United States Patent 8,781,750 (CELL-TYPE-SPECIFIC PATTERNS OF GENE EXPRESSION) - sequence listing, part 24

SEQ ID NO: 36747 - DNA, 332704 bp, Homo sapiens
gtggccgcggccaagtcacttgccttacggggcaccagtgagttccctgtcaaacagaggacaccccccaagacaccccgcgtgccctccctgtccaggaggggcccgtccacgatccaagacccccaaagtgccctgcctgtccgggaggggcctcgcccacaatccaagacccccgagtaccctccctgtccagacctcgcccacgatccaagaccccctgagtgccctccctgtccagacctcacccacgatccaagaccccctgagtgccctccctgtccagacctcgcccacaatccaagacccccgagtaccctccctgtcaaggcctcgcccacgatccaagacccccgagtgcccgccctgtccagacctcgcccacgatccaagacccccgagtgccctccctgtccagacctcgcccacgatccaagacccccgagtgccctccctgtccagacctcgcccacgatccaagacccccgagtgccctccctgtccagacctcgcccacgatccaagacccccgagtgccctccctgtccagacctcgcccatgatccaagacccccgagtgccctccctgtccagacctcgcccacgatccaagaccccctgagtgccctccctgtccagacctcgcccacgatccaagaccccctgagtgccctccctgtccaggcttccaccacgatcgctctgggggtgctgctctcgtgccttggagtgctgagtgccaccaggacccctgacccagacaacctctgtgtctggcactggggcccagcaggaaaacagtgaggcttccttgtttacctgctgtggcccaggagggccgtgggtggcatcacgccccaggctgcaggccagacagctctgtcacctggcacgtggcttcaggcctccctctgtggccgtccttgccagcagatctggacctccagggcctgggtgaccacagggggcgatgctgacagggaaggagtcctgccaggtttctgtgacctatgggtctgcctgcctgaccccccaagaccggacacctgagggcagacggccatactgactcatcccctcccacggcctgggccagggcaggtgtcacaagtgtttgctaactgagcaatcatctgtgctaaccctccccacaccctggctgccaaggccctggaggtgcagccctggtcctgggcttcagctccatccaaggggagcctggagcccctgccagtccattctgtctgctggtgggtgcccctggcctgggtcccatatgcctgacctgggctgccacgggcctggagccacgcgggcagccagtgcccacgttccccagcagttgtgctgggccgggtcccggccacctggactgtgtaggagctgggatcagctcgggtgactcagaaaaggcttcaggcagccttctggggacttgaccccaggcctgtgagagtccctgccttgggcaggatacggtgtccctcacacacaccctcaggcaccagcactgggagtgggatggccttgggcaccttgtgagctggggcaggtcttggggctgggctggactgagccacctgccttctgcccctgcaggcgcgcctcaagttccccatcgactacccatactctccaccagcctttcggttcctgaccaagatgtggcaccctaacatctacgaggtgagcgcggcccccacgggcctcaagtcctcatcctccgggacccagggtgctgggagcctcacgtcctcatccttccgggacccggggcgctgggagcctcacgtcctcgtcctccgggacccggggcgctgggagcctcacgtcctcgtccttccgggacccgaggcgctgggagcctcatgtcctcgtccttccgggacccggggcgctgggagcctcacgtcctcgtcctccacgtcctcatcctccgggacctggggcactgggagcccgtgctgacctctgacctgttctgacctgtcttcttcttgtgcagacgggggacgtgtgtatctccatcctccacccgccggtggacgacccccagagcggggagctgccctcagagaggtggaaccccacgcagaacgtcaggtaagccggcccaaccccctgtgtccacccagaacatcaggtaggccgggctccgtcccgtatccacccagaccatcaggtaggccgggctcccccacaggctgtggcgccaaggcctgattcgggacctgccagctggcggtcctgggcctcgctgtacctgcacggtaggtgctttcacggggcctgcggcaccgtgtgtcggtgcagactcccaccaggaccccaggccggccccaccgtctggaaccacctagaggtgtcccgccatcctcagtcctggggccttctccttacccagccgtctctgggttggtcacctcgtgccacgtgtgccgcctgggcctcgtccccaggtacaagcactgggccgtgttgcccgtgtgtcctggagtgtagtctaggcaggacgtgcgggtgtgagggcagccccgggtctgacggaggggtctgcaccttgctgccctccctggtcttggcgtgggagggaggagactgatgcaggtccagcccctgctgttctgggggcctgagacagaagcagaggccatgaggccaggtgaaggtcacctgctgggtgggtccaggcgtccccgtgaccctcagggccagagaagagccggaaggctggggtgccccgggccgccccactccgacccactctccccacaggaccattctcctgagtgtgatctccctcctgaacgagcccaacaccttctcgcccgcaaacgtggacgcctccgtgatgtacaggaagtggaaagagagcaaggggaaggatcgggagtacacagacatcatccggtgagggcgggcgggggcgtcacgggaggagagactcagatccggcctgcaccccggcccctggtcccacggccgcccagccccaccttcctggtgagggtggcggagcttcctggtgcccatttacagggtgccagtcacagatggaggccgggccgagtggcggagggtccagccaggttcaagcccagcttcttgccccttttcctctttttttttgtttgagacagagtctctctctgtcacccaggctggagtgcagtggcgcgatctcggctcactgcaagctccgcctcccgggttcacgccattctcctgcctcagcctcccaagtagctgggactacaggcgcccgtcaccacgcccggctaattttttgtatttttagtagagacggggtttcagcgtgttagccaggatggtctcgatctcctgacctcgtgatccatctgcctcggcctcccaaagtgcagggattacaggcgtgagccaccgcggccggcctttttttttttttttttttttggagacagagttatactctcttgcctaggctgcagtgcagtggtgcgatctcggctcactgcagcctccactactcgggttggagcagttctcccccttcatcctgccaagcagctgggattacaggtgcccactaccacgccgagctaatttttgtaatttttagtagaggtgggatttcaccatcttagccaggctggtctcaaactcctgacctcaggtgatccacccgcctcggcctcccaaagtgctgggatgacaggcgtgagccactgcacctggcctggtggttagtgttttcatagattcttccaggcttttcagtttaacgcatgtctgtgctttaatgaagaaatggggtcgtgctgtgtgtgcccagtgactgactgttagggaacatgtgtctgtgccttaatgaagaaatggggtcgtgctgtgtgtgcccagtgactgactgttagggaacatgtgtctgtgctttaatgaaaaaatggggtcgtgctgtgtgtgcccagtgactgactgttagtcaggggtgttggccttactcatgtctggagtgcgtccctgcaggctcttggcctggtgagctctgggtacagctgtgcagtcgcctaccggcgccttctgtacctgcagtccacttagcttgcgtggctgtgtgtggtgacccacggctctccctctcctcccatcgccctcatgccccagagctgagccccacagccccttctcttgggtgcctgtgttcacatgaatgtgtaaacacgtgcgtgtctgtgtacaaagacaaggctttctttacgggttgacggccttaatggttcctgctcttcctgttacatagaggcccttcctatccattttttttttttctcagagtgatattgcatagatttcctcacagaggcctcacctatttttgttggtattttgtataaacagaatcttaaaaacaacttttaaaatattgcacacataatgcatgtgtcttcctcgccccaggacccaggagcatccagggcaccttccatcctgcactcgctggtacctggtgtcgtggggtcatctcggggcagcatcctggtgctgggcggtctcggctctgagcagccatggtgggcgggccccgtgcggcctcctgggaagtggcctgcaagcacctgctggcctctggaggtcacagggtagctgccctggccgtccctctggtgcagatgtcctcggtggccccggtccggtcgtgtcacctggcccaggtggctggctccttggcccggttcttcccggccacctccctgaggcaccacctccttgagatcccagcacagaaataaaagccacactatttttatccctcaaaactccctgtgggccaacacacatgtgccatgtggactctgctgtggtcgccgtttctgcctgttttttcatctgtgtgcgtgttggcctcgtggcagcccaagtcccgctgagctgtgtcgggcaggctgccgtggagcccggcttggtcagggatgttggtcttgctgaacaggacctccagaccgtcctccagctcatgctggcggtgtgccggcggcacctccacggtgcaggtcagttcccaccctggccctcccctgcgtctccccacagccgccacctctgcggtgccgtccccggggcaccgtcacccccccagcccgtccaccctggccctcccctgcgtctccccactgctgccacccgtgcagtgccgtccccggggcactgtcagtcacccccccagcccatcggagagcttggaaagcaaagcttggcgtccgctgggtcccgccacccagggacgtccctgaggccagacgcctgccctccacgcgtcatgcatccccataaaaagcactgggcttgtgggctgggcttggggctgtctgtctgctccctggtgccctcccatgcgggcactgtgggacccgcacaccctggtagcagccagccccagagcccagagccgtgcctggtcggtgataggggctcgagcccattgcctgcggctgcagcctcgttcctgttttctgtcaaatggggtcagcgtgccgcctggccctgctgtgccacccccggaagcccctttgcttccagtcctggggggacattcttgacgcgtgtcctggaggtggagccgggggcaggttcctcgtaggtcctggtgtgcgcggtgcagcccctcatagggccgggtgtacacggtgccctccaggaagtttgagctaacttgtcctcccttcctgccagaggctgggatggccaggccccccaggtttagaatccggaggccggggtggccaggcccccaggtttagaatccggaggccggggtggccaggccccccacgtttagaatccggaggccggggtggccaggccccccaggtttagaatccggaggccggggtggccaggccccccacgtttagaatccggaggccggggtggccaggccccccgggtttagaatccggaggccggggtggccaggccccccgggtttagaatccggaggccggggtggccaggccccccgggtttagaatccggaggccggggtggccaggccccccggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccgggtttagaatccggaggccggggtggccaggccccccacgtttagaatccggaggccggggtggccaggcccccgggtttagaatccggaggctgggatggccaggcccccgggtttagaatccagaggctgggatggccaggccccccggtttagaatccggaggccggggtggccaggcccccgggtttagaatcctgctgaggccacggagaggctcaggccgtttttgcgtttcccatctcacctgtgctggttcccgtctccagggatggtcctgcctcctgtccttgggccctcccagctgcttcctttgctcctgcgctgaggaaggcttttgccccccagtggggcagcatgggccctccctgttgccggcatcgttattttctcccagctcctgatgggtcccttgggttgtgcttcggggcggggcaggcgggtgtgactgcactgcgcccgtccagcctcccacccgcacctcctgcccttcccgagccccctcctctgtcatttctccccctggagttcctcacgcacagggctttgtcctaagtggtcgccacacgccgttttaagagaaacctgagcgttggggtgagcgtcggacctgggggaggggggccgggcaggggccgagtccaggcacgtgggtggcgccctcacccaccctgtccccccaggaagcaggtcctggggaccaaggtggacgcggagcgtgacggcgtgaaggtgcccaccacgctggccgagtactgcgtgaagaccaaggcgccggcgcccgacgagggctcagacctcttctacgacgactactacgaggacggcgaggtggaggaggaggccgacagctgcttcggggacgatgaggatgactctggcacggaggagtcctgacaccaccagaataaacttgccgagtttacctcactagggccggacccgtggctccttagacgacagactacctcacggaggttttgtgctggtccccgtctcctctggttgtttcgttttggctttttctccctccccatgtctgttctgggttttcacgtgcttcagagaagaggggctgccccaccgccactcacgtcactcggggctcggtggacgggcccagggtgggagcggccggcccacctgtcccctcgggaggggagctgagcccgacttctaccggggtcccccagcttccggactggccgcaccccggaggagccacgggggcgctgctgggaacgtgggcggggggccgtttcctgacactaccagcctgggaggcccaggtgtagcggtccgaggggcccggtcctgcctgtcagctccaggtcctggagccacgtccagcacagagtggacggattcaccgtggccgactcttttccctgctttggtttgtttgaaatctaaataaaactactttatgagaggccagagaagctgtgcttgggagggagaggcagcctccacgtccatgagtgactgcacacggccagtcccactgggaccctggctacgccaggtgtggatctgggaggcctgtcctgggaggcacggggagcagccgggtcccgcggcctgtacgttcccatgacttgggtcagacaggcctgggcagcatcccccagcctgcgggacaggggcggccagaaagcccccagagttcctcctccctgtgaccaggtgcatctagtgggacgggagctgcctctgcaggcatccagcaaagcttcgtcgcgggtccacagccgcctgggcgttgatctcagcgtctcagggctcccaggaccacagatgcccccgatcagcactccggcggctccagctccgtccaggcacaccctcggggtggggagccgtggccctgggcacacagggcaggcacctcacgtcctggtgtcaggaagtccccagcatcgttttattacatgtcatggaggaaagctcggagctcccatgccctcccggggcaccgccttccaggaacctgcctgcgttccgcttctgggcacccggaaagtcgctcagtggctgattcagggtcgaggagctgtgaggatgaggtttcccaccaagttgggacagaaaatggggccctggggtctcagcaaaccatggccctcgggaccaaacctggcgtccgcccctattgtgagtgaagtgttactggcacagccacacccaggtctcaggatcatccatagctgcttggtttggtttggttttgtttttgagacacagtcttgtgttgcccaggctggagtgcagtggtgcgatctcgcctcctgggttcaagtgattctcctgcctcagcctcctgagtagctgggactacaggctcccaccaccatgcccagctgatttttgtatttttagtagagatggggtttcaccatgttggccaggatggtctcgaactcccaacctcaggtgatcgcccgcctcggcctcccaaagtgctgggattacaggcgtgagccgccgcgcccggcctaaatttatttatttttgagacagggtcttgctctgtcacccaggctgaagagcagtggtgcaattacggctcactgcagccccaacctgggctcaagcgatcctcctgccccagtctctcaaagtgctgggattacaggtgtgagccaccgccttcggccagtgtctttattcatgaagaccaaaaactagaacagcgcaaatatccgtccgctggtgaatgcataaacacagcgtggtccagccacacaatgggatgtgacacagccacaaaaaggagcgaggctctgacacaggccacagcctggatgcaccttgaggacgtcatgctgggagagacgccaacgcaacaggtcctgtgtgattccactcctgggaggtccctagagaccaattcagaggcaggaagtagtggccgggcgcggtggctcatgcctgtaatcccagcactgggaggccgaggtgggtggatcacctgaggtcgggagtttgagaccagcctggtcaacatggtgaaacctcgtctctactaagaatacgaaaattagccgggcgtggtggtgggcacctgtagtcccactactcgggaggctgaggccggagtatggcgtgaacccgggaggcggagcttgcagtgagccgagatcgcaccaccgcactccagcctgggcgacagagcgagactccatctctgaaaaaaaaaaaaaaaaaaaagtgttactttgtcaggtgtgatgatggtagtgtggcttcatctcgagtcctctttgagaaacactttctaaaatgctcaaggatggagggtggagggtgtgcagcggtgggcggggctgtgaccgtcacctcacctcccccacaggaagcgcgtgtggggaggctcggggccggggccagcacccacactgggtctccacagcggcatggaggcctgcgtgtcttcactgctggtgctggccctgggggccctgtcagtaggtgagtgggagccgggatgcaggggggacactgaggcccagcgctctcggtgggtccctggatgggaggggtgggcgcgggcgccgacatcctgggtgtaagagcggagattcatccttgtttggagggggactgaggcctggggcatcccgagctcctcacgcttcaccccgagtggacatcccgggaccgtgggagagtgtggtgtccaccggctcacctcgcccatcctcccggcagcagccagaaggcaggggtcacgctcacacccgaggtgcagagtaggagactgagacttggcgaaggagatgctgacctaggactgcccagctgggagggcagagctgggactcgatccccgctggctgcctgccaccaccaagggcttggctgggactaggtgcccagcagtgagggagaagggaggtgggtggcggctcccctgcattccagctggactgagtgacaggggctcttgatgagttggggacccaagaagatggacagaggtaggaatccagccgtcagtcatcatcatccttcctcccatttttatttccttccacccatgggtccatcatccctccctccctccctccctccctccctcatctccccttccttccctctacccgtccgtccacccatcattcctccttccattcttccacccacccatccatcatccatccctctacccatgggtccatcatccatccctccctccctcctttcgttcccccttccttccctccgccagtccatccacccatcattcctccttcctcccattcttccacccacccgtccatccatcatccatccctcctttcaacctccctccttccctccacccgtcatccttccctccctccttccatgtatccacccatccatccatcatgcctctctcttcctttcccccctccttccctcctccctcccatccatccatcatccattcctccttccatccctccttcctttctcccgtgcttctgtgtatccatccgtatttgcagggctcgtgctgttctaggcctgccctcctgtctgactggaagagacaggccaggcatgagactgtgcagagcggaggaaacacggagggcaagagggcgggtggggggccgttgcaggagacgagcataaaccaagggaggaagccggtgggggaaaggtacgcaggcagctaagtgagacagacaaaggcccagggtgcaggcagcttgcaggcacagctagacttgcactcttgtcacccaggctggagtgcgatggtgccatctcggctcactgcagcctccgcctcctggtttcaagcgattctcctgcctcagcctcccgagtagctgggattacaggcgcctgccaccatgccgggctaattttgtatttttagtagagacagggtttccccgtgttggtcaggctggtctcaaactcccaacctcaggtgatccgcctgcctcggcctcccaaagcgctgggattacaggcgtgagccaccgcgcccggcctattttttttttttaagatggagttctgctattcttgcccaggctggagtgcaatggcacgatctcggctcaccacaacctctgcctcccgggttcaagcgattctcctgtctcagcctcccaagtagctgagattacagatgcccgccacctcgcccggctaattttttgtatttttagtagagacggggtttcaccgtgttagccaggatggtctcgatctcctgacctcgtgatccacctgcctcggcctcccaaagtgctgggattacaggcgtgagccaccgcacccggccttaatttctgtatttttagtacagacggggttttaccacattggccaggctgatctccaactcctgacctcaggctgtctgcccaccttgacctcccaaagtgctgggattataggcgtgagccactgcaccggcccgcaagcggggacttgattttcaaagcatgatggggattcagagaagattttgagctgatttacgttacattatgaaatcaatccttttatatttatgattgatttaaaataatttttgtacagctttattaggaaattatgcactatacaatttacttatttaaagactacatttcttgctgggcacagtggctcacgcctgtcatcccagcactttgggaggccaaggagggtggatcacctgaggttaggtgtttgaggccagcctggccaacacggcgaaaccctgtcgctactaaaaatacaaaaaaattagccggacgtggtgatgcgcttctgtaatcccagctactcgggaggctgaggcaggagaatcgcttgaacccaggaggcagaggttgcagtgagctgagatcacggcactgcattccaggctgggtaacagagtgagactccatctcaaaaaaaaaaaaaaaatggccaggtgcagtggctcatacctgtaatcccagcactttgggaggctgagatgggtggatcacaaggtcaggagttcgagaccagcctggctaacatggtgaaaccccatctgtactaaaaatacaaaaattatccaggcgtggtggcaggtgcctgtagtcccagctactcgggagactgagtcaggagaatggcatgaacccaggaggcggagcttgcagtgagccgagatcgtgccattgcactccagcctgggtgacagagcgagactctgtctcaaaaaaaaagaaaaaaaaagttttttttaagagactgggtcttgctgtgtcgcccaggctggtctcgaactcctggcctcaagtgatcctccctcctcagcctcccgaagtgctgggatcacaggggtgagccacccacatccggcctgatgtgcgttttgaaggactcctgtggctgtggggcccagtggggcctggggaggtcctggagaggggattgggaggtggcctggggggaacatgatgggggtgatgagagggggatgggagggatgaagggcagcccacacgtatcagcctaaaagtttcggggaacactggggacttcattaggatggcacatctgcttggggtcctgggcctctgagctgggcaaggacagtcgcagcaggcagcaggggcatgtagccccaacctggctctttgtcccccatcctggcaggcagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggtgagtaccctgccctgcccaccccaggggtccggggaatccatccgacggcgcccattctctgcagggggtgggctctgggagatttaggcccattgtgggacccccgtcccctcccggtgacgacttaggcaggtttaagtgacctgcggctgtgggactcctggagaaggtttactccttgcaagaggcactggcagggccagctccttccacaccgcagcctgggtcagagcctggctcctttcacggctgagccacagtcctggtgtggacagagtgcattgtgtctgtccattcacctgctgatggacccaacttaggcgggggcttctgctataaggaaggagggtcaggtgggggtgtttgccacctgtggccaggaggtcgaagccggccttcgagagtggctcgggaatcgacctggttcccggggatcaggaagccgctaaatgacccatcatggagttgccctacctcaggactggtccgtcatacagagcccagatcaagatggtcaaagtaacaaaaagggatctgccggcttgtgtaactgcaaagtctaggaggaggcctggcttcaggtgcggcttgatccaggtgctcacaggaggcgctgtggagcccatctgtctcccagctctgctgcactaccaggaagcctgtctcacaaggtggaaagattgaccctcctcagtcccatggaaagagggcttggctctctaaagttggggcacacttaggaggattggcatgtgtcaacccctgtacaaatcactgtggttgagcctggggccccaagtgaagggaattcccagggctggttttcgtgaagctgtaggcttggggttggatttttggacacacagcccttgcctggggccagggccgggcagaagtctggggcaggggtgagagcagggagggcttcctggaggaggtgggttgcaaagacacagggaaggactggccaagccaaggcctgtgaggggcagcggctgtgagtgatggccatggacaacgggcacagtgggggccgggactgcatgtggcgggtcgtccacgccgggccaggccgcagcaccctgattccctctgtccccaggatggcccagctgaggctggtgctggggctccacaccctggacagccccggtctcaccttccacatcaaggcagccatccagcaccctcgctacaagcccgtccctgccctggagaacgacctcgcgctgcttcaggtgtgcagggacgggacagggagaactgggcaccctcctgtcccccacgggtgcccctcacccccactgcgccctccccccgctgccgaccctccccccgcactgctgcccctccccccgcactactgccccctcccccattgcccaccctccccccactgccacccctccccccgctgccgccccccgcccccgcactctcaccccctccccctgctcacctgccccttcctgtcactcgtagctggacgggaaagtgaagcccagccggaccatccggccgttggccctgcccagtaagcgccaggtggtggcagcagggactcggtgcagcatggccggctgggggctgacccaccagggcgggcgcctgtcccgggtgctgcgggagctggacctccaagtgctggacacccgcatgtgtaacaacagccgcttctggaacggcagcctctcccccagcatggtctgcctggcggccgactccaaggaccaggctccctgcaaggtgaggggcgcccgggtggggctgggggaatgaggctggcgggagggccggggccagggcagccgccgggcaggttcctggctctcccgttctctggggagtcctgtcaggggctggggggcggggaagcactggcaggggtcccgtttctcaggtgcagaaactgaggctcagacaggtttagcaacctgcgcaagaccacacagccgggaagcggcagagctgtgacttctgctccagccaagacggtccggcgggggaagaaggagcagggttcacagggccagcgggagatggggaggggacacgcgtgggccgggagcagcccctgtgtctccttgagcctggggataacaggcctggccctgctcccctcggcgggccctgctcccctcgtcccctcagcaggtgcagaggctgagctgcggtgtgtcgtccctgcagggtgactcgggcgggcccctggtgtgtggcaaaggccgggtgttggccagagtcctgtccttcagctccagggtctgcactgacatcttcaagcctcccgtggccaccgctgtggcgccttacgtgtcctggatcaggaaggtcaccggccgatcggcctgatgccctggggtgatggggaccccctcgctgtctccacaggacccttcccctccaggggtgcagtggggtgggtgaggacgggtgggagggacagggagggaccaataaatcataatgaagaaacgctcagagcccgcctgagtcccagcccacctctgtccatgctggctgtggggcttccgacaaacctgtttccctcagcctcccgagtaactgggtctacaggcgcccgccaccacgccaggctaacttttggtatttttagtagagaaggggtttctccatgtttgtcaggctggtctccaactcttgaccttgtgatctgcccacctcggcctcccaaagtgctgggattacaggcgtgagccaccgcgcccggcccttccctgttttaaaaagggaggttgtggatcccaaggcttctcccaggagggggcggcgttggccaggactggagcggtggccgggtctgcaggctggcaggggtgggcggccgtcctccccgcgtggctcctggggctgggccttgaacagcatcccaggatcttcttttttagtaacagcttttatcaagttacaactcacatagcagatgagtctccctgtaaactgcgattcaggggcctttggtacctgcacagagctgggcaaccaccaccgtgacatgtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcccgtccccagtcaccccagcaccccgaaaacaggcctgtcccctgtcaccccagcaccctgaaaacagtcctgtcaccccagcaccccgaaaacagccctgtccccactgtcaccccagcaccccgaaaacaggcctgtccccactgtcaccccagcaccccgaaaacaggcccgtccccactgtcaccccagcaccccgaaaacaggcctgtcaccccagcaccccgaaaacaggcctgtccccctgtcaccccagcaccccgaaaacaggcctgtccccactgtcaccccagcaccccgaaaacagccctgtccccactgtcaccccagcaccccgaaaacaggcccgtccccactgtcatcccagcagcccgaaaacaggcctgtccccactgtcaccccagcagcccgaaaacaggccccatctctatcaccccagcaccccaaaaggaagccccacccccattgtcattccagcaccccgaaaatagactctgtccccactgtcaccccagcaccccaaaaggaggctcgtccccatcggccgtcactccccgtccccaccccagccccggtgccctcacatcccctccctgtctctggatgggcctgtgctgacatttcatggacaggggatcacgctgcgtggccttctgtgtctggcgtctcccgctgagcgtgacgtcctcaagctgcacccgcgcgctggctgggtccgagccgtgctcctgctccggggggtcgagctccagctcgaggggggcctcgctgcgtttgtgggtgcgtccctgggtgcacatctgggcggcttcgtctgcgtccgtccgtctgaagctttgctgggagccgcctgtgtgcgttttcgtgtggacctacctgctccttcctccctccagattagacccgtgggagtggcatctcgggctgttcagtgactctgtttcagcgccgcgctgttttcctgcagaatcttttaatttcactaccaactctttctttcttttcttttctttcttccctttcttccccttcttctctttccctcccttccccttcttctctttccctcccttccccttctctcccctcccctcccctcctctctctttctttctttcctttctttcctttcttccccgtctccccttcccctcccctcccctctcctcccctcccctctcctcccctcctctctttctttctttctttctttcttttcttttctttttttcttttattttcctttcttttcttctgatggagtctcagtgcgtcacccgggctggagtgcagtggcacgatctcggctcactgcaagccatctcaggttcaagcgatgcttgtgtctcagccacctgagtagctgagggatcacagacgtgcaccaccacgcccagctaactttttttgtatttttagtagagactaatagaaacacaggtttcaccacgttgaccaggctggtcttgaactcctgacctcaggtgacccgcccacctcgccctcccaaagtgctgggattacaggcatgagccactgtgcccacgttaatggttttttattattttattttatttttagacagttcccactctgttgcccaggctggagtgcagcctcagcctcccaagtagctggaatcataggggtccaccaccaagcccagctaatttttttggatttttactagagacggggtttcaccatattggtcaggctggtctcgaactcctgacctcaaataatccacccgcctcggcttcccaaagtgctgggattacaggtatgagccactgtgcccggccgggttagtgttgtaatagacttaatttttaaaaccatttttggtctgcaggagatgtgtggcggctgtatccacagggtcccccgcgtccccgcccccaggctcctggccgctcccctctccagtcagcaggagtcacggctgacgaactcacatgaatgcgtgattaactactaaggacctactcttggctcggatttcctcagtttcccctaatgtctcttcctgcacagggtcccacccgggaccgaacctgccgtttcgccgcagcctctcctcggcacccccaggctccgaccgtttctcagaactccgtgtctggaggccggctggacgggatttatgtagattacgggtgtggaccactgcacccgccagctatctcatgtttttctctcgattggactggagtcacagtgtttttgggagaggcaagtgcatttttaatctttaacttttttaatttttttatgttatttttttagagactcctgggctccagcaatcctcccacctcagcctcctaaaggattacaggtgtgagccaccgcgcccggcctaatctttaactttttatggcatcattggcagtggaaggttctcaggtcacaagtgaagagcctcataactcacaaaccaggcacgcccctgttcccggcacctgggtccagacacaaccccctgccccgaagcccctccttagccaagtacccaagtccagtctcttttttttttttttgagattcgagtctcgctctgtcccccaggctggagtgcagtggtgcaatctcggctcactgcaagctccacctcctgggttcacgccattctcctgcctcagcctccccagtagctgggactacaggcgcccgccaccacgcctggctaattttttaaatatttttagtagagacggggtttcacggtgttagccaggatggtctcgatctcctgacctcgtgatccacccacctcggcctcccaaagtgctgggattacaggcatgagccactgcgccccgccccaagtccagtctctaaccccagagatgggccctgcctgtttgggttctttttttgttttttgtttttgtttttgttttgacacggagtctcgctctgtcgcccaggctggagtgcagtggtgcaatctcggctcactgcaacctccgcctcctgggttcaagcaatcctcctgcctcaacctcccgagtagctgggactataggcacgcgccaccacgcccggctaatttttgtatttttagtagagacggggtttcaccagattggccaggctggtcttgaactcctgacctcatgatccgccagccttggtctcccaaagtactgggatgacaggggtgaggcaccacgcccagcccctttgggtttttaaattgttcattcatggccaggcatggtggctcgcgccggtaatcccagcacatcgggaggctgaggcgggcggatcacgaggtcaggagttcaagatcggcctggccaacatggtgaaaccctgtctctacgaaaattacaaaaaaaattagctgggcatggtggtgggcacctataatcccagctacttgggaggctgaggcaggagaatcacttcaagccgggaaagggaggttgcagggagctgagatcacaccactgcactctagcctgggcgacaagagcgagactccgtctcagaaaaaaaaaaacaaaaaaaccataaataaaaaattttttaaaaaatgataaatgtttgcaactctagctatgttaatgtctgatcagcacacattgtatgtattgaaacgtcactatgtaccccatgaatatgtacaattattatgtgttctttttttttttgagacagagtattttgctcttgttgcccaggttggagtgcagtggcacgatctcggctcaccgcaacctccgcctcccagattcaagcgattcccctgcctcagcctcccgagtagctgggattacaggcacccgccaccacgcccggctactgtttgtatttttagtagagacggggtttcgccatgttggccacgctggtctcaagctcctgatgtcgtgatccgcccgcctcagcctcccaaggtgctgggattacaggcgtgagccaccgcgcccggcatgtgttcatttttttttaaaaaaaaaaaaggataaaaaggccaggcacggtggctcacgcctgtaatcccagcacttttggaggccaaggctggtagatcacttgagcccaggagttcgagaccagcctggccaacatggtgaaaccccgtctctactaaaaatacaaaaaaattaaaattaaaaataaaaacaaataaagaaaagataaaaagaaagccaggcctcttggcaatgaaagctgcccggggcagccctctccctcttcctggtgcaggtgtgttgccagcgtggatgtccttcgtggacgtgaacttattttacaaaagagcacttgtccagagctagtcctgagcctgcggtttctgggagtcaccagctcgaacgacgcaggacaagtacactttggggtggcacgtcctggtgctgttattttggggtggggtgtccttccgtggtacggctggaccacgttgcctctgtccactcactgccctcgagggatgggtgagctgtttccacctttggctgccgtgacctgggctgctgtgaacttcgcagacgtttgtgtttctttcccgcacggaaacttggacagaagctccttgtcacgtcccacagtcacacggcccctgcacgtgcttaaaagaagctgtggtgtttttttttttgttttttttttttttgttgttgttgtttgcttttttttttgagacggagtctctgtttccaggctggagtgcagtggcgcaatctcggctcactgcaacctcctcctcccgggttcaagtgattctcctgcctcagcctcccgagtaggtgagattacaggcacccaccaccacgcccggctaatttttgtattttcagtagagatggggtttcaccatgttggtcaggctggtctcgaactcctgacctcaggtgatccacccgcttcggcctcccaaagtgctgggatgacaggtgtaagccaccgtacccagcggaagctgcgattttccttattccttgacatcctcaagggagaccctgatgtagaggcagggaggctaggaaggaggaagcatccagcccagtggggtggacccgtcagaaatgctcagaggcggccgtgcatggtggctcacacctgtcatcccagcattttgggaggccgaggcgggcggatcacctgaggtcgggagttccagatcagcctggccaacacagagaaaccccgtctctactaaaaatacaatgttagccgggcgtggtggcgcatgcctgtaatcccagctactggggaggctgaggcaggagaatcgcttgaacccgggaggcggaggttgcagtgagccaagattgcgccactgcactccagcctgggcgacaagagcaaaaaactccatctcaaaaaaacaaacaaaaaaatgctcagaggcaagggttgagcttcctctccagcctcctccagaggtcacagggcaccgccccaccccacccaccccacccactgggtcctggggtgactccaactggacagagatcagtggaggccaggccaggctggtgtttggtgagctggagccacgccccggggagagagctaatctctgagcccggacgtgcctcatcagtggttccctcctgctgtgctgagatgtccccaccccagccccggtgagtgactggggacttagagacacagaaccagccaccagcaggaggctgacaccctgtgtgggacacgcagtgccctggaagcctccacccctccgtctgtgttttcgtggttttttttttttgagacagggtcacccaggctgcagcgcagtggtgcaatcctagctcactgcagcctcaaactgctgggctcaagcaatccccttccctcagcctcctgaggagatggggctacacgtgtgcaccaccacgcctggctaatgtttgtaattttgccgagatggggtctcagtatgttgcttaatggagtctcaaagtcctaggctcaagtgatcctcccgcctcgacctcccaaagcgctgggatgacaggtgtgagccactgcgccctgccagccctcgctggttcctcctggtgtaaaagggaacagccgagtgagcatctccgggtggccggtgggcagagctctggtctcaggtggtttaaactggacaggtgtcacccgggagcttgacagtgacgtgggaccacatgctgggtgacttaaacaacagaaggcagcccctccccgtcctggggcccggagtctgaggtcaaggtgtgggcaggcgccgctctctgagaggccccacggaggagtcctcctgccttctccagctccgggggcgccaggcgtccttggcttgtgtccacattgctgcagtctctgcctctgtccccgcagggacgtctccccatgtctcagtccaaatgtccctcttctgatgaggatgccagccattgcctcagggccacccttacaactttatcctaactacctctgccaaataaggccacattctgaggttctgggtgggcgtgagttttggggggcaccgttctccctgggaagacgcagacgcttgtcgtcccgtggtaaatgccagaaggcctcatctgatgcccacgtacgccctgaggtggggaagctgctgtcctcatccttgctgagcgtggggccccaggattctcaggcagctggatgagcctgtggagaggccggtgcccaggctcggtcccagaacaaagcgcagaggcacgatggtcgctgacaaagtgggggccccgggaccccaaacagaaaggtccacaaaggctgaggtcggggcaggggaatttgattcaagagacattttcagccatacggcccttctcgaatttttttttttgagacagtctcgctctgtcacccaggctggagtgcagtggcgcaatctcagctcactgcaacctctgcctcctgggttcaagcaattctcctgcctcagcctcccgagtagctgggactacaggcgcccgccaccacgcccactaattttatatttttagtagagacggagtttcaccatgttggccaggctggtctcaggtgatccacccgccttggcctcccaaagttctgggattacaggcatgagccactgtgcctggcctttttttctcttttttgagatggagtctctctctgttgcccaggctggagtgcagtggtgcagctgactgcaacctccgcctcccaggttcaagcgattctcctgcctcagccttccgagtatctaggattacaggcacgcaccaccgcacctggctaatttttgtatttttagtagagacggcgtttcaccatgctggccaggctggtctcgaactcctcaccttaagtaatccgccccacctcggcctcccaaagtgctgggattacaggcgtgagccaccacgcctggccccttattgaacttgatggtttctccttcgtatctcagaagtcacaagctggaggatttaggtttgaagaatcacgatgccaaggtcaggcgccgtcgctcacgcctgtaatcccagcactttgggaggccgaggtgggcggatctcgaggtcaggagatcaagaccatcctggccaacacggttaaccctgtctctactaaaaatacaaaaaattagccgggcgtggtggcgggcgcctgtagtcccagctactcgggaggctgaggcaggagaatggcgtgaacccgggaggcagaggttgcagtgaacagagatcacaccactgctctccagcctgggtgacagaatgagactgtgtctcaaaataaaataaaataggccgggcgcggtggctcacgcctgtaatcccagcactttgggaggccgaggcaggtggatcacgaggtcaggagatcgaaaccatcctggctaacatggttaaccctgtctctactaaaaatacaaagaattagccaggcgtggtggcgggcgcctgtagtcccagctactcgggaggctgaggcaggagaatcgcttgaacccaggaggcggagcttgcagtgagccgagatcatccagcctgggtgacagagcgagactctgcctcaaaaaaaataaaataaaataaactctgaaatttaaattaactgggtatttttatttgctaaatgaggccctacagggggtggtcctgaagaccctctccttggcagataaaagaggactgggatcttcttgcttctggggccagaactgagcagagcaggctcgggggttttgggtcgggggcaagggggtccctggctctgcctgagggtcagggaaggctttccagggaagggaccaggaaacagggtgttgaaggcggccacaggctttattttgtaaacaaagaccaagttcccaggagaactgacctcaggccagattggggccttgccaggggagggctgcggagggggcaggaattgggccaggccctgtggttgtttacaaccctggaggggctttgaaggcagctggccctgctgggcctcatccgcgtctgtgtcctcgttctgcacgtagcttcagaccctccccctccaccccccgcccccatgaggactttccaagcctgtggccccccaggtgggagctctttggcaccggtggttctgaggctccaagtcccctgatccgaagccatccccgagagggggtctcccagagtgggaagcgggggtctcccagagtgaagccctcagccccgtccaggccctcggcccccagcatcttcccaccctggctgggcccagccttcgccctggatggggttttctgcccctgcccaccgtgtgctggcccctcggttacgcacatcaccctatttatttatttagagacggagttttgctcttgttcctcaggatggagtgcagtggtgcgatcttggctcactgcaacctccgtctcccaggttcaaaggattctcctgcctcagcctcttaagtagctgggactacaggagcccgccaccaggcccggctaattttgtatttttagtagagacggggtttctccatgttggtcaggctggtctcgaactcccagcctcaggtgatccgcccgcctcggcctccgaaagtgctgggatgacaggcgtgagtcaccgcgcctcatcccctcctcagccccccagcacccacacgtcccctccctgtctctgtggatgggcctgtcctggacatttcatagacatgggatcacacagtgtgtgtccttctgtgtctggcgtctctcactgagtgcgacttcctcaaggtgcatccgcgccgtgggctgcgtccgagcctcgctcctgttcacggctgagtcgtgtcccattgcgtggatgggccatgctgtgtctgtccattcattctctgtttttgtttgtttgtttgtttttgagacggagtctcgctctgtcgcccaggctggagtgcagtggcgcgatctgggctcactgcaaccgccgcctcctgggattacaggcgcccaccaccacccccggctaatttttgtatttttagtagagacggggtttcaccctgttggccaggctggtctcaaaactcctgatctcgtgatccgcccgcctcggcctcccaaaagcaaccattttatttgtataactgtgtccaaattgttagaaataagtgctgggtcccgcaaagagaaaccagcccttagaaacctatttcccagcgagacaactttactatacagaatggggctgccccggagctcacgggacgaaggaaggaaggagcttctgttcccccgctggctggggctggacgccctcatctaagctcatcccggttggctaagacttaaaactgtctccaaatcgggtaaaggcaagatttgcgagaagaggagggctagggggaagaagggggtagggttgattgacaacttatgacctggaagttgagttttgtaagaggaatttggttgtctcaacaatttactccttttctgttttatacttcttcctcttcaaatttatttatttattttgtttgagacagagtctcgctctgtcgcccaggctggagtgcggtggcaccatttcggctcactgcaagctcggcctcccgggttcacaccattctcctgcctcagcctcccgagtagctgggactacaggcgcccaccgctacgcccgcctaattttgtgtatttttagtagagatgggggggtttcaccgtgttggccaggatggtctcgatctcctgacctcgtgatctgcccacctcggcctcccaaagtgctgggattacaggcgtgagccacggcgcccggcctagttttcttttttttttttttttttgagacggagtctcgctctgttgcccaggctggagtgcagtggcgcaatctcggctcactgcaacctccgcctcctgggttcaagcgattctcatgtctcagcctcctgagtagctgggattacaggcacgtgccaccaaacccagcttatttttgtattttggtagagatggggtttgaccacgttggccaggatggtctcgaactcctgacctcgtgatccacccacctcggcctcccaaagtgctgggattacaggcatgagccaccgtgcccggccttcaaatttctttaacaggatttggctttgttgttcttcttgatcgtctaggaacaagagcttatcggaatacagagcaggagaggtaggggaggtttttgtgagagctgcttctgtgagtctttgggttaacccgcgaatacaaaggtatgacacagcagcccacaggatgagtcctcctgtagcaattgcgagggaggtaaagattgaggtcagcccgggcgcggtggctcacgcctgtcatcccagcacttcgggaggccaaggcgggtggatcacaaggtcaggagtttgagaccagcctggccaacatggtgaaaccccgtctactaaaaatacaaaaaaattagccgggcgtggtggcaggtgcgtgtaatcccagctacttgggaggccgaggcgggagaatcacttgaacccaggaggcggaggttgcagtgagccaagatcatgccattgcactccagcctgggcgacagaacgagactgtgtctcaaaaaataaaaataaaaatgaagaaaagaacaaaaaaaagattgatgttatgagtcccttccattttccaaaccacctttccatcagtcccatcaaggggccatctattccagagtttatggctaattcatttgttaggtcggtaaggccctgtcaggctttcgagatggtcccatcagggcctgtattatctgggatcgaagtaacgatgcgctttatttatttatttatttttttgaaacggagtttcgctcttgtagcccaggctggagtgcaatggcgtgatcttggctcactgcaacctccgcctcccaggttcaagcaattctcctgcctcagcctcccaagtagctgagattacaggcgcccgccaccacgcccggctaattttttgtatttttagtagagacggggtttcaccatgttagccgggattgtctcgatctcctgacctcgtgatcctcctgcctcggcctcccgaagtgctaggatgacaggcgtgagccaccacgcccggccggtttgtgactattttctctaactttacctaatgtttccctttaatatttctgccaccatcctgagcgaatttcaacagggaatggcaccccagggtaccggttactacaagggctgggccaaggattttcttcagaagaggctgtctttggctgtggatatctttacggggtatatgaaccagacaggcatcaaacgaaactagctggggaaagggtgatcaccttatattgataataagacgtccttgggcggctacagggagaaggaagagacagattaaacctttttgaatgttaatttggaaggcgttgatcctggagtgaaggtccaagatccctccagggatggggccctttccgaccgtcatcttggtggtcaggagcacccgataaagtccttcccaggttggctgagtttttcctctttccaacttctgacaaggaggtgatccccaggctggtgtcggtgaactgggaattcgaggggtggaggccttgggtccggagggaggaaagggtggaagacaaaccacacatatagtttttgagaaactgatcttttgtttcaaatgtaggaaggtcagtagtggaagtcagataaggtagcccatagagcatctcataagggaacaggccaagatctttccgaggggcagttcgcattctttttttttttttgaaacggagtctcgctctgtcgcccaggctggagtgcggtgggcgtgatctcggctcactgcaacctccacctcccaggttcaagcaattctcctgcctcagcctcccaagtagccgggattacaagcgggcgccacgacgcctggctaatttttttgtatttttagtagagacggggtttcaccatgctgcccgggctggtctcaaactcctgagctcaggcggtccacccgcctcagcctcccaaagtgctgggattacaggcgtgaaccaccacgcccggcctgttcagattcttagtaaggcaaagggaaggcattctgtgcgtggtaaccaggtttccaagattaattcggttaggtggtttttttagagtttgattcattctttctaccctccctgatgagggtggatgccagggaaatattcccatttcattcctagtgctggggttagccccgtaatgatgtgtgcagtgaagggggtccccttgtccgaatccacgttctctattagtgcaaacctgggtgtgacgtgttcccacaggcctctgactacattgctggctgttgcgctcgggaagggggtggcctctacccagtgggtgagatggttgactgttcccagtaaatgtttgaggtgggctattgggggcatttcagtgtagtcaacccaaacactttggaacggcctcaaccctgggtttcttccctgggaggttgcctcttttttttgagatggagtcttgttctgtcacccaggctggagtgcagtgggaccatctcggctcactgcaagctctgcctcctgggttgatgccattctcctacctcagccgcccgagtagctgggactacaggtgcccaccacacctggctaattttttttgtatttttagtagagacggggtttcaccgtgttagccaggagggtctcgatctcctgacctcgtgatccgcccgcctcggcctcccaaagtgctgggattacaggcgtgagccaccgcgcccagcctggaatggcctcaaccctgggtttcttccccgggaggttgcctctttagggtttgcttattagcttttctgcacacgatgcaaccatccacatttgcctagcgagggtctctatcccacacacccacagactccaagggtctctatcccacacacccacagactccaagggtctctatcccacacacccacagactccgagggtctctatcccacacacccacagactccgagggtctctatccccacacacccacagactccgagggtctctatccccacacacccacagactccgagggtctctatcccacacacccacagactccgagggtctctatccccacacacccacagactccgagggtctctatcccacacacccacagactccgagggtctctatccccacacacccacagactccgagggtctctatcccacacacccacagactccgagggtctctatcccacacacccacagactccgagggtctctatcccacacacccacagactccgagggtctctatcccacacacccacagactccgagggtctctatcccacacacccacagactccgagggcatatatcccacacacccacagactccgagggtctctatccccacacacccacagactccgagggtctctatcccacacacccacagactccgagggtctctatcccacacacccacagactctgagggcatatatcccacacacccacagactccgagggtctctatccccacacacccacagactccgagggtctctatcccacacacccacagactccgagggcctctatcccacacacccacagactccgagggcatatatcccacacacccacagactccgagggtctctatcccacacacccacagactccgagggtctctatcccacacacccacagactccgagggtctctatcccacacacccacagactccgagggtctctatcccacacacccacagactccgagggtctctatcgcacacacccacagactccgagggtctctatccccacacacccacagactccgagggtctctatcccacacacccacagactccgagggtctctatcccacacacccacagactccgagggtctctatcccacacacccacagactccgagggtctctatcccacacacccacagactccgagggtctctatccccacacacccacagactccgagggtctctatcgcacacacccacagacttcgagggtctctatcccacacacccacagactccgagggtctctatcccacacacccacagactccgagggtctctatcccacacacccacagactccgagggtctctatccccacacacccacagactccgagggtctctatcgcacacacccacagacttcgagggtctctatcccacacacccacagactccgagggtctctatccccacacacccacagactccgagggtctctatcccacacacccacagactccgagggtctctatcccacacacccacagactccgagggtctctatccccacacacccacagactccgagggtctctatccccacacacccacagactccgagggtctctatcccacacacccacagactccgagggtctctatcccacacacccacagactccgagggtctatatcccacacacccacagactccgagggtctctatccccacacacccacagactccgaggctgcattgcacgtagcttggggacccgagtgagctccttgatgaagctctgacagtatttccctcatgaggggtttagacagcatttcccttcaatcctacttgaagggaaatccctacagagggaaagtggtacctactttccctctgggttctcctgagctcctatatccctcccaccctcccttccttcctgatggagtctcgctctgtcgcccaggctggagtgcagtggcgcgatcaaggctcactgcaacctccgcctcccgggttcaagcaactctcctgcctcagcctcccgagtagctgggactacaggcacccgccaccacacccagctgatttttgtacttttagtagagacggggtttcaccagtgttggccaggatggtctcaatctcctgacctcgtggtcactcacctcggcctcccaaagtgctgggattacaggcgtgaaccaccacgcccggcaacaggaggatttttattaaggtggtcaccggctcactggattcgcatccaaagactgagcgtggggccgggcgcagtggctcacgcctgtaatcccagcactttgggaggccgaggcgggcggatcacgaggtcaggagatcgagaccgtcctggctaacacggtgaaaccctgtctctactaaaaatacaaaaaattagccgggtgtggtggtgggcacctgtagtcccagctactcagagaggctgaggcaggagaatggcgtgaacccgggaggcggagcttgcagtgagccgagatcgcgccaccgcactccagcctgggcgacagagtgagaatccgtctcaaaaaaaaaaaaaaaaagactgagcgtggaacaaagggcttgactttgaagcgtgcagcggcgtgaaacttgcagtgcgggaaagtgaatttacagacgcaggacagaggcagttaatcgtacagtgacaggtttcgtaacctcagccgagcttgtgagcttgcggccgcattgagaaagaacaggagcttacaaaactggcagagtattttacggggagcgggaaacggaaggaggagtctggttcttatctttgcacggggggagtgcagtgctgggaggcgtctgggcggcattccttggggttctggctttttaaatggtgttttcaaggccttgcctgggggctttgcctgttgctggctttggggcgagtcagctttatacgaaaaaggtattttccgtttcttcaatttccgctttattccctccttgatgctttttataaataaggtttaatagaaagcatcactattttttatttacttctacagggggaagtagctcttttcctggcaggggtggacacgtagttatgggatgagctcggtggtactcggcctgtccacacgagcgtctctggctttgtcgatattcttgacaaggaggggaagagacaagagtacgaggcggactcccagtatggccagaactactcctagtaaggttttaaatcccccgagggatgaaaaccaaccacgggggggcggggggaacctggagaccattccggtttccaggtttgtgttggaacatgagctaagtctcgcattctcgcaattaattcatgacgtcctcctcattgtcatcgatttttaggcaacaattagttaaattaaactctccgcatatccctccttctgacatagatctagcgagagcagcaagaacaaagggaagagtagcatgtttgtacctaggatggacaagagatgtttgcccagaggagggggttgagcaaagcgacaggttaatagtaaaacaattaagatgacaaggaaaattactgggcttaagatttctaactacatttacttccttgacgaagcttcggccgtgcgtagactggtcagcttccggggtgactagagcagggctgtggtcactttcactggcatctgggtcctgtcgtaggatcagccggtttggatggtctgggtcttgctggctggtccacttgtcctgggctgctggtttcagccgactgtggagatcgaaggcacagttcctgaaacattaacagcagtgggagtggacaggatcgcagtctaggcccatcccatctgggtcccaaagtggttggattctatttctttttttttttttttgagacgaagtatcactcttgtcccccaggctagagtgcagtggcgcgatctccggtcactgcaacgtccgcctcccgagttcaagcgattctcctgcctcagcctcctgaatagctgggatgacaggggcacaccaccacgccccgctaattttgtatttttagtagagacagggtttcttcatgttggtcaggctgctcaaactcccaacctcaggtgatccgcctgcctcggcctcccaaagtgctgggattacaggcgtgagtcactgcgcccggccgatcttctttcaatatactttccagtttcttgggcaaactaagcttttttgtttggagaataacgtgggacctctgggaggggaggctccgggaggagaggcacagccagggcttcctctttagaatgtggtgtccttattactgcccgttttgcctcctcgtctgcctttgtttcctttggcctccagtgttcctgccttttgtgcaccctgcaacgcagaacagctacgtctttggggcccacacggcatcctggagctgtaaaatttctttttttttttttttttttcatatggagtttctctcttgttgcccaggctggagtgcaatggcacgatctcggctcaccgcaacctccgcctcccaggttcaagcgattctcctgcctcagcctccctagtagctgggattataggcacctgccaccgcgcccggctaattctgtatttttagtagagatggggtttctccatgttggtcaggctggtctccaactcctgacctcaggtgatccgcctgccttagcctcccaaagtgctgggattacaggcctgagccaccacgcccggcctaggagctgtaaaatttcttctttgtattttatttctttgcccccagcagttaaaagttctctttcttggctgggcgtggtggctcatgcctgtaatcccatcactttgggaggtggaggcaggcggatcacttgaggtcaggagttcaagaccagcctggccaacaaggtgaaaccccgtctctactaaaagtacaaaaattagccaggcgtggtggcgcgtgcctgtagtcccagctactcaggaggctgaggcaggacaatcgcttgaacctggcaggtggaggttgcagtgagccgagatcgcaccactgcactccagcctgggcaaaagagtgagactccatctcaaaaaagaaaaaaaaagttcctctatgggatggtctttccaattttcttttttctttctttcttttttttttgagacggagtctcgctctgtcgcccaggctggagcgcagtggtgcgatctcggctcactgcaagctccgcctcctgggttgaggccattctcctgcctcaggctcccgagtagctgggactacaggcgcccccaccacgcccggctaatttttttgtattttagtagagatggggtttcaccgtgttagccaggatggtctggatctcctgacctcatgatccgcccacctcagcctcccaaagtgctgggattacaggcgtgagccggcagctgcatattttcttatctgtttattaagtctgtttaagaattccacgggcctggccaggcgcggtggctcacgcctgtaatcccagcactttgggaggccgacgtgggcagatcacaaggtcaggagatcgagaccatcttggccaacatggtgaaaccctgtctccactaaaatacaaaaaattagccaggcgtggtggcgggcgcctgtaatcccagctacttgggaggctgaggcaggagaatcgcttgaacccgggaggcggaggttggagtgagctgagatcgcgccactgaactccagcctgggcgacagagcgagactctgtctccaaaaaaaaccccatgggcccttcatgtttcctctgttgtacgttaaatgctcgggaagtattttgggtttgcagatctgattcccgaatccttgtaattatcccatctccgagatcgctcatgttttttaggtcacattgtcatcccacccaggatcttgggccaggaatttacgctccgctgaaaggacgttctgaccggggggtgttcacgctcccagactaacacagcggcctgtgaatcatggttctctctctcctgagacgagagtactgagggtagacattaattcagcccaagcgtacagctgtggccccagaaattggtcaatttgatccgcgaatccaaaagggtcatctaacagtggtttgagttcttttagatttctaacctctgaactggttaaagggggcatttacgaagtcaatatcccttcctcccggtggtccttccctaaaggggaaaagggctgaggcaggtctttttgagcaggaggcaaaaggaaagttctgtgggtttttgtttgtttgtttgttttttgagacggagtctcgctcttgttgccgaggctggagtgcggtggcgcgatctcggctcactgcaagctccacctcccgggttcaagacattccctgcctcagcctcccgagtagctgagtagctggaattacaggcgcccgccaccacgtccggctaattttcgtatttttagtagaggcgaggtttcatcatcgtggccaggctgccagtcctgaactcctggcctcgtgatccacccgcctctgcctcccaaagtgctggaattacaggcgtgagccaccgcgcccggccgaaagtttcgaatatccctttggcattgttctgtttcccgttggagctttcctgaggaaggggcatgttctagtggctgtccagcggggatgtgggtggcaaggtccaggtggttctataggggagggatggaggggcggaggagcgggtgggggaggggcggaggggcgaggggtgggtgggaggggcggaggggcgggttggggaggggcggaggggtggggtgggtgggtggggggggcggaggggtgggttgggaggggcggagggggtgggttgggaggggcggagggggtgggttgggaggggcggagggggtgggttgggaggggcggagggggtgggttgggaggggcggaggggtgagtgggggaaggtggtctagaggatcccacccttctttagatatggggcgtctctgctaaaaatacaaaaattagccgggcgtggtggtgcgcgcctgtaatcccagctactcaggaggctgaggcaggagaatcgcttgaacccgggaggcggaggttgcagagagtcgagatcgcgccgctgcactccagcctgggtgacacagcgagactccaacacacacacacacaaaagatatggcgcgtctcattcattcacaagttcctcttcaaaggtttggctcgttcagcgccctcgttcttcgtttcctacttccaaggccaacctgacttcctcaccctctgggcctccccgtctgagtctcagtaaacaagtttcccgccggtcctgatctgcagagatggcacctgccacccactctgcacatccccctcccgtcgccacgggctcttcccgccagtgtagccacattcctgcccctttccagttagcccttcgcgttcggcttagtctgcggtcctcttgcattgcgactccgagtttaacttccaacacacactttcaacctccaagagacgcccccacctgtgtcgccccaatagcgacttttctcaccgtggtcgccgcggaacttcaagggtccttcctacccgcgttgctgagagtctgggtttacgcgtcacctcgggcgggacccgatcctccgctcctgaggcccccacaatgaagcagtcggacgcgtctccccaagaaaggtaaccgccagcctctcctgaaacagaatgggatccaaatgggatatttgggggcggcgagtcggtcccgcaaagagaaaccagcacttagaaaatttctcagcgagaccactttacttgtacggaagggggctgcctgcgtgggatgcaatctccagagcacacgggacaaaggaagggagcttctgttcctctgtcctttccctgttggctggggttggacgcccacaatctaagctgatcccggttggctaaaacttaaaacttttttaaaatagggtaaacgcgccacctgcgaggaaagaagaagggggtaaggttgattgacaactttagacctggaagttgagtttctgaagaggaacttacttgtcccaaccaaatggtgcacaggacgtttatactaagaaattattcattttctgagatccagattcaagtgccctttaagtatttttatttgggcggaggaggtcacttcctcccacctaatttattaatacgttcatatatatatatatatatgtacatttttaaaggcagagatgtgcgtctcgccatgttgccgcgtctggtctcgagctcccgggctcaagcgatcttcccgcctcgacctcccaaggctctgggagtacagacgtgagccacagcggccggcccgtgtttaactcagataaaatctgggtaacacactttcaacgcttcaaccccctcgggcgcaccgctctgcgctcattgcaactttgaaagcaggaaggaagaaatgcgcaggctccagccgcgtccccgcaggccccactcccgtttcctagcaacgccgggtcacgtgcgccgccgcccggattccgtagcgtgagcctgccggagccggcgcgtacatgcgagcgtgtgcgcgcgtgcgcaggcggggcgaccggcgtccccggcgctcgccccgcccccgagatgacgccgtgcgtgcgcgcgcccggtccgcgcctccgccgctttttatagcggccgcgggcggcggcggcagcggttggaggttgtaggaccggcgaggaataggaatcatggcggctgcgctgttcgtgctgctgggattcgcgctgctgggcacccacggagcctccggggctggtgaggagcgggtagggggcgggggtgcggtcctgcaggggccgggaatggaggccgcggtgccgacccgaagccgacgggagcctggggcctcggcgcggggcggcctggggtgcgaaaggccggccccgggggcttcccgcgccagcatggagcttgggggtgaagtcccagggtttgaggggggactagaggttcctcccggcgcggcctgccgggctcccccgggcgctccggcctcgagcccggcctctgtgtgtgggcgtgaagctccctgcttggaggcgggagccagggggtcctggccaggccggtcttggtcaggggaggtgggcgtcttgcttttcggtcacctggggttgggggtgacctgcttcctgggtgagggcgtctgcgaaggcggttggaggtggcccgcccgccggtcccatcggccaggagaagggagacccaaagcctgggtgagcgtcccctttggcctggagccaggggtcaggggctggttggtgcctgcccaacccgtcctgctggggctggactccgcaggacctggggaaagcggcctgggcgtggaatctggagacgggtccaccctgcctgcgagtgttagggtcagagaccctcccctgagactctctggggcccccgcaagggcccgtgcggcctggagcgatcatcttggcgctcccttctggaaaaggggcttttgtcctccaagagcacatggaggctctgagtgggtcagccctccggatcgggaagggattaccgttcttcacgggatttagccctggcgtcttgcctagggcgtgcacctgcccccgggtgttctcccagactcttaagacctcgcaggctccctcgaggggccctgcgtggaagggaaggcggaatctccctctgattctgcctggattcagcacccagaatgaggtggtctctgaacgcccctcctcctttacaggcgaggaaacagccctgtgggaagtcgaggttccaaggtcacagtgagggggccctggccacccgattcagcgcaggaaatagtgagaaagtcgtttttagccgactctgacccgcattcggtttccagtgctgtcttaggagggccgtgtgttgagggtgggcaaacgtggtttggagagcgcatttgggaaatggattgaggtgtgtttttccgggagaaaagcatgacatcctttcttgcttcatagaaaatttcttcctttgttgagacccccatttggttctgggttaaagatttatagtgaggccgggcgtggtggctcacacctgtaatcccagcactttgggaggctgaggcgggtggatcacctgaggtcaggagttcaagaccagcctggccaacatggtgaaaccccatctctactaaaaatacaaaaattagctgggcgtgttggcgcacgcctgtaatcccagccactcaggaagctgaggcaagagaatcgcttgaacctgggaggtgaaggttgcagtgagctgatatcatgccactgcactccagcctgggtaacagggagactctgtctttaaaaaaaaaaaaaaaagaggtcgggcatggtggctcacgcctgtaatcccagcactttgggaggccgaggcgggcggatcacgaggtcaagagatcaagaccatcgtggctaacacggtgaaaccccgtctctactaaaaatacaaaaaattagcctggcgtggtggcgggcgcctgtagtcccagctgctagggagtctgaggcaggagaatggtgtgaaccagggaggcggagcttgcagtgagccgagatcgcgccattgcactccagcctgggcgacagagcgagaccccgtctcaaaaaaaaacaaaaaaaaaatttattgtgaccgatgtgttgggaacaaggtgcagagctggagggtctggcctcctgaagggtcaagagcaagggcttcgagcctctgtcctgggcattgagccgtagggggccttgggcagaggctggggagggggctccttcttccagaggctttgccagctaactcctgacctacgtctgagatttcgtcttcctggtaaccaaagtggccctttatcgaatgtctcctgggcaagggcctggccccagcactgcggccagctctctggggagacacagataggagcccatgggtgaggtgagcgcggaagataagccgcccccgccagccctgtggaaacccagccaggcctgactgggtttcaagcacagcacgaggttcccacattgagctaatttggacagccaagtgggtgaaagacctttggtctctccctgctgggtagggtggttcacagttttgttccttttgtgcatttgtgcaggagactgagaagggtttcttctgagcagaaagcttagcctggggcttactggccagagctgcctgcagcctgggaagcaggtggagtctgcagtgctggcagcgccgccgtgcagcggtgtagccgtgtgtgcgcgtgtgtgtgtgtggtgagaaaccccacttttgctggggactgactcgtgaagaccacaaggtctgggcaacacagccttggcccgtgtggggtggacactgctgtttgctctgtgaattcgtgactgtgtttgcctctcctgaaacttgcttcaggggcgtctgcgggttggtggggcacagccgggtggggtgagtgcccaaggttggccgtccgcgtctcctgtgggcttgtcggggaccggagggccggggtgtgctagctgggtcccgagggtggagggcttcacccccgagcctcagatgagaggagtgggagtgcctggctgcggccggtgggggtgggtgggggaggtgcccgaggctgcttcccagagctgttctcgctggctgctgtctgagcactggggtgggtggggaggagggcgggtgggggcgggcagccttatcctgcggggctgcttgtgtacaagtaccacgcggcctgcctggccctgagccctgggcaaggaggcggaggctgtttttagatgaaggtgactttacttgagaacatgggttacgtctcatgtggccagaatcgaattctaacctttctggggctgtggccgagggtcaggcgccgtccctcctcctgctgctcatgggtggaggctcctggtgcggcgggcgagatggggtggtccgtggggtgggggcgctctgcattgtccccgaggagcctctatggaggctttctcttccggacgcccccccacccccagtgacacgtcaatacacagacaccagcatcatcagcatccggagggacacagggttgttccatccaaagccttttggtccctttgggagcgatgctgcccgctgagaagctggcggacccagcgggagcaccgggaccggtgcagatggcgcctgggagcccgggactcctggaaaggtggctgggggcagctcggctgcgggccccacctggtcctcctcactttcctgtgtgccctgccctgcctggaggtggggtgaggtgagtcaggggccagccctctcctagcacccctgggtgaggaggatgtggagcccagccctgcaggtctggaggatgaggagaggggctgctgcagggcaggaaggagcttgccagctgggcagcctctggctgtgcttcctgccctgactcacctcgcccagctctgcacatagctgccagtgttgcagtctgggaaatcttaactcccaagaaatgtaggttaccaggaggagatccctttgtgaaaatggcactgccagccaggcgcggtggctcacgcctgtaatcccagcactttgggaggcccaagagggtggatcacgaggtcaggggttcaataccagcctggccaaaatggtgaaaccccgtctctactaaaaatacaaaatattagctgagtgtggtggcaggcacctgtaatcccagctacttgggaggctgaggcaggagaattgcttgaacccgggaggcagaggttgcggtgagctgagattacaccactgctgaacagagtgagactctgtctcaaaaaaaaaaaaaagaagaagaggagaaagaaaatggcgctgccaaaacttgtcaactgcgcctgcccagagctcacctgaggtgctcagacgtgaacattcctgtccccgtggccttgggggccgtgacctgtgcactgccacgcagcctcggagccgtgtgcacgcatatgcacgtgtgtatgtgttgtgtgtgtttgcagacgtgtgtccttgtgtgtgtgtgtgtgttgtagcggtgcctggggagtctgacctcagaaggtgctgtggggagggctgcaaggtcctggcgggaggaggcactccccacgcttccccttgggctgggctgttcctggcaggcgagtgctaggcacagtgtgaggttctgtgtggattctgctgtgctccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaagtcagaggacggtgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgcccacggtctttcccatgccatgctgtttccagccgggccccatcactctcccacaagctgaaaggaagtggcttctccaccagccctggctgggagtcctgtgggcgaggccttccccaggagctgccctcccaagtgccccaggcactaacaagaccccacgcgtgctctccccacagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacgagaagcgccggaagcccgaggacgtcctggatggtgagccgtctgccctcctgcccacatgccctgctctcggggtggcccagggccactcctggtccgtccctgccagccccaccgctgacccagagcttggaactgaggagccccaggcagggagttgatgggaccccgaaagaaagtgtgggatggagggtctagccccgggcagctgcggctcagtgggcagcgggaccccgggaggaggaggcggcacctccgccccacagcctcacccggcccttccctcccgctcacttggctgcaagccagtgtcctccgtggtgagccggcccttgctgctctgcatgatcaggctcgggaacctgaggtcagccatgctgtgctccggcagcccctgcctgcctcctcgcggagcccttctgccccttgggctgcgtgtgccggggcgaggcctgtgtggggcctgtgatggcagctcctggaaaacgctgtggggcaggggtgaggcccacgaggccatggggacagctcaccatggggagcacacctgcaggtggggagggctgcctttccccacagcactcagaagatgcacgtggccggggctgatgagctgccccgagccacccctgggggtcactgagggcagggctggcagcacagatgcccctgctcggggcctgagtggggccagtgctgacaggctgtcctctcgtcctctttttcatggcggcggtccttcttcagatgacgacgccggctctgcacccctgtaagttccagctgtgggggtcgggggtcccaaggagcggcctgctgccccaggcctttaaaacacaaaggcagagcccctgggcttcagtattcgggggtcctgggggccggggtgggcaggggtgacttggagagagtgacttgcgggggacaccctctcacccggcccctcgtgccccaggaagagcagcgggcagcaccagaatgacaaaggcaagaacgtccgccagaggaactcttcctgaggcaggtgcggtgggcgggagctcctcctgagccaggtgtggtgggtgggtgggcgggaactcctgagccaggtgtggtgggcgggatctgctagccaggtgtgggctcctgggtcccgcctgtgggtcgctgggaggtgggtccagtctgagcgcccctccctgtccacaggtggcccgaggacgctccctgctccacgtctgcgccgccgccggagtccactcccagtgcttgcaagattccaagttctcacctcttaaagaaaacccaccccgtagattcccatcatacacttccttcttttttaaaaaagttgggttttctccattcaggattctgttccttaggtttttttccttctgaagtgtttcacgagagcccgggagctgctgccctgcggccccgtctgtggctttcagcctctgggtctgagtcatggccgggtgggcggcacagccttctccactggccggagtcagtgccaggtccttgccctttgtggaaagtcacaggtcacacgaggggccccgtgtcctgcctgtctgaagccaatgctgtctggttgcgccatttttgtgcttttatgtttaattttatgagggccacgggtctgtgttcgactcagcctcagggacgactctgacctcttggccacagaggactcacttgcccacaccgagggcgaccccgtcacagcctcaagtcactcccaagccccctccttgtctgtgcatccgggggcagctctggagggggtttgctggggaactggcgccatcgccgggactccagaaccgcagaagcctccccagctcacccctggaggacggccggctctctatagcaccagggctcacgtgggaacccccctcccacccaccgccacaataaagatcgcccccacctccaccctcaccctctcctggctcctgtctgtgcctgacggggttgggttttccgagagcaggtgcaccctgggctctggtggtcacagcaggggtgcgtccagtactgggatttcacatgcgaggacgggtctgctgagaccgcagtgggtgttgggtggctcggggcatgggctggacagggcctgaggctgtcagccggactgggaacttggaaggtggctggggccgaccccgtgcctcagagccacacagaagagagtgggcactgacctgagccttctctgagcctgttactcctctcggcatgttttgggcctgacaaaggctgaggctttctgctgcctgccctgcagctgcctgcacccacccacctgggcgggctgcttgggcaaggttcaggggtggtcctggctgctcctggagagtgggtgtgtgaagctggtgcccagaggctgagggatgcccagcccctgcccgcccagcacacggaacagatgtggttgcagggctggagagcttgggggaccaggagcttagagcgtggaggttgcaagttgcaggaccagtaactgggtctggagggaggtttgcagcggctgtgtcagccctgcaggccgagtgtggcactgggccttctgctggtctgagcgggggtctcagggtggaggtcagcaaaagaggcttagtgggggcttagggagcctgggtgggttcccagagaagctaggaatcagatgggaagatgggaaggcagtgtgtttccgtgttgggcaaatccagcgttttcatgccacggaagccaagaaagggctcacggcctccggcctcacagggctacgcaaagggggagttgaataaacacggtgacgggccccgggcggcagctgctcccggcactgatcctgctgggccagcggtggacttgcagggcccacatccggagctgcccactggtcctcgtgctgcacagccttggaggatctgaggctggctcagggtccctggcagcaactgccctgctaggtgggggctgctgggttccacagctgggccctccctgccggctgccaccaggcggcgctgcacgcccacgctgagtggggcaggccctggagcccctctgcccgggcagcctgacggcccctcctcctcggctgagaccgcagagtcccaggcatcacccactgaaagtgtgctcagtgacctgtgaatagggatgccacgtctgcgtgcagacattgattaggcgcctgtggtatacctggagctggagggtgtgcgtggacaacaggcagaaaggtccagtgggatggaggctgccaacaggacgatggggaaggggcgcgttggggacatcgccgggcacgcggcccaggtgggcccctggctcaggtctccccccacctccctgcctgggctctgtccatctttctgccgcaccctcagccccaggtgtgggcccaccgtgcttgtggacgcctcatgctctgtaccgggtgggaggtgtgggagttacaggtcagggcagccttgggagacgggcaggtttcctggggtgcttaccggcagatggggcgcctgggtccgtgcagggtcgtccgcccgagaaagcagcccctcacccctgggcactaacttcatcttttttctttgcacacagaaacgtaaacctgattcacaaaagtataaccactcagcatgtagctttgtacacctgccctcagcatttagtgtcctcgttcatccaacaagcatctaataagcactggggtacgcagtggtgggtgtccgccccgtcactgggtgtccagcgtggggtgcggaggtggatgtccaccccgtcggtgggtgcccggcgcggaggggtgcggaggtggatgtccgccccgtcggtgggtgcccggcgcggaggggtgcggaggtggatgtccgccccgtcggtgggtgcccggcgcggaggggtgcggaggtggatgtccgccccgtcggtgggtgcccagcccgatgtccaccccgtccctgggtgctcttggtggcaactcgctgaagcctgcctcggtttccccagaggtgagatggggaagtcaccaccgccaggtcatgagatgagattagatcatccttgccaagtatcaggaaaaggcctcagggctcccctgggaaccttggggtctcaggagtcccagctcccagtgggcaggggtagggttggggcggccagaggaacaagtgtttgttcatgggctggaccccaccgcggccccaaagctgggctgcctattcctgtcctgggcaaattggcctctcctccctcttaccccccaccccagtgggagcccacaaggacagggcctgccccatcccctccactctgggctgtggctctaagcagcacgtcccactctaggggctcagggcagggacagtgactcatccaaggtcccgccgtggagggcagagctgaaggagtgagaaggagctgctgacatggaactggcccgtgcggaaagactttggtcttccccatatttttcaccaggctcctggggcaaggtgagcccagcagggagaaggaaacttgtgtgaatcccaggccagcaggactgggggccctgctctcatcgcagacgctgcagacacggaggcctggggcaggggccctcagggctgtgctcctgcagagatggagcttgcgtgtgtggctgagactgggatgccaccccctttcctaagcctctgtttcctccgctgtaaatgtgggcccaggcctgccatgcacagctcatctctttaattttcttttttttttttgagacaagggtctcattctgtcacccaggctgtttgtgcagtggtgttgatctcggctcgctgcagcctcgacctcctgggctcaagtgatcctcccacctcagcctcccaagaacctgggaccacagatgacacgcacccctccccctggctcgtttagtatttattgagtcaaactgcagattttccaggcgggctcagtgcctgccctggcctgattttgtcttcctggtcttaaactgcttttcactccaaaggccccaaaattgtataagctttcagggcgtgcgacctggacctgtcctgactaagtgggaaatgtaggtccgaggttggtaaatccggtaaacaatgccgagagaggctgcagggggcggggagatggggaagaccctggggagggaatggcagggcctggggaggttcagcgaggaggggtctgggagttcggggtccagtgacccaggcacacaaaggccagactcgggcggaggagtacaagctgctggagggacccgggctttcttccaaaggcactgggagctgtgagtggttttaggccacagaccgatgtgactgactgaggggccaggccctggggctccatgctccctacacaagccaggtgcggtcccacctcaggaccctcgcacaggctatgccgcctgcccagagcttcctgcagcttcccgggccgcaccccctccttcaggccttctcccagcacctggccccctccccaccctgagtgtttggacaatgctcaccaccttctgctggacagtatcttacttgctactcataaggttgactgtgatacccagctttctcccctggctggctctctgagtcagctgtactggcctctgagtcaatactcggcctggagtaggtgcttaataagtttttgttgattttttttttttttttttttgagacagagtctcgctgtgtcacccaggctggagagcagtggtgccatcctgactcgctgcacctcccaggttcaagcgattctcctgcctcatcctcctgagtagctgagattacaggcatgtgccaccacatccggctaatttttatattttttattagaaacagggttttgctatgttggccacgatggtctcgaactcctgacctcaactgatccgcctgcctcggcctcccaaagtgctgggattacaggcgtgagccaccgcgcccggcttttttttttttttttttctgagacggagtcttgctctatcaccaagcgctggagtgcaatggtgtgatctcagctcactgcaccatctggctcctgagttcaagcgactctcctgcctcagcctcccaagtagctgggattacaggcgcccaccaccacgcctggctaatttttgtatttttagtagagatggggtttcaccatgttggccaggctggtctcaatctttaaatattttttaaattaaaataaatgagcatggctgggggggtggctcacacttgtaattccagcactttgggaggccgaggcgggtgggtcacctgaggtcagcagttggagaccagcctggcccaacatggcgaaaccctgtctctactaaaaatacaataattagccgagcgtggtggcaggcgcctgtaatcccagctactccggaggctgaggcaggagaatcgcttaaacccgggagtcggaggttgcagtgagccgaggtcacgtcactgcactccagcctgggcggcgacagagcgagactccaactcaaaaataaataaatacataaataaacagataaatacagagtactccggcctgggcaaggggtcagagtgagtgtgccgaggccagggagggtccccgtgcacactgacaggcgctggcctgggtaagcctgtgggctgcagagccgtcgccaggatctggtgacaaggaccccgagccacagcctcccttgtgacttgcgggttctgccggcgcctgcaggaggcgtctttctgcttctcccactgccaggcatgggcggttctcgtgccgtgcgggtcccgcctcctccctgctcccagccgcgagccctggggctctggcgacctgcccggcctgacatcttcccagggtgaacataaaagaacccccttcagctggagcacgcatctgcctcggggcgggccacagcctggcactgccaactgtgccgcccgcccggcctctcccgcaccaccttgggacaaacagctgtcctgcccgcctatgcggaggtggccggcggggccggcgtgggggcgcagggatccccagggtgtggggcagccaggccgaggcgagagacacggtcgggctcagcccatccactgtcagccgggcacatgctggccctccctcaagtaccactgagtgcctcctgggtgtaggaagagggccatctctgccccggtggcctcgaggtgcagatgggtggggggcacccggcacacgggacatcgtggctgagaggacgtcaggccaggtgccaggagggtcccaggagggcctcctgcctccaggtggggatgttcagcctccacttcttcgagtgtgactgtctgtctcctctctctcacttgccagcttcctcacctgccccctcccggctgtctggtgggctgggtggctagggacagaggcctcatgtcacctggcaccaagcagcacccacgcccagccggcttcggcccagaagcagagccttgggaagcacctgtctcagagctggggactggaggcactgggggcacagctgcacccggagtccgaggggtcggggaaaggaggcaaccccggggcagggggctctggtacccgtgcgaaggcgctagtgggctttgggtctccctgtgaccccaatctaaagcccaccagacctagaggagacccccgccgcacggctccccagggcactgtttgaggggtgggtgggaaccccacaccctcgggtggcttttccagttttccttgtctggctgggcttggcctcagtttcctcaaatgcagaccagggagaggagtgcctgagtctcccagaacggcgcccaagccggcctgcccctccccacgcactcaagggtctctgtccagggcccacaggcgacccagcaagggctcctgtgacctttagaaacaccctttcgtcgtggaagtcttcaaacctcacagaaagcaaggaggcgctggccgtggcggcctctcccgtctcccaggcccgcgtccaccctccccgcgccggtgccctccggacagaggtggaagccgcggcgcaggagaggcggctccggccgggcagcggggcccggtgaccttgggcgcgtccttacacgtcgcgggcctcagtttcccctcctggggagaggcccgcgcggggctccgaggcctcgggccgcgtgaccttggggcgcccccgaccccgcggcccgagtttcccggcgccgagcggaggcggcgcgcggggagggggcgcagccgaggcgggtctcccgcccccgcccctcccccgcccctcccccgccgcgaggctccgccccccgcggctccgccccgccccgcccccgcctcccccctccctcgggctccggccggcggcggcggcggcggctccgctccgcactgcccggcgccgcctcgccatggacgcgcgcgggggcggcgggcggcccggggagagcccgggcgcgacccccgcgccggggccgccgccgccgccgccgcccgcgcccccccaacagcagccgccgccgccgccgccgcccgcgccccccccgggccccgggcccgcgcccccccagcacccgccccgggccgaggcgttgcccccggaggcggcggatgagggcggcccgcggggccggctccgcagccgcgacagctcgtgcggccgccccggcaccccgggcgcggcgagcacggccaagggcagcccgaacggcgagtgcgggcgcggcgagccgcagtgcagccccgcggggcccgagggcccggcgcgggggcccaaggtgtcgttctcgtgccgcggggcggcctcggggcccgcgccggggccggggccggcggaggaggcgggcagcgaggaggcgggcccggcgggggagccgcgcggcagccaggccagcttcatgcagcgccagttcggcgcgctcctgcagccgggcgtcaacaagttctcgctgcggatgttcggcagccagaaggccgtggagcgcgagcaggagcgcgtcaagtcggcgggggcctggatcatccacccgtacagcgacttcaggtaccgcctccgggagggccggtcggcgcgagggggcccggggagccgggcgcgcggggagccgtccttggagcgcctggggagggcggggcggcgcgccgggccggtgacctcggggctcctcggtgacctcgggcgtgtccgggacccgccccggagtgaccccggcgcgcgaggctccgcctctgggggggctccccgggtgaccgcggagcgcccccctcccacgcaccccgacatcctccgccctgcggcgcggcgggtggggtgggccgcagggccagggtctgagcgcagaggggcagagaggacgaatagaggggaacgtgggccccagagaggcggcggagcgggagggaggaggaacgaagggcgcccgggaaggacgcgccccagggaggccgggggagagggggttaagcggctcccacggcgtccacccgcgccccgcctgcgaggaggcgcgcccggggccgcgggcctggaaagcgtgcgggtccccaggctgtgtccccgggagccgctccacccgagccgcgggcggtgcgcgcatgcggcggtgggtgtgtagacgccgctgtggatccagccggctaatgcgtggaaggctcggagcagggccggcgcggggccaccgccactgatgtttgcggtcgtggttcctgggctgtgcgtgctgtggccggagagcgagaccggcgcgtgtccccgtgggctgtgtgtgaacaggggcccgtgaccgcggcggggttcccggggcgcgagcctgtggccggagaggtgtgtctccaggagtgtgtttgcgtggtggtcgcgggcgtgtgcgcctccggtgggtttattttggtgggacgtgtggtttgtgtgtgttgggaccaggtggcgggcgtgcgcgtgtacgcccggggccggtgtgcaccggtgggcagtagtgtgagccgcaggcaggtctcacacacgcgaccatggagggatgcgtgtgtgtttgtgtatccacgagtggggtgtgaggtggggtgtggagggtgcaggtggagggtgtaggtggggcccgccgggctagcgaggccgggcgcgcgggacgggcgcggtttcagcaccacggacagcgcgccggacctgggaagcctgcggttttcccgcctgtctctcctcctccaggcctgggcgccccaggacagcccccacggaccctggacccccggaactgggcagggaggctgtggggttctctcttcccctggattctctgcacccctagtgcttgactggagaaactgaggcctggggcacatgcgtcctggacagagcctggaggaaggccctggaatcctcctcccaccccaggccttcctgagaggtgaatacagctttgaccagaagcctggatttcgagacaggccaggggtgggaggagccccgaaatccccagaggggctgtgtccggcccctcccaccctgcctctgtgccccaccgggagagcttggtcagcatctgggctctggcctgcgaaatgtggacagtgagcgggaaggactggacttccagggctgctggtcggcctggccccacttccagtcgggcagtggcaccccctgaccggagagggacgcggtggagagggagctgtagaacgtgcccactcccctccgtcccctccagcatgaccttcgacagagatgggtgcaccgcagcgtgggggctggcaggtggaggcccacaccagccactccctcccctgggcagctccagcgaccccctggctgcagaggggcggtcggtggcctggggggcaggtgggcagatggctgatcccggggcttggggggaaggccggtggtaggagtgaagccctctcatccttccaccctccttgggcgtggtcgcctggaggcctgggcaggctgtggccccgctctgtgctctgaggcatagagggctcagaggcccctgtgtggaccaagtgcagccccaccccggcagatgagtgttgaagtggaactgagcaggcagggaatggggttagcggggcctgtcttcgggactaggggagtcacggcagtcagattttaaaaaaggatttcgatgttgccaagctgggtgcacggggcccctaggaccctccccaggcttgggacctgtgccagtgtggaatcagtgtggaaaaagacccccaagaatatctcaaaagctccctaagcaggcggccggaccctgctgtggagggtgttttggggcagcccacagcaagcgaaggggcctctacgtttgcagctgactcaggagcctggccccaactggcttcgggcccaaggcctcctgtgcctggctgggtgtcttgggtcctcgctgggcccctctgcctcagtttccccaattgcacggtggggatggtatgagggagaaggatggggtctttcacagccttgccagtgtctcagcctcacgtctcacactctcttcacctccccttcctgctgagagagtgctgtgctccttgcccagcctgtgccccccaggcacgccctcaccccggttcttcctcgctgcccagctgtctccgccacgcccaagtccaccctgctcccgtgctcggaagtggcctctttcacgccccacgtcccagtcccagtatacagcaggtgccacatatttgctgaattttctgaggggcagagcatgggtcctgggctgacgtgggtccagatttcggctctcaggcctgggcggctggcccctttggaagtgcagttggtgccagggtgcagcggctcacgcctgagatcccagcactttgggaggctgaggcgggcggatcacctgaggtcaggagttcgagagcagcctggccaacatggtgagatgatcccgtctctactaaaaatgcaaaaattagctgggcatcgtgacgagcgcctgtaatcccagctactcgggaggctgaggcaggagaatcacttgaatccaggaggcagaggttgcagtgagccgagatcgcgctgctgcactccagcctggctgacagagtgggacttggtctcaaaaaaaaagaaaaggaagaagaagtgcagttggtctattgctgaagtctctggggctgtgggtggctctacaccccggcctgacgtctgaaagtccccagaggcatgctgggcgcttccctggggtgctggtggaagagcaagttcaaggacccaagttcaaggttttgggttccagaggctcaagttcccttccttgtaggtgatcacggttggtgcctgaattggaacaggcgtgaaaaccaagaaggaaggggtttggccttatgcaacccccagggcttcggcagggtcttctgtgcctcccagagcaaaattaggtcaaaaataagtatagttcattcctactcccttcaccccagccgccgctgattctaaaggccacacaggtccacttgggaaagcctgagtcgtgcaaaggagggtgtctccgcaggagaggggcaggggctggaggtctctgcacgagaagggctggggctggagggtgtctccgcaggagaggggctggggctggaggggacacgaaggcccagggaggggcggtctgaggaggtcgcgttctccgaagcttgctgtcatccaccctccctgcccccggtgtcaccgagggggctgggcagacctggcggggtggagacctgggcagatccggggtttgtgccctgggagctctggggggcacagggcaggtgtcgggtggagagaggctggcggcttcctgactgccctcggtccagttccagggctaagtgccctgtggccgccctgccgtctcctgctgctgctgacttgcaggtctgtgtttctgaattgtcttcagctggggaggccccgtgtgaggggagacagacgagatgctccccaaagccaggatctgttatgtcccctggggtccccgagaggactggtcggggaggagctgctccaagaccccaccaggacaggcggcccctgggccccgcctcagatggctgagtgggtcagcgggagatcagcctgggggtgcagctctgcaaatccgcagtgatgaatcccagcattagggcgtgggaataaaccccccattatcctggggggatggccccgggggcagggcgaggcgagggtttgtctggctctggtcacggcaggaaggcccagcgtgtgcaggatggtggggtgtgcatggacccatatcccaggtggcggtggcctgccctctggtctgcgtggaggggtcaggggtcggggtggccaaggcctccccgctctcttcagggccttccctatgttccctgctcgaaaacggacatctttgtccaggcactgtggctcatgcctgtaatgccagtactttgggaggcggaggcgggaggatcgcttgagcccaggagttcgagaccagcctgggcaacatagcaagacccccatctctacaaaaagttaaaaaattagccaggcgtggtggcgtgcacctgtagtcccagctactctggaggctgaggcgggaggatcacctgagcccaggaggttgaggctgcagtgagctatgatcgtgccactgcactccggcccgggaaacagagtgagaccctgtctcaaaaaaataaaaaaaacctaaaaacccacatattcaagtcaccttcatcagccccccactcacttgggccgggccctgcctcaccccccaccccacggttcagcctcgcaccctgtgcgctggccgcctctctcctgccagatgcctccccgtccccctttctggcctcccggctgtcagcatgggcctctccagacatcggtccttctttccctgtcacctctacctcctccctggctccagccctccccagtcatgtcccctggtcccgaggccgcccaccggccttgaagggaacccggagcatcaacctccgcacctgctgcccctcttcagccactgccctcccctcaccatctcatccacccacacgccacctcctccaaggagccctcccacctgcctggggctgacaggcccatcccatgtgtctgtcttggggctgggcctgtgtggtcatcgtgtgccccggcgcccggcgagagttcggtgaacatctgccccgtcgggatcacccgggaacccgagatctcccccacccgtagcagctccctttcttaatcctgggcacctgccacggatctggccatgactccacagctgagagtgccgtctcctaatcccccggcccgaggctctcccttaatcaccgacctccggcccctaatcctctcccggattgtccccatctgtaaatcctggacggcctccggcctgaggctgggctcctgcggggagggcctggctgccctcgcccgttccccaacccgggactcaggctccagcaggggctgaagaccccctgggcaggccctcccctgggatccaaggggctgagggtcctgggccttctgttgccaggagacctggtgtcctcgtggggtttgggagccgggtcggcggcctcctcccccaagcttcatccagccctggagagacggggacctgcgtcggctttgggaacttcaggggaagaaccctgagctcggggcaggagaatgacatggtctgtctgggttcccatcccactgtttcacttatggctggaggagcctcagtttccgtgtcagagccgagagagaggctgggcggctgttggaggagggctgagctcacatcggtgtcaggtgccgggggccccactgaagccactctggagtgagagggggtccgaggcttcttccggtcccccaggtgtgagagctgaggccggaaggtttccccagggacccagcctcatcccggcctccggagctggtctccctccctgcctgcgagggccaagctggacaaagtggcaggacccccgcgtttccgaggaaggggccctcgtagaggcctcactgttacctgtcggggatgggttttaaatacaggatttaatgatggtcactgatgtttctgtgacagctgaggggggcctgtccctgctcagcactggggttggacaaggagggcacagggtgcccggggagtgctggggcccgcctgggtccctatggtggccggatggggaaagggctgccggacgcggctgcacagagtgtgagggggagtggggttgggctttgggccttcccctgaccccaggtcccctctctggggtcctgtcttctggagctgcctccccctccccagggcgagaggcaggagagggtctcccaaggtcactcagtctagtgttgggcaaggagagggttggggtggagagggttggggtgcaccggcagagacagtgacgccctgcagggctctggggtcccctctgccccaggcctcggtttccccttggtaggggacatgcgtgggcgcccttcttccttctgacctctggctggtgacgacgagggttgcggccccaagccctgcttggaggcattgtggttggaacgggcaggcccagccccacaagggaccctcagggtggccaccccacctgtcccttctcctaggcccctctgctctgacccccgtaatccccaggaatactgccctgctgggcaagatgggctgaggagtcctttctggggacacaggagcagaaggctcaagggaggtggtttccagacagtgtgggccgtggataagaggacagtcctggggtctcatcctgcagtcccacttccatcagaggggaggtgtggtacctgcccccagctcaccccaagaataaagggggagaatgtctgttaatcatcacctggaaaggaggccttcatgttatatggccgtttaaaaccaggtaccccttggcggtttctaggtcctcctggtggtttctaggtctccttggcggtttctaggtcccccttgacagtttctaggtctccttggtggtttctaggtcttcctggtggtttgtagatctccttggcggtttctaggtcctcctggtggtttctaggtcccccttggtggtttctaggtcctcctcgtggtttctaggtctccttggcggtttctaggtcccccttgacagtttctaggtctccttggtggtttctaggtcttcctggtggtttctaggtcctcctggtggtttctaggtcctcctggtggtttctaggtcccccttggtggtttctaggccctcctggtggtttctaggtctccttggcagtttctaggtcctcctggtggtttctaggtctccttggcggtttctaggtctccttggcagtttctaggtcccccttggtggtctctggagccccctgggagtttctcctcgcccctcgtgggggaggtttctaggccctgtggccttctcaactgctctttcctgctggttttgtcccaagactggtgctcgaaggtgggaggcaggtctcaatccagagggtgaggctggggctgagctccacggtgagccccctcggggctgaggggcagggggccagcggcaggcgggtggcatcccctcagcccactcggtgctggggccctgggggtctcgttgctgagcagatgtgtcggactgggggcctgagccctcatgtcctgtctagactcagggaaaggaaggccttaaatttctagtccttttagtcatttgatttcacccttcaagcttgtgaggggacccctccccaccccgagatcaagtcagccttttttttttttgagacagagtctcactctgtcacccaggctggagtgcaatggtgcagttttggctcactgcagcctcgacttcatgggctcgagcaatcctcctacctcagcctcccaagtagctgggtccacaggtgcgcaccaccacgctggctaatttttgtattttttgtagagacgggatctcactatcttgcccaggctggtcctgaactcctgagcttctgtgatcctttagtcttggcctcccaaggtgctggcattagaagcatgagcccctgcacccacccttcccttcttttttgagacggagtctcgctctgtcgcccaggctggagtgcgatggcgcgatctcggctcactgcaagctccgcctcccgggttcatgccgttctcctgcctcagcctcccgagtagctgggcctacaggcgcccgccacctcacacaaaaaaataatacatttttgtatttttagtagagacggggtttcaccgtgttggccaggatggtctcgatctcttgaccttgtaatctgcccgcctcagcctccttaagccctggaattacaggcgtgagccaccgtgcccagcctgagtcagcccttctctaggttttatccccagcctgggtggttcttggggggtgtcccgaaggctcagcccctccccatcccgaggcggtggatgcttggaagaagagactgaggttctcaggggctgcaggaacttgtccaaggtcactgtgccagcaggcgggtgccagcccaggtctggctgatgccaccacgatgtgagtcgctgggtcccttccagcgtttggctcttgcagaccgagctgctgtgaacattttggtacaaatggctttttaatttttttctcttccttttggaccgtttcctcgggatcatttccccgaagtggagcgtctgggtcaccccgcagacgtggtgttaacagcttttccctcgaggagccgtccagaagcaaggagccgactttcggcggctcctgaaacaaaggtcccggcggccacgccagcgatgagctcccaggtttttctttattggtgttaactttggggagtccctccagtccctcagcatctcctccgaaaggatgtggggaccccggccatgatagggaggggctgggcctggggtggggataaggcctcaagaattggccgggcgcggtggctcacgcctgtaatcccagcactttaggaggccaaggcgggcggatcacgaggtcaggagttcgagaccatcctggctaacatggtgaaaccccgtctctactaaaaatacaaaaaaaaaaaaaaattatctgggcgtggtggcgggcgcctatagtcccagctactcgggagggtgaggcaagagaatggtgtgaaccctggaggcggagcttgcagtgagccgagattgtgccatcgcactccagcctgggcgacagagtgagactctgtctcaaaaaagaaaacctcaagaactaagaaggctgagttggtacagggatgggaaggggtcccgtgtgtgtgtgtgtgtgtgtgtgtgtgtgtgtgtgtgtgtgtgtgtgtgtcagagggtctcatgttacccaggctggtcttgaactcctgggctcaagcgatcctcctacctcagcctcccaaaatgttggaattataggcatgagccagtgtgtttggcctagcccccagtgttaatggcaaaatcctatgaatctttgtgctggaaattcaagaccctcccttgtctgagtcaggcacacgcaggccatgtgggctcagaccccagtctggaacctccccttcagcaagagcccttggccccagagcccagaggtttttgttttgttgtgttttgttctttgagacagagtctcgctctgttgccccggctggaatgcagtggcacgatctcggctcactgcaacctccacctcccgggttcaaacaattcacctgcttcagcgtcccgagtagctggtactacaggcgcccgccaccacgcccggctaatttttgtattattattttttgagatggggtctcactctgttgccaggctggagtgccatggcgtgatctcagctcactgcaacctccgcctcactggttcaagcgattctcctgcctcagcctcccgagtagctgggactacaggcacgtgccatcatgcccagccaatttttttttttgtattttttgtagagctggggtttcactctgttggccaggctggtcctgatctcttgacctcatgatgcgaccacctttgcctcccagagtgctgggattacagacgtgagccaccacacccggcctaatttctgtatttttagtagagacggggtttcaccatattggccaggctggtctcaaacccctgacctcaagtgatccgcctgccttggcctcccaaagtgctgggaacacaggcgtgagccaccgcacccagcaggcttttttcttttatcagttttccaattagccattgtaaaacctatcaatcagtgtcattaagcccattcttgctgttgtacaaccgtcaccactatccatagtccatacctttctcattcccccggacagaaaccgcaccccgcacatgccacttctcacccctccaacccccggcccccggcacccatgcatccccttcctgtctctggattggcctgtcctggacatttcgtagaaatgggctcacacggccgggcgcagtggctcaggccggtaatccccacactttgcgaggcctaggcagaaggatcatgaggtcagggtttcgagaccagcctgaccaacatggtgaaaccctgtctctactaaaaatacaaaaatgagccaggagtggtggctcatgcctgtaatcccagctactcaggaggctgaggcaggagaatcgcttgaacttgggaggcggaggtggcagtgagccgagatggtgccactgcactccagcctgggcgacagggtgagactccgtctcggaaaaaaaaagaaatggcttctctcactgaacgtgacgtcctcaaggggcatctgcgccgtggcctgggtcagagcctcactccttttcgtggctgagtcgtgttccatggtggacgggtcgcgccgtgtttgtccctccgtttggtgatgggcacctgggctgcctctgcctttttgctactgtggatcgagctggtgtgaacacagcggagtggtcgtcgtccgcagtcgagctggtgtgaacacggtggggtggttgtcgtccgcaatcaagctggtgtgaacacggcggggtgctcgtccgtccttgttttcatttctttgggtataatctcggggcagggagaggctggtaattttatgtctttttaaggagccacccgtgtttgctccgagtcgttttgattttcattttctcgatagcgaaagggttgggcatctgtccagtagccatttgctgaccctctatgacctcctgtgtggacgcggcactcccagcaccgtgtctggcccgccatacgcaggccctgaaccgacaggaccttttctgccagagcttcccagggagagttttgggatccaccttggggacttggactctggccgggtgtatctgggagtggaaacgccctctggtctcttgtccacgggtatttatcatacggaacgtccgaatggtgccaagtccggctcggccgttcctcccaccctctcggcctcccctgtggcgccagccccgtctctgcttggcttccctccctcctgtgtggacgccccacttcctcccctctcctcctgcgtggacgccccactccctcctctctcctcctgcgtggacgccccacttcctcctctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccactccctcctctctcctcctgcgtggacgccccacttcctcctctcctgcgtggacgccccactccctcctctctcctcctgcgtggacgccccacttcctcctctctcctcctgcgtggacgccccacttcctctggaaatgcagccggtgctgccctggttcagtcttcctgtggcccctgtggaggctcccgcttctcagtaaggcatctggggccctcacctcccggcgtgagctgagcacggttcatttcccaccctggcttcccgccttcgctctccctgtgcgcgccgccctgcctcgccctgctgcttcccagtgcccctctgcaccccggctcctctctgctcctctgctgtcctgtcctgtctatttttttaacgccaaccttgtgccaggcacattgtccctctctggtcatgtgaagcacttaatctattttgagccacctcttgggccttgtgaggtctcctgcatcttcaaggacacggggtcaaagttgggcctgaggaagggacctgggctagggcagcgcagtgggcgttgggctccctcggggctgggtggccttcctggggtgggagcctggtcccgagggaggagtgcccagggcttgtcctgcaggcgcctggggggaaggcaccggcctgagctgtgggcaccctcgtcccccagggaggaatgcccggggctggtcctgcaggcgcctggggggaaggcaccggcctgaggtgtgggcaccctcgccccccagggaggaatgcccggggctggtcccataggtgcctgggggaaggcaccagcttgaggtgtgggtgcccctcgtcccacagggaagagggcccggggctggtcccataggtgcctgggggaatgcaccagcctgagctgtgggcaccctcgccccccagggaggaatgcccggggctggtcccataggtgcctggggggaaggcaccagcctgaggtgtgggcaccctcgccccccagggaggaatgcccggggctggtcccataggtgcctgggggaaggcaccagcctgaggtgtgggtgcccctcgtcccacagggaagagggcccggggctggtcccgcaggctcctcggaggaggcactggctcgaggtgtgggcgcccctcgtcccccaaggaagagtgcccggggctggtcccgcaggtgccccggggaggcaccggcctgaggtgtgggcaccctcgcccccaggttctactgggacttcaccatgctgctgttcatggtgggaaacctcatcatcatcccagtgggcatcaccttcttcaaggatgagaccactgccccgtggatcgtgttcaacgtggtctcggacaccttcttcctcatggacctggtgttgaacttccgcaccggcattgtgatcgaggacaacacggagatcatcctggaccccgagaagatcaagaagaagtatctgcgcacgtggttcgtggtggacttcgtgtcctccatccccgtggactacatcttccttatcgtggagaagggcattgactccgaggtctacaagacggcacgcgccctgcgcatcgtgcgcttcaccaagatcctcagcctcctgcggctgctgcgcctctcacgcctgatccgctacatccatcagtgggaggaggtgaggtggggcgggggcggggccaaggcagcaggggcggggctataatggtgcatgggcggggccaaggcagcaggggcggggctataatggtgcatgggtggggccaaggcagcaggggtggggctatgagagatctgggtggggtcaaggccccaggggtggggctatgggagatctgggtggggtcaaggccccagggatggggctatgagagatctgagtggggtcaaggccccagggatggggctatgagagatctgggtggggtcaaggccccaggggtggggctatgggagatctgggtggggtcaaggccccagggatggggctatgagagatctgggtggggtcaaggccccaggggtggggctatgagggtgcaggggtggagctacaatggtgcagtggtagagccaagacagcaggggtggggctatcaggttgctgagcagggtcgaggcagcaggggcagggctatgatgctgctggggtggagtcaagcagcaggggtggggccgtgatatctgggtggggtcaaggagcaggggcagggctgtgagggtgctgggcggggtcaaggcatcaggggcggggctatgagggttgtgctgagcggggtcagacatccgagtggagatatgagggttgtgctgggcggggtcaggcagcaagggcgggactatgagggttgtgctgggcggggtcaggcagcaggggcggggcaatgcgggttttgctggggcagggccagacatcaggggtggggatatgagggttgtgctggggcggtgtcagacatcaggggtggggagctgtggatttggggggtgtcctagggcgggggctgtggatttgggggggtcctgcagtgaaggctgtagaggtgggcggggtcctggggtgggggctgtgggtttggagggcgggggtcccggggcagggctgcagggtggggcgggggtcctgtgcggggccttggatttgggggagggggccaggagctcccgcagtgggggcgcacggggctggggctctgaaggtgggggccgggggtcagcgggtagggtgggctcacggcgccttcctgcagatcttccacatgacctatgacctggccagcgcggtgatgaggatctgcaatctcatcagcatgatgctgctgctctgccactgggacggctgcctgcagttcctggtgcctatgctgcaggacttcccgcgcaactgctgggtgtccatcaatggcatggtggtgagcgccgcgggccctgacggagggggagacgcaggctcccatacagaggggggacccaggcccccttatcccgcttacagagggttgaacccaagcctttcagaggtggggacccaggcgcccccttatggaggggaggactcgggcccttacagaggtggggacccaggcgcccccttatggaggggaggactcgggccctttcagaggcggggacccaggcgcccccttatggaggggaggactcgggcccttacagaggtggggacccaggcgcccccttatggaggggaggactcgggccctttcagaggtggggacccaggcgcccccttatggaggggaggactcgggccctttcagaggtggggacccaggcgcccccttatggaggggaggactcgggcccttacagaggtggggacccaggcgcccccttatggaggggaggactcgggcccttacagaggtggggacccaggcgcccccttatggaggggaggactcgggcccttacagaggtggggacccaggcgcccccttatggagggaaggactcgggcccttacagaggcggggacccaggccgccttacagagggagagacacaggcccttcaggggtggggacaagacccccttacacgggaggactcaggcctctttacagagggggacccaggactgcagccccggcactggccccttaatgtccctgggggtctgaaacagccacttggaacctttcaggcctgggatcatccgtggagagaagctgagtgtggttatgatgagtcctgtcacccagacatctgcttagcgcgttttccaatggatttcccttttaattaacccacattaattattattattttatttacttatttttttttgagactgagtttcactctgtcgcccaggctggagtgcagtggcacgatctcggcttaccacaaaccccacctcccagggttcaagggattctctcgcctcagcctcccgagtagctgggactacaggcgcccgccaccacacctggataattttcgtacttttagtagagacggggtctcgccatgttggtcaggctggtctcgaactcctgacctcaggtgatccgcctgcctcggcctcccaaagtgttgggattacaggcgtgagccaccgcgcccggcctggttggatcccttgagcccagaagttgaggctgcagtgagccatgattgcaccactgcactccagcctgggtcacagagcaagacctgatctctaacaactaaagaaaaatttacaacatggccctgaattgggaaagtggtatcaccatgccaaagaaataataaatgggccaggcatggctgctcatgcctgtaatcccagcactttgggaggctgaggcaggcggatcacctgaggtcaggagtttgagaccagcctgaccaacatgctgaaaccccgtctctactaaaaataaaaaattagccaggcgtggtggcgcgcacctgtaattccagctactgtagaggctgaggcaggagaatcgcttgaacccgggagcagaggttgcagcgagctgagatcacaccattgcactccagcctgggcaacagagccagactttgtctcaaaaaaaataaataaaaataagtaaaagcaaaaggaagaggccgggcgcggtggctcacgcctgtaatcccagcactttgggaggccgaggtggggctgatcacctgaggtcaggagtttgagaccagcctgaccaacatggagaaaccccgtctctactaaaaatacaaaactagcttggcgtggtggcgcatgcctgtaatcccagctacttgagaggccaaggcaggagaatcgcttgaacccgggagcggaggctgccgtgagccaagatcgtgccactgcactccagcctgggcgacaagagcgaaactccgtcaaaaaagaaggaataataaatgaagttaggtcccagatactccttgcttcctagctgagatgtgctgactgttaagaagggttagttatgggagccctcggccgctacagtcaggttagtggccagtgagcctttgtccctgcctggggagtgctgtgccccagcgtccagccacatatgggacttgggatgtgtttggtttggacacagagcaggtgggcattgatggggtcaggagctacagagggaagacccgccagtgcccctccccagagcctggcacagctgcccaggctgaggcagcccattgtctggctgccacccgcacatgcggtcccatttcctgaacagagccccgcggctcccctttcccggccgggtcagctgaggacttggtgcggcaggacctcctgggccggcctggtgtctctgcccgccctgcccctctgctctggcccagatgctccctggaacttttgccccctcttgacctcacagatgctctgatctcagaggctgcaaaaggcgggacccagactctcgcccttggggtctcagtttccccaggagtgaagcgggcaggtagaatcagccctggccctcctgccaactcactgtgacaagtgtgcaaaccatgtcatctacctgggtctccatttctcttggttacctctgaacatggggagctcaccacctccagtgcttggcagagggtgggcgctgggcccttgaggaccgagggctcctggggcgtgagcacctgcccaccaccgcccctcctgctggccttgcagaaccactcgtggagtgaactgtactccttcgcactcttcaaggccatgagccacatgctgtgcatcgggtacggccggcaggcgcccgagagcatgacggacatctggctgaccatgctcagcatgattgtgggtgccacctgctacgccatgttcatcggccacgccactgccctcatccagtcgctggactcctcgcggcgccagtaccaggagaaggtctgagggaggcgggccccggcctgggttctgatgggggaggcgggcctggatctggggtctgagagagagtcaggccaggccctggggtctgatggagggaggcaggcccggtcctggggtctgaggctggagggaggccttgccctggggtctgagggcggaggtagtccttgtcccggggtctgaggggaggggcgggcccggccccggggtctgaggggagaggcagtctcagcccttcactcagcttcaagtggcgcgctcagggcagagaccgcgtgatggggagcaggggaccctgggggtctgtggctgtgattaggaggagaaacggccggtggtgagaggttctctgaccctgtgacagggagggaggtccagagcctggagatggacgtggggcgggggctggggaggggatgcaggctgggcaggaaggggtgagttgggatcagggcaggacagggtcagtctttggacatcgggaagcccccgggctgaaggggcattgccaggaggctgggcccacctgggggtctctaggccggctcaggatggggctgggttagggaagggcctggcggggtctgagaggcctggggttgcttcaggacacgccggtggccggcagtcagggccaggcttcagggagagcaaggctgccccactgctcagatgcggcctctggcctgcagcgtccattgggttaatcctaggcttggcagtggaggggacacgggggagctgggaggggtggagggagattaggattggccccattggcagcccctggagttgggcctcatgcaccactctgtgcctcagtttccccatgttaggcggctggctggtcctggctgggagccaagtgcccccctctcccgcgccccgagcagtggctggctgggtcagctgggccccgtgccaggcgccctgctgtccggaagccacgggcctcacacccaaacataagctggtgccaccacccgcccgccgtcacgggttccgctgagctcagggcagctgcggccgggcggggctggggcggaagtgaggctggagctgccggggggcaccgtcctggggacagcagggcctggcacccccgcccagcacccacgctcccttccctgctcaggaggggctgacccgatggtttctggaaagatcatcagggaagggccagagcccccgggaagggggtcctgtgtgtcagggtacctggggcctctcctcgtagagtcaggtgcccacccattcctcagggatagggttgctagataaagttcagggcacccggcctggtgcagtggctcctgcctgtaatcccggcactctgggaggccgagacaggccgatcgcctgaggtcaggagtttaagaccagcctgagcaacacggcgagacctcatcgctacaaaaaattaaaaaattagcagggcagggtggtgcacacctgtaatccccactactcaggaggccgaggtgggaggatcccttgagcccaggagttcaagaccagcctgtgcaatatggcgagacctcatctccacaaaaaataaaagaatcagccaggcgtggtggcgcacacctgcagtccctgctactcaggaggctgaggtgggaggattgcttgagcccataggcggaggctgcagtgagctgtgattgcaccactgcactccagcgtgggccacagagcgagacagtgtctcagaaaaaaaaaatggaatttatcattgaaacgaattcaactttgatttaaatagaagcatgtttatttgctcttgttgaatctggccgcccctgtgtgtggcggaggcctgtctccccgctgtgggcgggggctttgtctgacccagccctgaccccccacagtacaagcaggtgtgaaggcctatctccccgccacaggccggggggctgtctgacccacaagcaggtgcccgtgtgcccgctgcaggctgggggcggtgtctgacccagcctcgcctccccacagtacaagcaggtgcccctgtgcccgctgcaggccgggggcggtgtctgacccagcctcgcctcctccccacagtacaagcaggtggagcagtacatgtccttccacaagctgccagctgacttccgccagaagatccacgactactatgagcaccgttaccagggcaagatgtttgacgaggacagcatcctgggcgagctcaacgggcccctgcgggaggtgaggcgggcgccgggcgggcgggaggcagcctccggtacagggccggcctccctctcctggagcccaggagccggtccctgagggaggcgaggtgcctaggctgcagcaggagggactcgagctagacctgcgtacacaccctcccctccccgccccgtgagcctctgcacccccaggacccccgccacccccgccttgcttcccgctgcccccttagcagaactgcctgggtctgtgcctgacagggcggggcagaagcagggcagggggtggggagggaggagccgcagaggccccgctgagcaccaggtcctgggggcactgaggctgattggagcgggtttaactcccagctctgttccggtagcctgagtgaccctgggcaagtttcccagggttgcgggaacaaatacccacaggctgagtggcttgaacagcggagattcggcctcccaccgtcctggaggccggaagcccaacatcaaggcgtgggccgggccgtgctacccccccggagcccctggggaggatccttcctgcctcttccggcgtctggggctccaggcgcccttggcttgcagattgatctccctgatctctgcctccatctgctcacagccttctcccctgtgtgtctctgtctcttcttgtaaattcatccgtcgttggatcagggcccacccggttcctcgtggcctcgccttaactgggccatgtctgcagagaccctatttccacataaggtcctattcacaggaaccgggggtcaggatgtcagcctgtctttctgggagatgtagttcaacccacaacacacatcaaacagttattgagcgccgactgcgtgccctgccgtgtgcttgaaggtcccaccctcaggaagcggggcctagggatggcggccgtgatcacgcaggcagcagagagcagctctgggaagcggggagggacgaggacggggaggcgacatcagcaaggccgtgtgtgagccaggcagggtgtccccggtgtagcacctggctcgggcagaggccccgaggaggggctggaggagctgggcgaggaggcgggcaggacgggcctgacactagggacctcgggccccgggaatgcctctgggggggcgtgtacacccgttgctcccaggaggcacacactgcggttcgcttcgccaagaatgtttaattgcatttgatgactacggtttccattcattcatttgtagagatataacactcagaccacaaaatgcataaaatgcggtggcttttagtattaacagagtgctgcacccgataccacagcctcactccagaacattctcatgggcccaaaaggagacctggggtgttagtcaccagctcactccccgtccccagcccctggcaacccacgctacttagtcattatttaggtgtttaggagttgcaaagtcaaatctttaaacccacatatggccaggcgtggtggctcacgcctgtaatcccagcactttcagaggccgagacgggcagatcacctgaggtcaggagttcgagaccagcctggccaacatggtgaagccccgtctccactaaaaatacaaaattagccgggcgtggtggtgggcgcctgtaatcccagctactctggaggctgagacaggagaatcgcttgaacccaggaggcggcggttgcagtgagccgagattgtgccactgcactccagcctggacaacagagcgagactccgtctcaaaaaaaaaaaaagtaccaaaaagtgccccaggtcataagggcacagctcgatagctggtccctaaagggaacgtggtgtaaccaccacacagaacgaagctggaacgttcctgccgtccttagaagctgcctttgctaaggggaattgccctgacttcccacaccattgattcatctccagacccttggttttcatgttgatttttcaaaaatcacctgatagtctgaccgaatgtagctttccactggtgtgtgtgtgtgtgtgtgtgtgtgtgtgtgtgtgagagagagatggagtctcgctctgtcacccgggctccagtgcagttgtgtgatcttggttcactgtaacctcctcctcccgggttcaagagactcgtgcctcagcctcccgagtagctgggattacaggcacccgccaccacacccagctaattttttgtatttttagtagagatggggtttcaccatgttggccaggctggtctcgaactcctgacatcaggcgatccacccaccttggcctcccagagtgctgggattacaggtgtgagccaccacgcccggccttatttttcccccattttctttttttttttttttgagtcagggtcttgttctgcgctcaggctggagggcagtggtgtggggatcacggctcactgcagcctcgacttcctgcaccaccacgcctggctgttttttttttttccggtagagacgggggtcttaccgtgttgcccaggctggtctagaactcctgggctcaagcgatcctcccgcctcggcctccgcaaatgctgagatcacacgcgtgagcccccgcacccggcctcctttccaccgctcttgtctacagccgcccctcctggtccgattgtattggcagatgtcgccaatacggtgtcaaacggcgaaggggcactgagcgttttttctttctcccgtccttggcggcagcagctcggttccggctacggggctgagcccgtctctcagacgaggaaactggggtccgagaggtgagccggtcccagaggcagggcgagggggaagcgggagtggggtccgcagcggacccagccctgcctcccccctgcaggagatcgtcaacttcaactgccggaagctggtggcctccatgccgctgttcgccaacgccgaccccaacttcgtcacggccatgctgaccaagctcaagttcgaggtcttccagccgggtgactacatcatccgcgaaggcaccatcgggaagaagatgtacttcatccagcacggcgtggtcagcgtgctcactaagggcaacaaggagatgaagctgtccgatggctcctacttcgggggtgagcttgaggggggcgcgcctggagggggagggggcacgcgacccccgcggtgtgcagagccagggggccggggccggggccggggccggggatggggatggggatggggatggggccggggatggggatggggatggggatggggccggggatggggatggggatggggccggggatggggatggggccggggatggggccggggatggggccggggatggggccggggccggcaccagggagagcctgggtgggaagcgcccacgctggccaaggtgcagaggccgggccgtgtgcctgggcggggagggccgcggcgcccgcctcgtccagcaacccccccctgcgcgccacgtgcagagatctgcctgctcacccggggccgccgcacggcgagcgtgcgggctgacacctactgccgcctctattcgctgagcgtggacaacttcaacgaggtgctggaggagtaccccatgatgcggcgcgccttcgagacggtggccatcgaccgcctggaccgcatcggtgagcgggccgggggcgtggccggggcgggtgccctggcgggggaggggcgtggccaaggcatcaggagagtggcttggacagtggcagggggaagggcgtggctgtggcatcaggggcacggttggggcagagacgtggccaaggcatcaggagtgtggccatggcagcaggggcgtggctggggcaggggcagcggctggccgctcctaggacccctttgggtctagaggctgattttctgacctattgtcctacttcagccagaggcagcctgtttcccaagggagggaatgcacagggtgtttgcggttgtgccgaatgctcggtgagcacctgctgtgtgctgggggtgcaggggacagacccgggggcccactcagactcccagggaggcttatggactggtgatgaaatcacacacgactgggctgtgtgccagcagggcaggtggggccggtgggcttccctgagttgggaatgcagagtggagaccagggtaagggatgccatgtggaaacggggaggaagatgtgttcgtggagtggacacagcacatcccaaggccctgaggtggaaaagaggcctagagtccagagagccagggaggcctggaggaggttggggaagaaggggaggccagacacacagggcccagtgggcggcagggagagtttagactaaatcaggagcatcagggagccatggagggttctaggtgggcggaggacctggtcagattgtatccgccaaggcgggccgtgtccaggagggagacggtgacctggcctctcaggggggcagtctctggggcagggagcggcagagccctgatgactggatgtaggcgccagagagatggcggctcatgctgctgttcgtgggaatgggaatgaagaccatggctgaaacgcaggacaggtgcgacggagtggtgtcagggagctccctggtgtacagtaggaagctctccacaacttgctctatacagtgagtatgcaacccgttcctgagtatcaggtgcttaggttataacttctgtatacagcaggtgctcagcacaggctgtgtacaggcaggtgttttcggtatgcctgtggcacactggaggcagtcattacataatcagcgtatacaggtggtacacatgcatacttggtgcacagtgatacctgctccatgtacacagcaggcattaaatacctgtttactgccaggcgcggtggctcacgcctgtagtcccagcactttcggaggccaaggtgggtggatcacgaggtcaggagattgagaccatcctggctaacatggtgaaaccccgtctctactaaaaaaaaaatacaaaaaattagccgggtgtggtggcgggcgcctgtagtcccagctactcgggaggatgaggcaggagaatggtgtgaacccgggaggtggaccttgcagtgggccgagatcgcgccactgcactccagcccgggcgacagagcaagactccgtctcagaaacaaagcaaaacaaaagccctgctttctgtatgcaggtgcttcatgcatgctggctgtgcatagcaggtgctcagcctgtatatggcaggtactcaatatccatactataggccagagatgctacatatgtgcttattgtatacagtaggtggtaaatgcatgcttgctctacacggcaagcactgtgtgcgcacccgcggtgcagagtaggtgctcggtgcccgctgtacgcagcaggcgctccctgtgcacacgctaacgccccctctcccgcaggcaagaagaattccatcctcctgcacaaggtgcagcatgacctcaactcgggcgtattcaacaaccaggagaacgccatcatccaggagatcgtcaagtacgaccgcgagatggtgcagcaggccgagctgggtcagcgcgtgggcctcttcccgccgccgccgccgccgccgcaggtcacctcggccatcgccacgctgcagcaggcggcggccatgagcttctgcccgcaggtggcgcggccgctcgtggggccgctggcgctcggctcgccgcgcctcgtgcgccgcccgcccccggggcccgcacctgccgccgcctcacccgggcccccgccccccgccagccccccgggcgcgcccgccagcccccgggcaccgcggacctcgccctacggcggcctgcccgccgccccccttgctgggcccgccctgcccgcgcgccgcctgagccgcgcgtcgcgcccactgtccgcctcgcagccctcgctgcctcacggcgcccccggccccgcggcctccacacgcccggccagcagctccacaccgcgcttggggcccacgcccgctgcccgggccgccgcgcccagcccggaccgcagggactcggcctcacccggcgccgccggcggcctggacccccaggactccgcgcgctcgcgcctctcgtccaacttgtgaccctcgccgaccgccccgcgggcccaggcgggccgggggcggggccgtcatccagaccaaagccatgccattgcgctgccccggccgccagtccgcccagaagccatagacgagacgtaggtagccgtagttggacggacgggcagggccggcggggcagccccctccgcgcccccggccgtcccccctcatcgccccgcgcccacccccatcgcccctgcccccggcggcggcctcgcgtgcgagggggctcccttcacctcggtgcctcagttcccccagctgtaagacagggacggggcggcccagtggctgagaggagccggctgtggagccccgcccgccccccaccctctaggtggcccccgtccgaggaggatcgttttctaagtgcaatacttggcccgccggcttcccgctgcccccatcgcgctcacgcaataaccggcccggcccccgtccgcgcgcgtcccccggtgacctcggggagcagcaccccgcctccctccagcactggcaccgagaggcaggcctggctgcgcagggcgcgggggggaggctggggtcccgccgccgtgatgaatgtactgacgagccgaggcagcagtgcccccaccgtggccccccacgccccattaacccccacacccccattccgcgcaataaacgacagcattggcgccaagcctggccgcgtgtgattgcccgagacccgcagggcgtgcacccttcctgaagacagtggctcctgggggtggcaaaagagctttatttacacactgacaaggctcacggggtgtcagctgaagaagtaggtggaacgcttcacctgctccaggtcgaaggcccctgcggaggaagcagagcggacggcgtgggtggcgggaaagccccgccctggcccgcagttcgagccacccttgcgaggctgcccacccgcctacctggcttgggcaccgcctgcagtgtctccttcagctggctggcctccaagatcttctggggcctggggttggaagcagggtggggtgaggctgaggccaggttttggggtggggggggaatccaggtagttggggtcagggagcgccttactcagagcagaaccgcttgaccaggaatctggacaggtcctgcaggatgggctcgctgtgcaagcggacaaactgctcccggcacacctgggcaggagtcagaggatccccaggggtgatcaggcaggctctgggcaccacccctacccaacgccccagtgtgggggccccacccatgggtggactgaggctcagactacgggggcacctggttcatgacggagacatcagctgcgtgagtccagtaacagtcgtgcacagagacgaaggtcaggcccttcctgtggcagagcggaggactcctgaagggaggggagctcacagggccacccagtgaccagcatcctggccctgcgctcagccccctccacttgaggtccagggaagcccaccctcctgcaggcctcgccccacccctcgccccgcccctccccaaacatcctgggttaggtatcagtacagggggaggaaatgttcccagaagcctcctcgccccacccctgccgccccccacgctgctgtgggagcctcagctccgagggcggctacgaggtcccctcctgccagggccaccaccccgcatcctgagcattcccagctcccgtggccggtagattctgctggaacgacctccacgtgctccagatctaaccacacatcgcggtgccaagaaatgcccagcaggaaggggcagcgcccatgctcggctctccctgtcgggccacaggaggggagctgccaggaccacctacattcggggcacacagcctcagggcctctacacaggccccacagacacagcagatccactctgcccagtccctgcccccagctagacccagccttgccagctgtgccctgctagccagaagacgcccctgggaggcgagcggcacccacgccgtccggagacgcccacctgtagcagtgcagggcggtgagcatcatgtgggaggagtccagcgagtggatgaagttgggcgggaagccgttcttctgcttacgtgtgttgggctttctgaggacggaacaggtgccggtgggggcggcccagggacacccctaactggccgctgtctccaccgtggctgctctccagacccccggccaggccccagcccgggccccccactcaccggctgatgtctccgttgtgggtgtaggtgatgctctgaattccacctcctatttgctaaaaaggggaaggggccggtgagtcccacccgaggcccagcacggtggtggtacattgaggtggtggtacactggggtagtggcacgctaggatggtggcacactggcgcgggatggggtggcacactggggcggtggtacactggggtggtggtacgctggggcactggtacactgggacgctgttacactgggatggtggcacactggggagggatggggtggtacactgaccttgaccttggagtccaggcgatagggctggatgacggggacgcccaggggtgtgacccactccaccacagagcccatgtgggagatgaggcgggcactctcggtcagccagtgctgtgggacacaggccgtctcagggcagggggctcaggccggggatcccgtccacttgcttagggagtcctggccgagcggggacaggacaggacgtacctggatggcccgggtccccgagaacatctcctgtagactcttgaagacctggcgtacgagatagtgagaggcctcccacacgaactcctgcagagggcgggcagcaggtgcaggtcctcaggggctggcccgttcacgccctactcccccctatttcagagccactgaggcccaaggcctagggcctagcaggggggcaggggaatggggcctggcgcccacgcagtcagcaagaaacgcccaagccctaacaggcagccagtggtctgggggagcagccagggctcctgctgggaggctgggtcgggggcacacccgtctgagttttaaatggcagtgaaaccaacgtgttcgcagcgcgacatgcctggcgcacctggggaaagtcgctcagctcccggaggcgcttctcaatctgcaggcgcccgccatagcgcgtgaccccgtacaccaccgtcatcaccgtctgcttcaccaccttgcgggtgatgaaaccttccagcacctgtgccacccgcatgccccgctgggcgtcctgcctacggaacacctccacctgcacggcgggtgggccgggggcgcgggtcagccccgctagcagcccaggggccaccaagcacccatgaagcccccgccccagccccaccacatcctcaggacaggccaaggtgagggcacctggggccgagactcagggctcacattgcccccacgccgagatgcccccgggcagcagggcacaccctacctgcgcggccacgccgctgtacacgtcctgcggcacatccgagggctccaggttgacggaggcggcgcccacgctgtcgcggcccagagcagcataatgctgcaggccgttgcaagagccgtcctgaggaaggggcggcaaacgggagatggaagctagagaggcagagacgtgtgggaccccaaaccaccccccaggtcgagccgttcctagggccgtgcaccccccagccaagtgcaccggagcccccgcacgctcccgggagagaccaggagccatggctcccgcacactctaggaccacctccagagaataccacgagcgaaggtgaaatctcacaccctcaagtcgagccccaggcccagtgcacactgcacggcctcgggggccagacccagctggctcacctgatggacggggaggtgggagacataggcggcagggtcggaggcgcgcacagcgttcgccacctccatacagcaggccagcgtctgccagggttcctccgcgcccatccaccactttcggccctgcggggacagcggatggggggcagtgaggcccgggcccgatccctgagcccgctgggaggctgtgttgcggggaggtgggaaatggggaggagacgcacacccgtgatagtgaacacgggacgcatgtgggcgagagacggggcggtggctggatgagttctccatagccacggatggaggatgggagctgcgggtggaccgggctgaaacaagcgtgtccggagctgccgggggaggagggtggacagaggacctgggggcgccgggggaggaagcagctcggcggatgcaggggaggggggaacgtggggaacgcgggggccctggggcaggggagaagggagaagcaggacgggcagggggcgcgggggaggagagcgggcgggggacgtgggggcgccaggggagggggaggggaggaggaagacgggcagggggcgccaggggagggggaggggaggaggaagacgggcagggggcgcgggggcgccgggggagggcgcgggggcgccgggggagggcgcgggggtgccgggagggcggggaatgcgggggccccgcccctaccgtcaagggttggtccgcggagtccaggatgtcatccatcacctcctccgcaaaggccaggcgcttccgcagcggctcccgcttcttcaaccccgtgagattgaccaggtggatcttgagccaatccaggccgtgcgggccgagcgggcggccctgggcgaactccagcagggcccgcgccacgtcgctgcccaggtggttgaagtgcggcgggcaggggtaggtgcggccgcggaagtccatgttgtgcggcagccagaagacgcggtcccgcaggtgctgcgccagcgagaggcggtacagcgcctccgcccgcaggctgtgcatctcccgggccaccttctggcagtgcgccagctcacggcgcagctcggccttgcgggcgggcgcggcgctgtgcggcaggtgggcctcgggcggctggggcgcctcggagggcggggccggcacgcctagctgggggcagcccttggcctggaagagctgcagcaccaggtccagcacgcgcccgttgacgcgccaggcgcagttgcccagttgggtgagggcgtccagtgcgccatgcagcgcggtgggcgggcaggtttccagcagctcctggtgctgcgtggcgccttccaccgtgcgcatcagcttggtggggctgagcaggaaagcaccagagtgcggcgatgtccagggcagcggggggcaaagcatgggtacatccaccgcctcgaaggtcagcgtgggctccgcggccttctccagcagctgcacgtaggccgggtgcggcttcaggatgccgatctggggtgcgacaggcagacgggtcagggccccggtgctggggctttcctgttcccaccccttaaacttgggtgagaggggccggctccccggccaacaagaaaccagtgtggcctcccacgaacagaagccacctccagaaacggccggacacctgcatggacacccatggtgtgtcccgagtcctgggaggtactgacggctgcgctgagatcaaggctccgcccaaaggcgccaaccccatggggtccctggtcctcccagcgggatgccccccagctcaggagggcactgcctggcacctgctggacgttgcggaaggaatacacgtggtagagcacggggacaagccgagaggaacgatgcggcttgtccaggctgcatggcatctgcgtagcctgcaccagcatctccgccagcagcttgcccagctccatctgcactggcaggggccagggctgctcccgcagggcctcgggcgcccccagctcctcccagtactgccgcggcaggcagggctcgggcacctgtaggacagggcggtcagggcgctgggcaccggggcccctgagctagatgccccaccgcccgtgcctgacgcccggtggggcatctgtcagcccaagcatacagatgaacagactgaagcttgggtgcaaacccggctgctccagggagggagagcgcccacccaccactggccccagccaggaggagagggggtgcgagcctcacctcggcgtcggaggccagcaagcagaggtacttcctgtagtggttctgcagcgcctgcacctggccactgacccgctgcctctgcaccacgtgccggctgaaagtgcgcgcactcagctcccgggccagggtggtgaaggactcaccttgggcgggcagcgcctgcaggacctgcggaaggcagccgtgagtgcctgcccgccccgcccggggacccggccgcgcggaggaagacgcacctgcaggagcatccgcaccacctcgcgctcgtccagcaggcacaggaaggggtaaagtgagaaccggccctcgtacacctcgcgctctaggcggttcttggtctcccgcagcgcccggcacagtgctttctcccattggtcccgcagggtcttcagggtcttccgctgcgggggatgaacgggcccggtgagccccgtggcagctggtgggacccaggctcacaggacgggggtcaccgcagctccctgcagagacctcatggccctcaaggtccctgctgtgtgttccgggtagctcctcaccccggcctgccctctgccggcttcagcgtgcctgacgcagccaagagcaaaagcccagctgcagtgtgcgcagaagcacaggccaagacccaacctcgggaccccacaagttttccctgagcggcagccaggctgagttcctaggccctgcatgaccagaccagggcatgagcaattcaaccgcatacacggagctcagcccctgcggcggacacgcgaccccggctcagcccctgcggcggacacgggaccccggctcagcccgtgcggtggacacgcgaccccggctcagcccctgcggcggacacgggaccccggctcagcccctaccgcgtgcttgacctccttgcttggcaacgtgggcttctccacggacaccacgcacaccctgctggccagctccatgtggagctgcttctcaaagaggcactgcagggtcttcaagggcaggtgcagcttcgggtaggacacacgcccatcctgcagggatgggggtagtgaggttgggggcttgccagagggcgacctgccctcccaggaccccgagacagcatgggtgcacgcgtttctgcgtctcctgcaagttgctggtggctatcgctgacgcggggaaaggcgggctgcgggtaaagtcagtgccagcagtgcaaaccaaaggccttgaccctcctggcctcgacccctctagaagggacactgggcaccgtgcagggggtggcaggggcggtgatgctgggagctggcagagcctggggagaccgttcactgcacccccagatgttggctgttttctcctcaaactcagaactgtatgaatgtgacccatccagaaatagatgaattaaaaataacaactaaagcctagcgctttgagaatcaaagacgcacgtccacataaaagcttgtacacaaacgttcacagctgcatgactcgcagtcgataagtagaaacagcccaacgtcccataaacggacgaacagacgggcacggcgcggccatccacgcaccggagcatgactcagccctgacccaggtcgcctcccggaggcaccatgaggacgtcacgctcagtgggagatgccaaacacaaaaggtctcgcagtgtgtggtcccatttctatggaatgtccagagcagactcatccacagatggggaggggatggggagtgacggggatggggacgaggcttccttttagggtgatggaacattctagaattagacaaccgtgactacactaaaatcgctgaattacacctttaagagggttttatggcaggtgaattacacctcagtaacagacgagcccactgcgtgcacctggcagccccactcaaacgcactgctctcctgtcaccccaccctctctctgcggcccccgaccacctcgtccccctgagcccacaccctcagggccaagaccctcccagctctgggtcctcccatcttctcagaggaggaagggaggaattcagggcccagcccaggtgagccctgggcaccggggaggcccattggtctgagctgaggctccaggaacccccaaagggcagctataaggactgaagtctgccggggcccacgtgggctcaccttggcatacacgtccctgagcagcttggaggtgttgaccgggggcggcagctgcggcgggaggctgaaggtgggcttcaccttgtgcacggccttcagaacagtggcccgatcctcctcagacagcagaacggcggtgaagagtgcctgcagcttcagcccctcctggctcatctgttccagacacctgtggtgcaggcggcctgctcgagggacgggccagccccacgctgggcttccacagaccccaggggaacctcgtgaccacctcctgctagcctgcaggtctcggtgtggctgtcaggccctctgggggtccccagcccccagcccaggcaccgtcccagatcttaaaaccctgggagggacatggtggggggtgggggccctcccgacaccacctacctttcgatggtcccggcgtcctggtcctgcctccccatgcactggagggcagccgcataggacagcaggtccggagtcaagccggcatccttcaccatgaataacacatataccagctccttgaaggcaccctgggagaccaagccagggtgagggtctggggggatggcccaacctccacatcctccctgctccctggagaccccttctctgtagccaccagctcagcaggggacagggtcaccaggcaggagtggccagctgggcagaccgatgcatccccctgaggttctgacacacaagctccacctgcagaggcagccgcatggcccgccaggtgggactgtgggaggttcacgttcctctgggaggcagcttgttaaacctccagatttgtcaattgtgtggatcttttcaaaggactgacttggcttgactgttctctgctgtttctgccttccatttcatcgatttgttttaatctttgtaacttcctctcatctacttgctttaggtttagtgacagcttcttcttctagtttcctaaggtgaaaggtgacgtatttggtctgagatgtttcactttttttccccccaagatggagtcttgctctgttgcccaggctggagtgcagtggcacaatctcagctgggccgggttctctgcctcccaggttccagcacttctcctgcctcagcctcctgagtagctgggattacaggcacacgccaccacaccagctaattttttgtattcttagcagatacggggtttcaccatgctggccaggctggtctcgaactcctgacatcgtgatccgccagcctcagcctcccaaagtgctgggatgacaggtgtgcaccaccgcgcccggccatcacctttccgaatataggcattttgtgactataaattaccctgcgagcactgtgtcagctgcatcccaggacttctgacaggtggtgttttcattttcattatctccaagtgttttcgaacttcatagtttacttcttctttggaaattttatttaattatttttttagatagagtctcgctctgtcgcccaggctggagtgcagtggcgcaatctcagctcactgtcaacctccgcctcccgggttcaaccgattctcctgcctcagcctcctgagtagctgggactacaggcacatgccaccacacccagctaattattttgtatttttagtagagatggggtttcgccctgttggccaggctggtctccaactcctgacctcaggggatccacccgcctcggcctcccaaagtgctgggattacaggtgtgagccaccacgcccagccatgtatagcttaaatatcccctgcaatttttttttttttcatttaatttttggccaggcacagtggctcatgcctgtaaccccagcactttgggaggccaagacaggaggatcacaaggtcaggagtttaagaccagcctggccaacatagtgaaaccccatctccactaaaaatacaaaaaaaaaaaaaaaaaattagctgggcgtggtggctcatgcctgtgctccctccactaaaaatacaaaaaaaaaaaaaaattagctgggcgtggtggcacatgcctgtaatctcagctactgggagcctggggcaggagaatcacttgaacgcagaaagcggaaattgcggtaagccgggatctcaccactgcactccagcctgggagacagaaactttgctgtcgacagacttggagactctgtcttaaaatatacacacacacacatatatatatatatataaaataacatatatatataatttttttcttgtattcatttttcctgacatccctgttctgagcaatttctcctttgacccagtggctgcttaagagtggcctgtaactgtaacagactattccaaagggaaaaaaattcccttacatcctcccaccccatagtcctgcagctgaagacatgctgtgacatgaggtggccacacaccagagaccagagacatgagttttggggcatttttttttttttttttttttgagacggagtctcgctctgtcgcccaggctggagtgcagtggctcgatctcggctcactgcaagctctgcctcccaggttcactccatcctcctgcctcagcctcccaagtagctgggactgcaggcgcccgccaccacacccggctaattttttgtatatttttagtagagacggggtttcactgtgttagccaggatggtctcatctcctgacctcgtgatccgcccgcctcagcctcccaaagtgctgggattacaggcgtgagccactgtgcccggccggttttggggcagtttctaaacaacctctgtatggtagacctcactggccacacatagtccttaaattgaaatattcagttcttccctttcaccagcttcaagtgttcagtagcacacacagctgttggcagatgcggaaaattcccaacatcatagaaagttctactggatggtgctggttagaatacgtggccgggcgcggtcgctcacgcctgtaatcccagcacttagggaggctgaggcgggcggattacctgaggtcaggagtttgagaccagcccggccaacatggcaaaagcccgtctctactaaaaatacaaaaattggccgggcgtggtggtgagtccctgtaatcccagccactcaggaggctgcggcagggagaattattgaacccaggaggcggaggctgtagtgagccgagatcatggcactgcaccctagcctgggcaacagacagagagtctatctcaaaaaaaaaaaaaaaaaaaagatagaagcaatgccttagcctggctaacatgctgaaaccccacctctactaaaaataaaaattaaaacaattatccgggggtggtggcacacgcctgtaatcccagctgctcgggaggctgagctcgcagtccagcgacatccaggactgctggccaccccggaacgctgggagaggcaggaggggcccctgctagagcctctggagagacttcgggtctgcagacatcttgattccagacttctgggctcgtgctaagagtgcgtttctgctgtgcaagccgccaggtttgggacactttcgtaggggccgatcccaaaagcgccctgttacagtgtgggctctctgcccagggaatccagggggcttgtgaccttggaggggaaaatacacgaccctcatcctcagtcctcccggagtctggcgccccctgcagcaaggaggaaccaggcagcacgccgcctccacctcgcggtaagagcactgcggacttcaccgcaagactggccccacctgatcctgaatttcgctgtttgatgcgttaataaagaagcacatcaagttctctaccacgaattggtcttaatattgcgatatctgtattttaatataatagtatcccatgtttacccaaatattaagagaagcttttactgttgtttctcaaattagggctgaaggatcatggggggggagaaagctgggaacgtttgctgctttgaaagggtgtgtaaacaacaccctccaaaacaaccaagagttccgaggagaaactttggccggatacggtggctcacgcctgtaatctcagctcctcgggaggctcaggggggcagatcacgaggtcaggagtttgagaccagcttggccaacacggtgaaacccccgtctctactcaaaatacaaaaattaatcgggggtggtggcgggcacctgtaactccagctacttaggaggctgaggcaggataatcacttgaacctgggaggtggaggtggccatgagccgagatcgcaccaccgcactccaacctagtaacagggagagtatgtcccagaaaacaaataaataaacaaacaaaaagaaaacggcaagggaaattggaaaatactccagatgaaccacaacgaagatgggtgggatacatctaaagctgtgctcagagggaatgcggcgccagtgaacacccacatttcacacagaaggatctcagcacagcagcccgaccttccacctcaggaaaccagaaaaaggagcaaagtcaaccccaacaccaaagcctcatcctgacgagggctctgcaggctgccccccgacgaggccaaaagcacccctgcccagacagattcacgagccccgagaaagaacggaaggaaatgctcaaggcattagcagaatttctccctacttttttggtcattttcaaaatttgagagtcacacgtgatttgtatttgaaaagcctaaaagaattattaaaataaaaaacaaaggacttgaacctgggggctaagagagaaaagtccagtctaaatgagggcaagttcctgtctccaacgaccagggcaggtggcccggctcccggctgcactcacctgccgcgcccagccaagcatcacggcgttgtacatgtccagcgtgagcagcttccgcttctgccgctggccgtggtggacgaccagcaggtggtgggcgaggggcagctggtcagtgagcaggcagcacttgaagaaggccaggagcctctgctgctgacctgagagctgggcctgcgagtgctgccccgacggggcctgctccacatcgaggctcagcttcccaggggcctcctgcagcagccgggccagctgctcctcccaggggctctcgggggcctggcgcgtgcagtcctccaggcacccggccatctgcttgctcaggagccggggctccacctgcaggcgcctggtcagcgccttgaactccccgctctggaatggcatctgcagcttcgccttcaaccgctgcatacgcatctgctgggtccgcttatccttctccagtatctttgcccagcggccacagggcaccggggtggcatccttggcccccatctggaccttcctgggtggctggaggctaccatctccactgccacattctgggagccgcgccacatccaccctgttcaccaccacctccgacacgctctcagcctgcagctgccgcacccgcgcctggagcactgtgaggggcagaaggcgaggacatgagagggaccccctccccattcgagcacccgtctctctggaccctgagccaggccaggaggtgcaggtggctgagctcgctgggacccaaggcgtgaattcctcatacttgccaacaacgttgtaaggtctgcccgctgctttccagacacacgcaccccaccacctccgcacctccccacccgagcctcacagaactcagcagccctaacaagctgccaccgaaacctgcagcaccacgtctccccggtcactggccgctcagaccctccaggtgcacaggcccagaacccggggtctgtgacaactccctccgtccacctctcagtacctcctctgggcttgcctccagaatctatccaggtggcccccgcctcccctgcccctctcactgtctagctcagggcctctgcacagactcccaggaccctgaaccgcccactccctggctcaaccatggcctgcaagttcgcaccccgcctcagcaagacccccccagctggtggagctgccacacacacactcctaggctcccagtgtctacaccggtggacgctgagccactagctcgcagggaaaacgcggctcctgctcgtgccgcctcaggttgcatttttgccaaccaatcaatgcctaagtgttctgtatctctttaaagaagccttgttggaaatctattgctggccgggcatggcggctcacgtcggtcatcccagcactttgggaggccgaggcaggaagatcacctaaggtcaggagttcgagaccagcctggccaacatggtgaaaccccgtctctattagaaatccaaaaaattagctgggcgtggtggcatgtgtctatagtaccagctacttgggaggctgaggcaggagaattgcttgagcctgggaggcagaggttgcagtgactcaagatagcgccattgaactccagcctgggcaacagaacaataatccatctaaaaaaaaaagactgttgaaataagccgggtacagggccgcgcacctgtggtcccagctactccggtggctgaggtgaaagaatcacctaagcctaggagttcctggctgctgtgagccgtgatcaggccaccgtgctgcagcctgagagacagagcaggaccctgtctcaaaaaaaaaaagggggggggggacccaggtgtccagatgtggtggctcacgcctgtaatcccagcactttaggaggccgaggcaggcggatcacgaggtcaggagatcaagaccatcctggctaacacggtgaaaccccgtccctactaaaaatacgaaaaattaaccgggcgtggtggtgcgcgcctgtagttccagctactcgggaggttgaggcaggagaattgcttgaactcgggaggcggaggctgcagtgagccaagatcgcaccattgcactccagcctagcaacagattgagaatccgtctcaagaaaaaaaaaattgctgaaataaaaagacaagcgtgatgtccgccttcagagtgctccaaaactcaggagatacttttaggattaacagttgagagctttgttttgttttgttttgtttttgagatggaatttccctcgttgcccaggctagagtgcaatggcatgatctcggctcaccgcaacctccaccttccgggttcaagcgattctcctgtctcagtctccccgggttcaagcgattttcctgcctcagcctcctgagtagctggcactgcaggcgttcaccaccatgcccagctaatttttgtatttttagtagagacagtgtttcaccatgttggccaggctggtcttgaactcatgacctcttgatccgcccgcctcggcctcccaaagtgctgggattacaggcgtgagccaccgcaccaggcctcggacccttgacctcttgatccgcccaccttggccacccaaaagtgctgggagtacaggcgtgagccaccgcaccaggcctcgaacccccgacctcttgatccgcccacctcggccacccaaaagtgctgggattacaggcgtgagccaccgcacctggccaggttttttccctttataaaggttctcccgcctctcccttcccggctgcctaatggacgcagacaggatgtgggacagaagcaccggcgggaagcaagcacagggaagctcccacctccctcccacaccaccagccaggccaggacgagggcctgccaccgctggagcctgggctgtccctcccaagtttcgcagtcatccagtctccattaggcgcctaccccccagagccaagccaggacagctgagtcagttcagggttcacatcctggctctgcacatgtggccttggcggcggggccggggggggggtctctccagacataatcttgggcctcacctatgtccctggaaagtgggagcacctggtggggttctggggagggggaattacgagagctccaggaaggagcctgctcagcaaggacagggcccatgagcggtgcaagagatgtttcagcaacgccgtctgggcgtgtcctgggacccgagaggtggagaccgccctcagcctgtctcagaatctgagcctttgccttttctcccggcagcagggagcggactctcctctcccgggccgccgtgggggtcgcgctcaccctccagcagctccacgtggccccagtccttcctgcggtcttggtcttgctcctgggggctggcggacgagctcctcctggggccgcagacgccaccggcggtccctgcgggaaagacgagagcggctgagcggggccgggcgtgtgggcgggggcctccataaaggcagaagccgaagggtcgaagggcaaaggagccctaaacgcagcggaaactctcggagcacgggcttaagttggaaagaaactaagacagcgaaggtggaagggccccgccgcggcgaacacgggcgcggaaccgccgagagagggttcctcgcactcgaggtgcagcaggtcaaaggttaagagccctaaacaccacacctggggtcaggaggctgcataagaaaccacgagtcaaaggtcagactgcacggaggagcctcagtcgaaaagcgggcaagggcgagtggaaagcggggccgggtcggtgggctgcgcacgcccaggtgcaaagaggcaaaggtcaaagcgccaaaggccccggccgcgcggggaggagcccacgccgtggcccccgggctgcctggccgtctccctttgtgttaccttctttgccggggagtcccgggcggccgcaaggccgtagggctcgtttgagccccgccgctccgcggccccagcaaagtgccgacattacgcacgccgctccaggccaccccaccggcccgcgcctgcgcatgcgcccgcgccgcctgccgggagttgtggtttcatggtcgacggaggctgcgaagggaaaccccagccggaagtagactcccaggatgcagcggaggcgcgaaggcatgcgccggtggacgctctgattggttcctcctgctgtttttaaagggagggggcgggacagagctgttgccgtggcaactgggaggcactctcaggctgttttcccgaggacctcaaatccggactttttttctgtttttctttcttttttggttttgttttggacgcgttgtggcccaggctggagtgcagtggcgtgatcatagctcagtgcagcttcgaactgctggggtaaagagatcctcgcccctcggcttcccaaagcgctgggattgcagacgccgccaccgtgcccggctttttttttttttttttcaaggcatactcatctaataacgaggacagcatctgcaatttagagattcctgtccgcaaccttcattgctccaacgacaacttttgggtaagagtcattaggatgccgtctatcatggaggaagctgaggctcagagagggccaccaagttgctggaagacacagcacgtgcgacctcagggaggctgcaaggagagaaagccccagtccgcgagactcccagcctccagcttcagtttaccctccaatccccaagccctcaggggcaggagccgaatggagcggcaggcttggattcacctgctaagtggggtgaggtcaagggaatgaaataaacctcggagcctagagcctgccctggtctccgcgtgatcctgcctaggaggagcagggcgggagctttagaatggaacctggaaggtgtgcccacctgtgtcgttcagccggggcagcaggccagaggcgggagcgcctgctgtggggcagtaggcttgggaagggtgagaataggaatatctgggggtaactgtgttccaggctaatatcccagttgcaaaggggagctggtttggtggctcaggcctgtcatcccagcactttgggaggctgaggcgggcggatcacctaaggtcagagttcgagaccagcttggcaaatacgcaagcatgcctggcaacatggcaaaaccccgtctctagtaaaaatacaaaaattatccgggggtggtggcgggcacctgtaatcccagctactcgggaggctgaggcaggagaatcgcttgaacccgggaggcggaggttgcagtgagccaagatctcgccactgcactccagcctgggtgacagagcgagaacctgtctcaaaaaaaaaaaagtgcaaagggaggtcagttcagtgcctcaggcctgtaatcccagcactttgggaggctgcggcgggaggatcgcttgagcccaggagttccagacaagccttgggcaaccgagatactgagacccagtctccaccaaaggaaaaaaagaaattagccaggcatggtggtgcacacctgtggtcccagatactcgggaggctgaggcaggaggactgcttgagcccaggaggtttagactgcagtgagctgagatggcgccactgtactccagcctgggttgacagaacaggaccctgtctcaaaacaaaacaagtgcaaaggccctgaggcaggaacaagcgtggacagaggagcaatttgagcagagtggggctggggagagggagcaaagatgtagctggggctcagttagggggcctgaccacacgggggctcgggggcctcagctcaagctatcctccatccccaaaccctggcacttcagtttccccatcagcccagaacgaggactcgacctcactctggaagggcctggcagcctccttacagcacattccagacgctgctgccgacgcctgcgtgagcgcactgatgccaccggctgggaatgttttcgacagacggcagcaccctccctcacctgcctcagtccacctcagggtgccccagcgggctgtgacctcagacctcacccactactggggtcacctgcctggccctgaatcagccaggcctggtgtgccaagacctacagacaccccctgcacccctgcaggctggcagagccagaaacttgggtggaaaccgacttctgaactatttcaccattccttatgcgttagtcttttcttttatttgatgagatcccagcactttgggaggccgaggcgggcggatcacgtgaggtcaggagtttgagaccagcctggccaacatggtgaaaccccgtctctactaaaaatacgaaaattagccgggcatggtggcctgtgcctgtaatcccagctactcaggaggccaagggaggaaaatcacttgaacctgagaggtggaggttacagtgagccaagatcgcaccactgcactccagccttgggcaatgtagccaaaccccatcactacaaataatacaaaaaaattttgttggctgtgatggtgcctgcctgtggccccatctacttgggaggctgaggtgggaagatgtagaattgcttgagccaggaggcagaggctgcagtgagctgtgattgagccactgcactccagcctgggcgacagagcgagaccctgtctcaaaaaaaaaagaacataatctgggttttggaataagacagcagtttctgaaacagctcattgcccaaattccagcctcgcaactctgtagccgccaccaccccccagccccaccatttattttaactacatctgtctccaccactcctgtattaagtaaatgcaatattggctggtcatggtggctcatgcctgtaattccagcactttgggaggctgaggcaggcagatcccctgaggtcaggagttcgagactggcctggccaacgtggtgaaaccctgtctccactaaaaattcaaaaattagccggacgtggtagtgggtggtgcctgtaatcccagctacttgggaggctgaggtaagagaaatgcttgaatccaagagactgaggttgcagtgagctgagatctcgccgctgcactccagcctgaacgacagagcgagactccgtctcaaaaataaattaataaatacaacattaattatttttcttgcttaagttttacgaagagacttaatatcaccatcaaaagtgggaaaccatatatctggccgggcgtggtggctcccgcctgtcatcccagcactacgggaggccgaggcgggcggatcccctgaggccgggagctggagaccagcctggctaacatggtgaaaccctcatctccaataaaaataacaaaaattagccgggcatggtgggtgcctgtaatcccagctattcaggaggctgaggcagaagaatcacttgaacccgggaggcggaggttgcagggagccgagatcacaccactgccctccggcctgggcgacagagcgagactctgtctaaaaacaaaacaaaacaaaacccaaccaagcaaaccccacagagtcgagaatcgctagatggaaggggatggcccaggtccctggagcccctgtgacaaattaccacaaactcggtgccttaaagcaacgttcattttcttacatttctggaaatgaaaagtccaaaatcaggactgcggggctgaagtcaaggtgtgtggaggcctcgctccctccagaggccctggggctccttcctgcctctcccagcttttgaaggctccaggtgtgcttggcctgcggccacatcactcccgtctcggtctctgtggtcgcactgcagcctcctcgtctgcctgtgtgaaatctcctcctgtctccgtattgtgaccgcgtttaggatgccccaggacaatcttctccatatcgttcagatcttcatggtgtcaatatattgagactctttttccaaataaggcaaatgtcacattctagggatcagggtggggacttacctttgggccaaccacagaggctacaaagaggaagacaccactcaatacaaagcgtgcgccagcccagccctgatcggtgtttgttgttgttgtttttgtttgagacagagtctcgctctgtcgcccaggctggagggcagtggcatgatctcagctcattgcaacctccgcctcctgggttgtatagattctcctgcctcagcctcctgagtagctgggattacaggcgtgaaaaggagcaaggctctgccccagccacagcgcggatgcaccttgaggatgtcatgctcagtgaaagacgccagacacagaaggacacacagtgtgtgatcccctttatatgaaatgtccacaacaggcccatccacagaggcaggaaggggatgtgtgggtgccgggggctggcagaggggatgagtgacagctgatggggcttcttcttgcggtgatggaatcttctggaactagacagtcgtggtggttgcacaactctacgaggtactaaaatcactgaactggctgggtgcagtggctcatgcctgtaatcccagcactttgggaggcagaagcaggtagatcacgaggtcaggagtttgagaccagcctggccaacatggtaaaactctgtctctactaaaaatacaaaaattagctgggtgtggtggcaggtgcctgtaatcccagctactcaggaggctgaggcaggagaatcgcttgaaccagggaggcagagtttgcagtgagccgagatcgcaccactgcactccagtctgggtgacagagccagactccgtctcaaagaaataataataaaataaaatcactgaactgtacagtgtaagtgggtgaattgtgtggtatatgagtgatgtttccgaggtgtcattaaagaaactcagacgcctggggtggggccagtctcaccgctgtgggtcccatccccatcatttctcacaaggccctcagatcacccttccgcggtggggggcggacactctaagaagggaagacctgggctcctgctggcgagaaggcggtggacatttcttcagtgtctggtgccgcgccctctgcccagcgtgctccgtggagggtctcattgtcttcctccagacgtctctttactggcccattttacagaggcggaaccgaagcttggggtgttggccacagggctctagtgtgggaagccaggccaggctggacctcagccatggggacccctgtccctgagactgtggcacctgccacaccctctgtgtgacccgcctaagccaggaagagagggtcaggagatgcctgagccaccaagaaggcatcccagcgtccagccagaccggttatccctccagagggctccccggcaggacaggctggtcgccatgtcttcagcctggtgctatttaaaggtgggtgccacctggggctgtggccgcagggccaggactgggctgctgggagctgtgtccccacagcggaggtcgccgcccctctcaggcctcggtttccccagttgtcaatgcctccacttggctgtgagtctgtgagggtcactgtgctcaccttttggggcccagcgcatggggcaggcagaggaagggtgggggccagccgccttgctgggtggttccccgtggggcctggggtatggctctaagggaggagcaagtgtgggtgcgaatggggccgccccattcctgccgcctccgacgtgccccgccagccggccaccgacaggtctacgtggctatcctccctcctgcccacctacctgcccaaacacacgtccccagtcgtcacctgcccacccacccgcgcattcccacacccttgtgggcctggctttcgggaaactacaatttgcggggagagaagtcccacgagggcatgccccggagcctggctggtcccacggctgacgcacgcggcaggacctcccgtgtccatctctgtccccaagcatctccgcctctgcccctctctgtctctgtgtctctctcgtctctcccggtcatcttccttgtgtctcttgactgccgccgtctttctgtctctgtctccctccgggtctctgtctccctccaggtctctgcggcccgcgtctcacactcccgcccccgcaacccgaggtcctagcccgcccggggactcggctgactcacggacacgccccgcgagacaaacaacaaacgcgcggaggccgagcgcggagtcccgcacggccgcgcccctgtgcacctggcccccgcccccgagacgtcccattggccggcgccctagcctggtcccgcccaagtggaccccgcccccgccccgaggcaccccattggccggcgtccccgccccagcgaacccggccccgcccccgaggcgccccattggccccgccgcgcgaaggcagagccgcggacgcccgggagcgacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagtgagtgcggggcggcgggggcctggggtggggaggcggcgggtgacggcaacgcggccgccgtcttcacggtgacctgcgcccgcgggggagtcccggaggctcctctgtgcagcctcggcctcagtttccgtggtctgtgagatgggtgcagcctgcctggtgggagggttgcactgttaaagcgaaggctgcagcggcggacccggctcaggggcagagaagcgtccgtgtggtacaaccctgtgggtggggccacccatctgcaggtgggaaactgaggctccagaggggctggggcaggcccagctgcatggcggaagcggcggggggctgacctccggactcctgacatcacagaatccagtcagggctgcctgagtcggggccccctctgcttcttcccagacaccccatctggcaggtgaggacaaggaggcacacagaagggatgggacctgcccagggtcacactgacaggggtggcggagctgggtccccacagggcccaggacgtcacggagcgggcgtctctgtccccagggtctgccgagcacactgaggtaggccctcagtgtttgtggaatgtcaggagcaagaggagaggctgggcacagcaggggatgtgggtacctggaggccaggggagtcggtgtccccgccgggcggggggcactgggaagggggcccgggcccgctggctgccgcctgaatcaccaccatcagggcaggtaatcaccccctgtccttcccaccgctttcatctgggcgccaaggccctcattaggccgcacgtgacgagggcggacaggggactggctgggccggtccatccatggcgggcatggccaggcggggtggcctcgggccggggcagaggcctggctccgctgcctgacctggaacagtctctgcctctctccaagcctcggtttccccagctggacggtgatgggggtgagggctagctgagggctctcctgcccttcgtgcattcgctggtcactaatcgggcaccttgtgggtgctgtgctccgcatgggggacccagtggtgacagagacgcccaccctcctggggctcccagagcagaggcgcgcagcagttagacacgtgaacaagggcgcaggtgggtgcacagaacagtgaacggttggccgggtgcagtggctcacgtcggtaatcccagcactttgggaggccgaggcgggcagatcacgaggtcaggagatcgagaccatcccggctaacacggtgaaaccccgtctctaccaaaaatacaaaaattagccgggtgtggtggcgggcgcctgtagtcccagctactcgggaggctgaggcaggagaatgacgtgaagccgggaggtggagcttgcagtgagctgagatcgcgccactgccctccaccctgggcgacagagcgagactccgtctcaaaaaaaaaaaaaaaaaaagaacagtgaatgacgtgaacaagggtgcaggtgggtgcgcagaacagtgaacggcggtgttgggaggcaccttgccaggggaggggaggtgcagggcgaggaaggggccaggggagatcgtgacacagacgccccagaacaaccacctcaaagacgttcctgtgtgtcctggaaggtcgggctgggaggctgccccgaggagctttcactttgacagggagctggccgggcacgcagggaactgtacacccagctgacaaagcggcagacacccaggccggggtgagcgagtgtgggtgaggagtggcggctggccccagggtccttgctggacaagacacttcagctcagggtggggcagggctcacccagggctacccacagacgatggcgtccaaatctggctctgccactcccaggcctcaactggcccctctgcaacgtgggctgctgagcgggcttggtaggacagctggcatacagtcggcgctcaagcatgtctgtggtgtcccataaaccaccggtgtcccactctaggccactgccagcccggcctccagtccagagtcccagtccggagtcccagtgactgtgcgtgggccgggcagctgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctggggggtctctggggtggtgtgagctgtgagggccgggctgggggctccatatggggtggtgtgagctgtgagggccgggctgggggctccatatggggtggtgtgagctgtgagggccgggctggggggtccctggggtggtgtgagctgtgagggccgggctgggggctccctggggtggtgtgagctctgagggccgggctggggggtctctggggtggtgtgagctgtgagggccgggctgggggctccatatggggtggtgtgagctctgagggccgggctgggggctccctggggtgctgctggtcgctggctcattgacagttatcagtggtctgggtgggccctgccccttctgactcccacatcccaggaaccctttcccaaccttcctcgtggtgttgctgcccccctgacgtccgtccctctgggtgtgtgggagcccccccgccatacacacacacagatgctgctcttgggctgagctgcagggacagcgctgacctggccctcccacggggtcctcatcgatctctgcactcccccagctcgtgggggccgtcctgcttcccgttccctctgcctgctccttgctcctccctcacatgctggggggggctcctggtgtcagtcacggctctgggggatcctgagtgtccgtcgtggtcgggaggggactcgtggtcccgggggtctcctggtatctgtcgtggtcctgagggccctgcacgaagcacagcggacagcagcggtgctgggggtgagccagcaaggccctccccgacccccgcctcccccaggcatcctggagatccgctctgtacacgtgggcgtcgtggtcatcaaagcagtgtcctcaggcttctacgtggccatgaaccgccggggccgcctctacgggtcggtgagtgccgggcagggctgggcggcgcgggcagggtggggagggtgggccggcctcacccccgcccgcagcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctgaggccctgagaggccggcggctccccaaggtgcctgggctggtggcgaggggcccggccacgcttgttcttccccctgcgggctctgtaagcgctgagtgcccaccgtgtgcgggcgctgtggacacagcccaggagccctccaggggggtcccagcctgagggggtggtggccaccaagcaggttcaatcctgagttggggacctcgaggacccaacagggcgcctctcgggctgaaggacgcagacgtcgaaaggtcgagggggacgtcccaggcagggcccggcagaggcaggggctcggggtggggagcacgttgggagtgggggcaggagcggaggggaggggagggggccggggagacggtgacagacgccgcagaacaccagcctcgaagccggtcccgtcccgggaatctgcaaatacaacgccttgcgaggacaaaggcacctgcaggtgggacggagatggaggagcatccagggtggggggtccagggccccagtgtcctcacagggtcctcacgacaggaggcgggacagtgagagccagagagagatggggatgggccgcgctgtggccgtgaaggggaggaagggccctaagctgagggacgtgggtgcctccagatgctggggaaggcgggaacggttccgcactggagcccccgggagggaccggcctgctcctgccttgatatgagcccagtgggacccagtttggactctggcctccagaaccgccagaaaataaacgtagtaagccatcaactttgtggtcttttgttacagcagacgtcggaaatatgcacacggtgtctgaaactgttctcatgacaaaataagcctcagatcccccggggaagggcggaggccaacgcctcggtgttcctccgatcccccgggaagggcggaggccgacgcctcggtgttcctcggatcccccgggaagggcagaggccgacgcctcggtgctcctcagatcccccgggaagggcagaggctgagggcaggagccgtgctgggtgcagggcaggcctgggggcttcatgccgctgtcctgcgggacgcagagagggctggccgtcggtgtgggggcgcccccacctgtgcccagcgccctcctgacatcctgactccgctgggacttctgcctacagccctgggagtcaaactccagcctctcagagaaaaggtcagagccaagagccccacagcctggagccaggcagtgacaccctgggcctgtctccccttctgtgtgtggggcgacagcagcatcgccctggtgaagtccccggggacggccagggctccatccccagccgccgccttccacataaatacaggaagactgggccgaggcacttgctgggaggtgctgagcagcctgacacggaaaacccttctgggaagggagggtcgtgcccggcccgagagcttctgctcaccctgcagacagaagcgagccccaccccaggggacaccaggcggcctctggggacatctttggctggcatggagtgggtggaggacagggctgcacccaggatgtccccaggttggcagtgtgaggggagatcggcccacgttggccagtcggagggcgtcgccacttgagttgtcactgggagctgcacaggtcaccacagctgaaataaaacttgctggcaccccacgcaggaacgtaacatgtgcctcgaagaaacgggtcagcaggccgggcgcgggggctcacgcctgtcatcccagcactttgggaggccgaggcgggtggatcacgaggtcaggagatcaaggccatcttggtcaacatggtgaaaccccgtgtctactaaaaatacaaaaaattagccgggcgtggtggcgggcgcctgtaattccagctacttgagaggctgaggcggggaatcgcttgaatccgggaggcggaggttgcagtgagctgagatcgcgccactgcactccagcctgggcgacagagcgagactccgtctcaaaaaaaaaaaaaaaaaagaaacaggtcagcagttgtttctttgtttctaaaacagagcgtggaatgggcgtacagctccgcacatcccagggcagtgaaatcccggttcacacagagccctcagcagcttattcgcaagcccaaacctggggacccccgttgtcctcaggcagtgaggtgggggccccccaacagagaggagcggcctgggggcacagaaccagcggctccccaggaaatcgccagcagtgaaaataagacaaccccaaactgttgcaaactgtgcttccgcttacgaagcactcctgagcggcagggcggatggggagagggcggctgcaggcgcgaggggcccggggacgcaggggtgcgggccttaccagggccctgtcctgtcgtgcagcaggctcctggggcagggaagacaccaggggcggccacttcttactgctgtctgacctcgagcaatgcggcctcacagcccccaccagggtgccggtgtcctctgggcccagcgcccccgaggctcatgcctgggtggggcgaaccaatcggtcctgctcctctggccactccacgcgagggaagtcccagcctcacaggcaggcgcacaccccggcagcatctctgacaaaggccctccagttccgagtctccaggtcccgccgctgcaagcctcacctgcccagccctcctctccagctccaactccaactcccaagaaccaccacggacacacagaacccgagccttgtctccctcaacgcctcctgactcaaaactccatcttccaacaggaaaacggctcggccgggggactgtgacccggagcaggcggcccagcctgtcgcgcagactcggggcctaaaacacttgttctctcagtccggagatcaaggacgatccgaggtaacctccctacctcggtgtcctccatgcaacctcgtcttagggcaccgggtacgttacctcgtgaggagccgagtccgcgggtcctggggttgagatgtggacgccctcagggctggcactctgccctggcggccacagtcatggaagtcccaacgcttctctcggctccgcaaccccagagggcggccacgaggagggcccgccacgcacgaccccagagggcggccaccaggagggcccgccacgcgcgaccccagagggcggccaccaggagggcccgccacggcgttgcggcagcagcccagaaggtgccctgcgcacggtccggacaggtgggatccgagttacctggccaagggggctgacgcagacacgtcgcgggacacagtgaagagtgtggtgcagagcggagggcgggagtctttggagaacaggtaggggcgtggggcacgcgcctcccacgcgcaggagccgtctaccgtggagggacacgggtggtcctgctggaggctcctctccgttagctgtctccatcgtctgattcttggatcccaggatggtgggatcatcagcaactgagatgaacccactgccccggccccctgagcccgcaggtccccacgccttgccagctgtgcccgagctggctgcaccccgggccaggcatccagcaaccttgagcagtggggtccggcttttcagaaggggccaggaacccgcgtggctgaggtgtgaccgaagcgtggggcagaggcgctgggccctggcgctttaacgctggtgtttctggttttaaatttcacgacccagtgacactgccaccctgctacctcgccagcagccctcctgggcttaacttcgggagagcagttttgctagccggccctgggtgccaagccctgcaggaggcgcagacccctggagacaggaccggactctgcagagcccgaccagcctcccagcttggccttttcctgacgcacgggcgcagaaggaaagccacagcaccggcttctctttgtaagtagtgtattttaaatagctttcaagatacacatattttttcctttaaaaaagtctgttggagcagttttgttcttgaattttgctggtcatcctcatggtcccgagcccccctactccgggtcgtggaggcggccgagggggaggctgggggcccacgtggcccgtcctggcggcacctgcagcactgggggagccgctgaaccccgtgcttcagcgctgggggagccgctgggccccgtcttccgccacaaaccatgcatggccgccacgtgagctcaaacgtccgtttatttcaaagcagtaataatttaaaattataaaaatctttccaccgctgaacgtttagagggtgaggttagacagaggacggggaggctggggacgccccagaggggaccatgtggcccacgccttcccaagccagggggccggtgggccgggcccgggtcctgccctggaacaggcgggacctgcagcgctgaccagccaagcgtggcgccgccggggcacccagtctgtgggtgccgtgtggcgctggctgagggtgggtgggaaaggccccgtgctttcccgacggccgacgtgggctcacgagttgcttgtggcgttctcgttgctgggcgagctggaggaggacgatgacgacgaggaggagaagctcaccccagtgaggccaggggggttcgtggccgtgttctgtcccgtgaggctttttcggcagacggggcagctgtcgtgctttgtggggacagaggcagggacgggagaaggggcaggttagaggcgggagggccgcggtcggggtgggggggcgggtgggcggggcactcacctgctccagccagggcacgatgcagccgtcgtggaacaggtggttgcagggcagctgccgcacacgctcacccagcgcgtagtcgtccttgcacacagggcactcgagcccggagcctgcgggagtgtgcagctgcggtcacagcgggcgtggggggcctgccgagccttcaagggcaggctactccacagcctcagccggaggccgcccctgagcccagcgaggggagaaaagccgtgtgtgtgtcccccgggctgccagaggggacctggacagaaccctctcctcccagcccaccttcagggaaatgctcgaggccgggtgcggtggctcacgcctgtcatcccagcactttgggaggccgaggcaggaggatcacctgaggtcaggagttcgagacctgcctgaccaacatggtgaaaccctgtctctactgaaaatacaagtatgagccaggcgtggcggcgggtgcctgtaattcccactactcgggaggctgagctctcatacctacgtgctcctcagtgacggggacggtggggagggcctggattttctctttatctgccggtggggggcctgtgttttcaaactgattgaggagctgaaagacaagaggcgagagtgccgggagctcctcgggggcccggcccggggctctgaaacgcgaggctgcaggacctgcaaaagcaccgaggccgcgtttgtcctgggccctgggccccttggagcccgcccggggtcggagatcactgtggagcccacgcggcccccccgctcctgggtcccctgacggtggaatgggggaatgggcggaggcccgcgctcctgggtccctgacagcggaatgggggggggggccgcgctcctgagtgccctgacggcggaatgggggggccgtgctccggctggtgggctactgtgagggtcgggtcctgccagtgacaaaatgctccaagggctcctcagcaaggctgagacgggtggcacttggaagcaggtcagggcgcgacctctcgggaagagggaccgcgtggcctcctgaccatgtgactgtgggcgagtcctccccgcggttttgctacaacgttccgcgtgaacacaggagaacccccaaagttgccaagactcagaaatggcaggaggaaggccggagctgccccctgtgcccgccagagcgtggaggctgtgcccgcatcccctttgacctttgtggggcttcgtgggtccaggcagtggggcagctcccaggggtgggcagcccagccctcccccagcaggcactctgggccgtggccacgctgtacctgtgtgatgatggcatccaggccgttggccccccaggcgtagtccatagggtttgagtgcaggactcccctggaggtggaaggtggggttcaagtggctgacgggcagctggggcaggtgcgtctatccaccccactcaccaggggcccaggctggggatggggacaggcaccccctcctactcaccagggaccctggctggggatggggacaggcacccccacccactcaccaggggcccaggctggggatgggaacaggcaccccctcctactcaccagggaccctggctggggatggggacaggcacccccacccactcaccaggggcccaggctggggatggggacaggcacccccacccactcaccaggggcccaggctggggatggggacaggcaccccctcctactcaccaggggcccaggctggggatggggacaggcaccccctcctactcaccagggaccctggctggggatggggacaggcacccccacccactcaccagggacccaggctggggatggggacaggcacccccacccactcaccaggggcccaggctggggatggtggcgggcgtgatgatgccgttgacgagctgctggatgatcctggaaaagagagcgccagtcacggggtgaggccgccccacgcacaggagaggcgccaggcctgccaggtccgtggtgagcaccaagggcagggccagcatcagcttctagattagcttctatttatttattttactatgagccagggtctcactctaatgccgaggcaggagagaagcagcttgatcttggttcactgcagccccaacctgctgggcttaagcgatcctcccgcctcagcctcccaagtagctgggaccacagaagaggtccaccactctcggctactttttttttttttttttttttttttgagacagagtttcactcttgttgcccaggctggagtgcaatggcacgacctcggctgactgcaacctctgcctcccgggttcaagtgattctcctgcctcagcctcctgagtagctgggattacaggcgcccaccgccatgcctggctaatttttgtattcttagtagagacggagtttcatcatattggtcaggctggtctcaaactcctgacctcagtgatctgcccgcctcggcctcccaaagtgctaggattacaggtgtgagccacctcacccagcctcagctactttttaaaaattagagatggggcctccctacattgctcaggctggtcttaaactcctgtcctcaagagatcctccctctttgacctcccagagaactgcaaatacagcactgagccaccgtgcctggcaaaattagccacttttaaagatgacatttccagcaggtgagacacacaaccataaaagcatcaaccgccaggagtagggccctgcgacggctcccccaggctctgttccaccaggagcagggcccagcgacggctcccccaggctctgttccaccaggaatggggccctgcgacggctcccccaggctccgttccaccaggagtggggccctgcgacggctcccccaggctccgttccaccaggagtggggccctgcgacggctcccccaggctctgttctgggcccaaggcctggacagcgtttgacgacacgcgtgtggacagcagtctccagagcacgtgggcctggcaggcacacggtgccccactctgtggtcaacccacacaccctgaaccggcatacttctgtctccgaagggccgtgtggggagtcacagggggctggagggcctggccgggcggcctctccagagagcctatggatgatgccacgtttccgtggaacccgtgctggattctaagcgccagaacttccgacctcaaggcgtggggccctcgcggccacccccggggccccctcacccttccagcgtggggacgccttcgtgccggccggtggcccgccgcgtggtgaggcgggcgcggggctgtcgggcgccgtaccggtgccgggacggatggtctctctcccgccggctctcagggtccctgccgtcgtcagcctgcgccccaggagggaacgtggggatctcgaagctgtcatcgaagatgccgaaagcaaactgtccgtagccctgcggcagcgtgaacaggtgctggtccacgtgctggggagaggaggggggcgtgacctcgggggctcaggcccgtgcagtctgctgggggcgctagggcacaaagacaaaggagaaagcaagacgggccctgctgggtgccgggtgggagggagacgcagacagggaggcaggaattgggcagagcctgccccgctggtgtgagatgcctcggtggaagtttcgctttcatccaagaaaccaaccaagcagcgtgggccgccccaatccctggcccgggcccctggagggaaaaatttcctccgccgtgcgggcagggagagccggggaggcgaggtggggacaggctggcgctcggggccccgagcaaggctgacacgatcgggaagcacgaggggcgggcgactcacctccaacggtggccggctctggtctgtgggagctgtggagggggcagaaccattttctgtgctcctggggagagagtgcaggtcagcagtgccggctaccctgtgcccccatgcgccaggcgctccctcccctcaaaagcctatgttgggagagcaggaattgtccttggcactgcttcccacccgccaccgccccagcatttggtgccgtaacccgctgctgcttccctcgccagtaaaccacgggtttctcgataaaccggtgcagaccccaacagcctcctaagcgtgagaatgtgggtagggcccccgtggccccttccccggagggcctgggtcaccagattagccgccgaggctgagggaggtgagcggctgcacaggttgccggcactcccctctggccccggcccggccatcacagaagagaacggcacgctgctgtctgcacagagaaaagtgctcccggagccacagacaccagggcctgacggccccacactcggcggggcggacgccagcacagcccacacccctacaacagctgaggcccggctggctcttccagcctcttcaacagggggctgcattacctggtctcttccggaagctcctcgataaaaccagactcgcatcttggacagatataatcctgcaggagagaacaggaggccgggtcacggtgacgccggcatcacctgcaaacccccccaagtgtgaggacagaggggctccggacccagcggtctctggctggccaggcacacgcaggccagggtggctcccaacccgtgggtcctggagggcggccgaggggacctggcctctgccagccacccgctgaccctttggtggctcccggcgatctgagcccctccgacctggccccaccgtgacgggcgtcaccagcgtcatcagcgccttggctgagcccctccgacctgccccaccgtgacgggcgtcaccagtgcctgggcacctcctcacacaggtggcaccactcggaggggtgccccaataccccacagtggcatttccaggacgctctggcagccccgcacacagcccgttcccctggctcgggggaggccacgtccacgctggccacacccctgcaagaccccatccccaggtccccctagagccaaggacaacacaaggccaacatggtgatgtcccagaggagacgtgaggaccctgcccagggacagccgtgggtgagtcccaaaaccacgttcacagttccccagcaccagcctcaagccacagctgtgccgagcaggacggatgccatcccctgtggatctcacactgcaacgggatccccagggctgaagggcctgctggagacactggctcacagggcggactcctcatggatggctgggcccctggtgatggcggagcgtgccgagcattcgtggggcctgggctgaaacgtgcatggtgcctcccggcctcaccaggggctgggcagatgccgacacacacttcccgcacagcctgcagaactggaaactggaagctaaatcaactgctctctatgaacgacccagtctcaagtgctccatcgcagcaacgtgaaaatggcctcacacggcacgtgtcatcacgccaggggctcacatgggggtcccaagaccacccccaggtaacacagacaaaaacaggagacaaggctcccaccgtgcatgggggagtgctgtgaggggagccaaggtcgaccccaggctctggggatgcaggttgcaccggggctgttcagtcttcgcaggggcaggggctgggacctctccagcaagcaagatcccggcctcacccactgactctggggagaagcgggggtctggcgtgcagtgcccaaggggagggccgacagctgggcccccgcccacaccacgccgtgcctgcctcacctgctcctgccactgaagcacaggctgggtggggagggactaaggccagggtgagcaaacgatgccagatgcacatgaacccaccgtgaggggagagtgaagaggcaccatctacaatatagaaaaagtgcggcccggctcctggtgaggccgggaggcaccacatgcgtttcagcccacgccccacgaattctcggcacgctccgccatcaccgggggcgcggtggctcaggcctgtaatcctggcacttcgggaggccgaggcgggcggatcatctgagatcaggagttggagaccagcctggccaacatggtgaaactctgtctctactaaaaatacaaaaattagccgggtgtggtggcgggcgcctgtaatcccagctacttgggaggctgaggcaggagaattgcttgagcccgggaggcggaggttgcagtgagctgagattgtgccattgcactgcagcctgggcgagggagcaagactccgtctcaaaaaaaaaaaaaaaaaaaaaaaaaaaaaaaaaaaaagtgctggccgggcgcggtgtctcatacctgtaatcctggcactttgggaggccgaggcaggcgaatcacctgaggccaggagttcgagaccagcctggacaacatggagaaaccccgtctctactaaaaatacaaatgttagccaggcgtggtggcacgtacctgtaatcccagctactcaggaggctgagacaggagaatcgcttgaacctaggaggcggaggctgcaacgagccgagatcatgacattgtaactccagcctgggcgacagagtgagactccgtatcgggaaaaaaaaaagtgcttacaactcaaaagaaagaaagaaagaaagaaaaaaaagcccaggccaggtgcagcagctcacacctgtgatcccagtactttgggaagccaaggtgggcagaccatttgaggtcaggagcttgagaccagcctagccaacatggccaaaccccatttctacaaaaaacaaattagctgggtatgctggggtgggtctgtagctccagctactaaggagggggaggagacaggcaggagcgggaggcaggaggcagaatggcttgagtccaggagatcgagaccgcagtgagctgtggtcccaccactgcgctagcctgggtgacagaaccagaccctgccaaaaaaaaaaagaaaaagagaaacagacaacgcaactaaaaacgggcaaagtcgggaggctgaggcaggagaacggcttgaacctgggaggcagagcttgcagtgagccgagatcgcgccactgcactctagcccgggcgacagagtgacactccatctcaaaaaaaaagaaaagtggggggggaaaggacgtgtacaggacatgcctccaaaaacacgctgggtaaacgcagccggccagccccagcgagatgccacttcccagggccagccaggacgagatgcaagaccccgtcaggcctgctgggagcccagaagtcccccagatggaactaccccatgacccacgagctagaactttcactccaggcgcagaccccagagaaacgaagacacctgcccaccaaatgttcacatggccagaactggcaggtgagagttcacggcagcacagttcatcatcgtcgtcggcagatgcaaacagctccagtgtccacccgcacctcagagcacgactcaaccatggaaaggggcaaggcccagaccaggccacggcgggggggaggggggattgcatcttgaggacatcacgtccagtgagagatgccagacacagaagaccacgcagcgtgtgatcccacgtctatgaaatgtccaggacaggccgagccacagagacagagaggggatgtgtgagcaccagggcctgggggaggggacggggagtgacggctggcagggctgaggtgggttctttttgcagctgtgagaatgctgtggaattagactgtggtggtggttgcacaactttatgaatatactacaaacgtttcaccaggtgaattatatggtgtgtgaaaatactgagataaagctattaaaataaatgggccaggcgcctgtggtcccagctgctagggaggctgaggtgccaggatcgcttgaacctgggaggtggaggctgcagtgagccaagattgcagcaacagagtgaggcagcatctcaaaaacaaaaacaaaaaaaagaaagaaacaaagaaaaaaagggctgggcacagtggctcacacctgtaatcctagcactttgggaggccaaagtgggcagatcacttgaggttaggagttcgagaccagccaacatagggaaataccgtctctactaaaaatacaaaaattagctgggcacggtggtgggtgcctgtaatcccagctactcaggagctgaggcacgagaatcgcttaaacccggcaggcagaggttgcagtgagccgagatcataccactgcactccagcctgggccacagagtgagaccgtgtcagaaaaagaaaaagaaaaagggaaaggggaaggggaagcagccaacgaccaccactgtggccctgagcttagtgtgggagcagtgtggctctgccacagtggccgtgacaactctccccaggcgtcggttcttggggtgtgtttggggtgtcgggattgggacgccccacgtaaacacgctgagacttcacagtcaaatctgaacccctggtttctgccggtgtcgggtctatcggggctcctctgggctcaggggttgccgccgtccgcccgccagctgaccgggagcccagggccgctccatcgcctgggtgggtctctgggaatggaggggtagctcagggctcaggctctccctgcatggtgactccccaggctagcaccacccagtggacctggaacagctgcactggcccccactgagggcaggacgtaagtcagctgtgcagctgccccgaccaccatctctcctgctgggtgcatccacaaggtcaggcagccccagaagggcctgagggagaagctgtctccctctgaggaccctggcttgccagccccagccccgaatctctcctggacaagcacgaggccctgcacacgcccacgtggcctggcacagcgctcggccgctctggtccccatgtgccgagctcagcccctctgtgcatcactggctttctgtcgggctcccgggttcccgtctcagtccagggcacaacgcatgctcccgccacccgcactgccggctcacgacagcccgacctggccacatacacactcatctgccccagccctggcctcctcttggcccccgctgtcctgcccgcagcggccgtggggcctggtgccacagcactgtccagaaccctctctctgcagcacccactccagcgtcggggcctgtgcacgtcggccctgctgctggaacgcccaccctaggggtttcaaaggtcacctctctgctccaagcctctgccctgtcacagaggacagcctggacactcactcatatctgaaatccgggtgccatcgaggacgccaagggctgcgacccaactcctgcgtattgtcagggctctgggctgtctctcaggcccccggccagcccctccagggccaccgaaggccggaaccgaggctctggtcacgaaggcaagtgacaggtggatcccggatatccagggtggaggttgagcctctgctggccgacggtgggaggggctggacctgggggtctccagccgccctcctcctccaagggcacagccaagagaccgcttggtctcgtattaaatcggggcagctgcaggtagaaacgcctgggcaagggggcctggtgaaggagctgccccaccttctccgggggcagcacgcactgggggcccccacagaggccccattggagcctctggccctagcagaagacggtgaatccattcacctctccgtcagagaacagatgcaggaggtacgatcacccggcatcatcaccatagcaacagctggccaggcagccagggtaggggggaccctgccagtgccgggctccacccatgcacccctgcagcgtgatggcctcatccccgggtgggacctggcagggcagcagaggccccttcatccacggggcctgcacggggcgcatgtcctgagggcccagggccaggcgcatggaggggagtgggctggcgacctacaggccccagatgactgacagtgaccagggcaggcaggcccctggtgacagtgactcggcccctgtgggtggcagggccctcgggaagctgtgcacatcaggagaccccagggagagtcatggtgcagtgctcggcctcggtaggagcccccgtgctggctactgttttcctaaagggtgcccaaagcttcccggctgatccacagtgtgtgggccccgcagccccagaggcacgggcacgtgcggcgcctgcacccctttcttcccgccctcagcagctgccaccacatcccacattcacaccgtctgtccctgggccccacgcaccacacactcccaagacaagctggatggacgaggcgtgagcgaagccactgcctcagcccaggctggggccccgcctcacaccccagggcgtgcctcggcccaggccccgaactctgccttcttcttcccaggtggcttcaggcaccaccactagggactggaaccccacaggtgcccatccgtgccagtgccaggggtgctacggctcgcccgaggctcagaggaaggtcctcatggtggcagagttctaagtgggaggaaattcagcaccggcatctgcccgaggcagaccccagcgccagccggccagagagggcagccgacatccacaggttcccggggtattgctggtgcccgatcacaacgccaggctccatgttcacagggtgctgcagggagcccgttccggagaacccagctgtgcagagccgctccagggtgctggccggacgcttgagaggcaggggcaggctgtcactgtcacggtatctggcacaaccgcagacacacagagcaagcagcggccagagacagacccaggccgtcttctgaagactcgggccaggccgccgcagggaccaggagaagacagggtgggccggggggcagctggggagacttcccgcctggccccatcagtgacactggccgtagcagccctcacttcctggtggctccccgcccacgccggctcttccccgccaccgtgggcggcagggcccagcacccccaccgtcctctcaccgccacttggggacactgcggaggttgcaggcgttcgggggtggggggtcggcaggcagagctggaaccaccctaggaaccacccagagacggggaggtcaggggcaaggacggcacgcagggccacctccctgcgcccgcctggttcctgggggctcagtgccctcagcagctctcgcccacaccctacagtcacagctccagtcagtgcctcctcagcaggctcgagtctgggtctgcgcagccgcctgtggcctgagctccagctggcctgtctggttcctgccgccacacgccccactctggctgacgctccctttgctgctcagacacccagacaccctcgtcatcgccttttttttttttttttggaaggagtcttgctctgtcacccaggctggactgcagtggcacaatctcggctcactgcaacctccgccttccaggttcaagcaattctcccgcctcagcctcctaagtcactgggactacaggtgcctgccaccacgcctggccaatcttttgtatttttagtagggatggggttttaccatgttagccaggctggtctcgaactcctgacctcaggtgatccgtccacctcagcctcccaaagcgatgggaccacaggcgtgagccaccgcgctcggcctcatcacagcctttcatgggggcaactgctgcccctgtgccgtcgtcgcctgagcccccgaccgcaagtgtggctccccgctcaggacaccctcacgagtcaccaggagagcggccaggtgccggccactctgcacacacgtgcccaccagatgccacggggagcgaatcgcatcactaaacccacttggcaggtgaggagactgaggccaaggctgcccagcagagaatgacccagctgcgcggggcctcagcctgatcccagagcccaggacagcaaaggaggcccggaacggcccagctgcctgggagaagccctcgtgggcaggcacacagcccatggcagccagtcccccctgcgtcagaggcaggcaggagcttcccgacagccagcccaggtgtctcagcagcagcagtgccgcccctgactcagccgccgggcaagctccccagcggcagagacgccccgtttcgagggcactggttgtggctggggactttccccattgccagatacggagcagccgtccctccccagaacaaacgccaggtgtgcccatttcccagcataaaaaattcgtttttgagacagcgtcttgcttgtcacccaggctggagtgcactggcaccatcacggctcaccgcagcctccacctcccaggctcaagcgctcctcccaccacctcagcccccgccagtagctgggactccaggagtgcaacaacacaccccactaattgttttagtcttctgtagagacagggtcctgccacgtacggagaagttctgacactgccatgctgtctacgggcgccttgttgcgtcctgctccaaaggcacaagcagatgcccttgggatcacccgcggggtggacacgggcaggcccccgcagccctctctgcagttatttgctcttaaggaatctaccaacgtccatgattaaatatttgtcaatcactgttccatgctggctccctggccagcctgtaaattctgtgagggcaaagaccacagcggcctgtcaccacagagttcctttcactacaggaaggccctccccaggcccagtgacagtcggaggaggtcaaggtcctccgtgtccaaggccacggggcgaggaagtggctccaccacaccaggatccagtcctgtgcgggctctaggagcagctaaatgtgcagccgagtcaaggcagtgtcggccccccacagccaccactccaggcttcccaggggcttcccaggcctgtcccagggctcaaggggctgcaaggggctgccctgcaactcacccaggctggcgggctgtcaggcaaccagcctctcctgccacggccagtggggacagaaagctggaagaggcaagagcgagacccctgggagacagaggagtaaggcaaggctcagtctcagctccccaaccttcgccccacacccgagatttcactttatttgttcctcctgctggggaggggaagccctgtggcttcagtagagaggaaaccacacctctctctttccactcctgggcctggccccgctctcccgccatgccccaactctagcactcgctcctcctctgtgacccagagacaggcggcttctcctgactccctccagccccttcctgggtctctactcccggggaactgcactgcttctggggggcttggacttctcttacgggtcaaagcgtagcaacagccgggcggctacgtacacagcacagtaaatcctcaatgcctgcagcctcttcccctgggcacagggtggggagtccagacccctccacctcctgcggctgctcccctcaagctggccaagcggctcccgactgagccggctctgccactttcccgctgagccaccacgcgcctcagtttccccatctataaagcacgggtggctcgactaaatcaccactttgcacgtcagcctggcgaagggcaacacgggttaaaaatgcagaccaccgccgggcacggtggctcacacctgtaatcccagcgttttgggaggctgagccagaagaatcgcttgagcccaggagttcaagaccagcctgggcaacacagggagaccccattcctaaaaataatattagaaatgcagactgctgagcgcattccacacctactgactccgaaaccctggaaaaggggcctggaaatagcaccttcaacgagcgctgctcccacctcccccaaggtgacatcaggtccgcgtgggaaacactgccctaaacgagcaggaagtagcactcggcacgcccaggcccagggtcctcttcggtgaggggcggctgtaaacacctggaggaagggtgggctgcgcagccaagccccgggaggggaggaacgcaggctctgctcacaaagccccgccggcgggccgcggtcggaccccgggacagtgcctggggcgttccgggcctgggcctgcctccaaggcggcggccagggctccacgaggcgagcctgcagcgaggcgccggcgcccccaaccacgcgctcggcgggggtcccctggcgttattctcggggtccgagccccgccaggcccagcccctgccccgcgccgcgccaccgggcaataccctctctctgctcgccgggcctcagtttctccgtttgcaaaaccaggctcaccgggcttagggatcccacctgggatcctcgcggcctctcgggtcgggaacgccgcggatgtggggtcacccggccgcgatcccgctgcgccgctccggccaggccctgcctcccgcccgggcctcagtctcccgcatgtacaggacggggttcgcgcgcgcaccgcccgggctccccgcggattcagcctgggccggcgctgccccgagcctcagttttcccgtcgtggtcagctcgcgcaagaggcgggcgcaagcgacccccaccccggccccggccttgcctcaggcctgcggcgcagaccctgccgcccgccgccccggcccgggcctcaccggcaggcgcgggacgatctccacggagcagcagtggcagaagtaccgtccgggatgcggcgacgcctcggccatggccgccgccacctactccgcgccgcccgccccccgcgcggcacccgccgccggccgtttgctgctccctcgccggccgacgcgcccgcgcacgctcacgcacggcacgcacggcacgcggggcggagcgggggcgcgggagcggcgaaagctgcgtactcggcgggcagcggcccgggcgacggtggccgctgagagacaaactaggcccggccgttgggcggggctccaagcgggggcggggcttccggcgggggcggggccaaagcaggcggcggaagagacgagaagcggggcgtgcgcggggcggggccgaggccctcctcccctcccgaagctgcccaggccttcgtgtccctcagtgcttccctacctcatcgccgtctcccctcacggtacttcagcccactgtccccaccgttcctggggctcgccaggcgccctctcccccgcccgctgcccggtgcagcgctctcccgacgcccgcgtggctttcttccaggtctttgctcaaatgtcagcttacaaggtcttctctgctgccctcctgctccgtggcactgattccctcccgatgcactgtcaggtcagctgcgcagcaaagggatttttggacccgcagcagcgcctgacacacagcaggcattccctcagcgctgcggaatacaggcagacccggggctcagggcgctgtctgggcctcactgggacccgtggggtcagacagaggctgaggtctgtgggttgtggccttgtttccaagatgctccacgggctgacggcccaggcgcctctcgggtgcggagaaggcaggaaacctaacccctgcttccaaatttaatcagtagaaacggtatcatcacccagcacaggccaggatcatttctgaggttagttctggcccaatcatgcatgcatttcttttttctttttttttttgagacggagtctcactctgtcacccaggctggggtgcaatggcccgatctcggctcactgcaacctccgcctgccgagggttcaagcgattctcccgcctcagcctctcgagtagctaggactagaggcacccgccaccacaccggctaatttttgtatttttagtagaaacggggtttcactatatttggccaggctggtcttgaactcctgacctcgtgatccgcccgcctcggcctcccaaagtgctgggattacaggcatgagccaccgcgcccggcctcatgcgtgtatttctttcttcactcaacactcattgagcaactactgcacaccagaccctatgctgaatgcacgcagatacccccagtcccatgagattggacaggagcgtggaactcaagggtgactctggctctgcctggggaaagagagagagggcttccgaggggtaaggacattggaaccagggctgagggatgaataggatttggttggagttggacttcctgcaaaatgaggcattggagcgagactgttgaggaattaagagttggagcctgtgcatttagattttttgtttgtttgtttgttttttagagatggagtctggctctgttgcccaggctgcagtgcaatggcgcaatctcggttcactgtaacctccgcctcccgggttcaagtgattctcctgcctcaggctcccgagttgctgggattacaggctgggcaccaccacgcccgcctaatttttgtatttttagtagacggggtttcactatgttggccaggctggtctcaaactcctgacctcaggtgatccgcccgcctcggcctgccatagtgctgggattacaggcgtaagccaccgcgcccggcctgcatttagggttttgaatgtccagaggttggggacaggggcttcagcctccttccagtcgtctttgcagcagcgcgaatccagtcattcctgctctgaccaccagagagcgcacgggccccgtccctgggaatccaggaaaaccccaggctggggaggggcgaggcttgccagacgcagcccctgcaccagccttcacgctccgcaagtgcaggaggagcagcaggcctggttcaaacgacgccaaaccacgaactggctgtgtgtccctaggcaagtggcctaacctctgagaaggcggcagaacctgacggttttccgttggctcggagcagacatgaggaccgctggcacctcctcagccctctctgtgctctgctgcctgccccgagtcacctgcccctcgctgacccctccccagcctcactggcccccttgggtgggctaagcaggttcccacctctgggccttgcaaggctgtgcccttccccaagtcccctctccttcccctgcttttttttttttttttttttttttttgagatggagtctcactctgttgcccaggctggagtgcaatggtgcgatctcagctcactgcaacctccgcctccaggggtcaagcgattctcctgcctcagcctcccgagtagctgggatcacaggcatgcgccaccacgcccggctaatttttgtatttttagtagagctggggtttcgccatgttggccaggctggtctcgaactcctgacctcaggtgatccgcccacctcggcgtcccaaagtgctgggatgacaggcgtgagccaccgcgcccggccctttcccctggtttttaggaggctgccccatccaccactgcaccccacttctcagagccccctttccatcccccacagccatcctcacatctgtgggttattaatggcgtctccccatatgtgaggccaatacccagcgcaccagtaggtgttcagtagattcccaaatgcaccaacagttgccgagtgtctactgtgtgctgggctcaagcaggtgctggaaacacagtgggaatgagaaggaacgtagggattttgtatcaaactaagcagggcgaggtggctcacgcctgagaccaggagttcaaaaccatcctgagcaacatagtgagaccctgtctctacaaaaatagaattaggccggggacagtggctcatgcctgtaatcccagcaccttgagaggctgaggcaggaggatcacttgagtccaggagttgaagaccagcctgggctacatggtgaaaccgtgtctctactaaaaatacaaaaattagccaggtgtggtggcgggcacctgtgatcccacctactcaggaggctgagacagaaggatcacttgagcaggaggcagaggttgcagtgagctgagatcggaccactgcactccagcctgggccacagatggagaccccatcttttttgttttgttttgttttgttttgttttgtttgagatgggtctccctctgccgcccaggctggagtgcagtggcatgatctgggctcactgcaaattctgcctcctaggatcaagcgattatcctggctcagcctcccaagtagctgggattacaggcatgtgccaccacgcccggctaatttttgtccttctagtagagacggagtttctccatgttaagtaggctggtctccaactcctgacctcaggtgatccgcccacctcagcctcccaaagtgctgggatcacaggcgtgaggctaatcgttttaaatttttattttgtagagataggatctggctatgttgcccagagtgatctccaactcctgggctcacgggatcctcccaccttggcctcccaaagtgtggggatcacaggtgtgagccagagtgcccggccacccctttatcccaaacacaccaaaaagcaggctgctcttccctgaaggcagtagcacattgatcaaatcggccagtgggcactgacactgctgcacacaaatgcacacacttgcaccctgccccaggccccaccggccaccctggttccacagacggcaccgtttctcccatttcctctcaccagggacctcgacaggtgtgggcttggttccgtgagctctcttagcccctttttcaattcaggatcccgtccccgtgaaccctgggggcctcggcaaacatgagacgagaggactcctaaaggaatgacacgcgccactccctccggggcagagaggtgtgttgacagctcattctcacgtcccaggcagaccaagcccaggtggaccacgtcccaggcagaccaagcccaggtggaccacgtcccaggcagaccaagcccaggcggaccacgtcccaggcggaccacgtcccaggcggaccacgtcccaggcggaccaagcccaggcggaccacgtcccaggcggaccacgtcccaggcggaccaagcccaggtggaccacgtcccaggcggaccacgtcccaggcggaccaagcccaggtggaccacgtcccaggcggaccatgtcccaggcagaccacgtcccaggcagaccaagcccaggcggaccacgtcccaggcagaccacgtcccaggcggaccaagcccaggtggaccacgtcccaggcagaccaagcccaggcagaccacgtcccaggtagacctagtggttgtgtattcacttctcccaacccccctgggaagaaataactgcagctggccccattgcaccaatgaggaaactgaggcccagggaggaagccgattgcctgaggcggcagctttgggactggactgtggctgcctcctgaggaaggaaacagttcctccctccaccctcatcctggcaggggttgggccaccgttgcttcatcaagtgtcgtggagcctccgctctgtgccaggagcggggcctgtgccacaaacgtctgctgaaaccagccatccacccaacagtatcgagcaccatgatcggaagagtaaaggccccaaactgggccaggggcggtggctcattcccgtaatcccagcactttggaaggctgaggcgggtggatcatttgaggtcaggagttcgaggctagtctggccaaaatggtgaaacccatctctactaacaaaaaaaaaaaaaaaaaaaaaaaaatggccgggtgcagtggctcatgcctgtaatcccagcactttggaaggccgaggtgggtggatcatctgaagttgggacttcgagaccagcctgaccaacatggagaaaccctgtctctactaaaaatacaaagttaaccaggcatggtagcaggcatctgtaatcccagctactcgggaggctgaggcaggggaatcgcttgaatctgggaggcagaagttgcagtgagccaagatcttgccatttcactcctgcctaggcaacaagagcaaaactccatcttgttaaaaaaaaaaaactagccgggcatggtggtgcctgcctgtaatcccaggtactcgggaggctgaggcatgaaaatcacttgaacccgggagcagaggttgcagtaagctgagattgcaccactccactccagcctgagagacagagtgagtgagagacttcacctcaaaataaataaataaagtccccaaacacacttgattttagcccagcaagactcatgtctgttgcgggaagtcagggaccccgaacggagggaccgcctggagctgtggcagaggaacataaattgtgaagatttcattttaatatggacatttatcagttcccaaattaatacttttataatttcttacgcctgtcttactctcatctcttaatcctgttatcttcgtaagctgaggatgtatgtcacctcaggaccaccgtgataattgtgttaactgtacaaattgattgtaaaacgtgtgtttgaacaatatgaaatcagtgcaccttgagaaaaaacagaataacagcgattttagggaacaagggaagacaaccataaggtctgactgcctgcagggtcaggcaaaaaaagccatatttttcttcttgcagagagcctataaaaggacatgcaagtagggaggatatcgctaaattcttttcctagcaagcaatattaatattaataccctgggaaaggaatgcattcctggggagaggtctataaacagctgctctgggaatgtctgtcttacgtggttgagataaggactgagatacgccctgatctcctgcagtaccctcaggcttactacggtggggaaaaactccaccctggtgaatttgtggtcagacgtttccctattttttgttcaagatgtttatcaagataatacgtgcaccgctgaacatggacccttatcagtagttctgtgttgccttttctcctgttccctcagaagcaagtgatctttgttctgttttttgccctttgaagcatgagctctactccatgttctcacaccccctcccctcttgaaacccttaataaaaaacttgctggtttaaggctcagggggcagcacgatcctaccgacatgcgacgtcaccccccggcggcccagctgtaaaattcctctctttgtactcttcctctttatttctcagccagccgacacttatggaaaatagaaagaatttatattgaaatatggggggaatgggtccccccgatacatgtcagatttcttttatttatttatttatttatttatttatttatttattgagatggagtctcactctgtcgcccaggctggagtgcagtggtgccatctcggctcactgcaagctccgcctcccgggttcacgccattctcctgcctcagcctcccgagtagctgggactacaggcgcccgccaccatgcccggctaattttttgcatttttagtagagacggggtttcaccgtgttagccaggatggtcacgatctcctgacctcgtgatccacccgcctccacctcccgaagtgctgggattacaggcgtgagccacctcacctggccttatttatttattttttttgagacgggggtctcgctctgttgtccaggctggagtgcagtggtgcgaactcggctcaccaaaacctctgccctccaggttcgagcaattctcctgcctgagcctcctgagtggctgggactacaggcacccggcaccacacccagctaatttttgtatttttaatagagatggggtttcaccatgttggccagactggtctcaaactcctgaccttaagtgatctgcctacctcagcctcccaaagtgcaggaattacaggcgtgagccactgcgcccagctgttttgttttttgagatgaagtctcactgtcacccaggctggagtgcagtggcgcgatcttggctcactgcagcctccgcttcctgggttcaagtgattctcctgcttcagcttcccgagtagctgggattacaggagtgtgccacctcgcccggctaattttttttgtatttttagtagagacggggtttcaccatgttggccaggctggtctcaaactcctgacctcaaatgatctgcccgccgcagcctcccaaagtgctgggattacagatgtgagccgtggcacttggccagtggggttgctttagggcccagctcacaccgcacccggctgatggggttgttttagggcccagctcacttcccagtgttcccacaccgcccaccaggccaggccttcaggcctgagccatgttatcagcatcacaggctccggagtccagcaagtctttgcctcctggagcccaggggttggcaagttctagctcagaggctgcagacaatagacagtaagccaatgccaagtatctttgggctcaggaaggtgggaccgggtgtccctgactgttctgtaccaagccacaacccgcttcccatcctggaggccgaaggtggtaccgcagggtgagctccctagagccccacagaacacgctgctctgggtcctaaaggctctccttgcatgaatgcaaacctgctgactacaaagatggttattattatcagctccaaggtacagaaactcggtttaaactggcttcatctccctgcggaggaggagttcaggcacagctggatccagggacctccaatgtcactgggaattgttgctgtcccctttggctctgtggcccacggggctggcctctccctagccatcagaaagagccacctgcaatttcaggctcacacctctccagccccagcaggaagcaggtgtccctgtccctctcccagcaaaattccagggccgttggccaggcgtggtggctcacacctgtaatccccgcactttgggaggccgaggccggcggatcatgaggtcaggagttcgagaccagcctggccaatatggtgaaaccctgtctctactaaaaatacaaaaattagccaggcgtggtggtgggcgcctatagtcccagctgctcgggaggctgaggcaggagaatcgcttgaacctgggaggcagaggttgcagtgagctgagatcacgccactgcactccagcctgggcaacagagcaagactccatcttaaaaaaaaaaaaaaattccaggactgactcgtcctggtggttttgtgttttttttgagacagagtctcactctgtcacccgggctggagtgcagtagtgggagcagaaagggggaaccagccccaggctggccctcgtcgtgtggtccatgggaggcacaggggtcctggaagcttctgaacctggtgctgaccctagtcctgactctgcaggtctgtgtgactccaagaaaatcacttcccaccctccaacctcatccctataaatggggcgcctgcctcacagcctcccagcaagcagcaaaggggactcaccatggtcccgttctgcacgagcacccattgactgggtaattaacaggaatctatgcacgccatggccctactgtgcgcctggcactgtccacatcccacctggaacctctaacactggggtctgtgcccatgttacagataagaaaacaggcataggctgggcacggtggttcacgcctgtaatcccagcaatttgggaggccaaggcagctggatcgccagaggtcaggagttcgagaccagcctggccaacatggtgaaacccatctctactaaaaatacaaaaaattagctgggtctgctggtgcatgcctgtaattccagctactcaggaggctgaggcaagagaattgcttaaacccgggaggcagaggttgcagtgagccgagattgcgccactgcactccagccttggcaacaagagcgaaactctgtctcaaaaaaaaaaaaaaagaaagaaaaagaaaacaggcctagaagggtcccagggcctggcacacagtgggcacccacggctgctataacaaatttgcacaaactgcctggcttaaagcaacacacgggctgggcgcagtgtctcatgcctgtaatcccagcactttgtgaggccaagatgggcagatcacctgaggtcaggagtttgagaccagcctgaccaacatggcaaaatcccgtcactgcaaaaaaaaaaaaaaaaagtagccgggtgtggtgggaggcgcctgtaatcccacttagtctggaggctgaggttgcagtgagccgagatcgcacctctgcactccagcctggacaacagagtgaggccctgtctcaaaaaaataaaaatggccaggcatggtggctcacacctgtaaccccagcactttgggaggccaaggcgggtgaatcactgaggtcaggagttcaagaccagcctggccaacatggcgaaaccgcgtctctactaagaatacaaaaattagccagttgtggtggcaggtgcctacaatcccagctactcgtgaggctgacgcagaaggattgcttgaacccgggggcggaggttgcagtgagccgagatcgcgccattgcactccagcctaagcaacagaacgagactacgtctcaaaaaaaaaaaaaaaaaagttccacacgggtctggctgggagaagatcgaggtgttggcagagctgcattccttctggcagctccaggagagaatctgttccgcgcctttccaggctcctagaggccgcccacattccctggcttgagcccccttcctccatctccaaatcccgcaatggcagccaagtccttctcttatcctgtctctaaccatagagggcaggcgtctccttttttttttttttttttttgagacagagtctcgctctgtcacccaggctgcagtgcagtggcacgatctcgggtcacttcaacctctgcctcccaggttcaagtgattctcctgcctcagcctcccaagtagctgggattacaggtgcacaataccaggcccacctaatttttttgtatttttagtagagacggggttttaccatgttggccaggctagtctcgaactcctgacttcaagtgatcctcctgcctcggcctcccaaagtgctgggattacaggcgcacaccaccaggcccacctaatttttttgtatttttagtagagacagggttttaccatgttggccaggctagtctcgaactcctgacctcaagtgatctgcctgcctcggcctcctaatgtgttggaggttcacaggtgtgaacctaatgtgttggtggttcacaggtgtgaaccaccgcgcccggccaggcatctcctcttctacggacccttccaggacagtgggccatccgtataacccaggatgaacccctgtgtgaaagccctcaactcagtcccatctgcagagcccctttggccagggagggtgggacacccacgggttctagggatgagggccccatggtctctgggaccgccgttctgctgaccaccccccactgctctccccctcactcacagcacaagcgtctgtttccagcgcacacccctgccgctccgtctgacgttcgagtctcaacctcaacgtctctttcctctgggaagccttcctcagtctcccccaggcccgggtcaggcctggggcacctttgccatctgggcatcctccgccacagaacaacactggattgtcactgtctgtttacctgtcaggatgtacctggagggagacagaagcctggggggtgagcagaggccacgaggagccacggtgggtgtctgagccagggagaagtgttatggcagctggggtaggaagtgggccgcaggggccaggctgcgggctggaagtcctaggatgagcctcgggcctggatagggtggggagaggggcagagccgggagaggggaggtcatcactggggtctcaggaggaggcggcgctctggaaagggtcagtgacctgttagaggtcaccctgcacagagcctctgggttagggaagacagagccgggagcaggaggccactggcagctggcctcggtttccccggagagggccggaacccacgccagccagacaatgaccctttgattcgcacagcccaggccggagtggccaagccacggcggggtcaggtcttggccaaggtcacactgtccagcccccgcacatcctcagtgagaacacagggtcccatccctgccccactccccaatcccgggagagtcccgggggaatgccagaggccaaggccaggtcgagacggcggggtgtcccccgtcagtgagaacacagggtcctgtgcctgccccactccccaagccggggagattcccgggggaaatgccagaggccaaggccaggtcgagacggcggggtgtcccccctcagtgagaacacagggtcccgtccctgccctgctccccaagccggggagattcccgggggaaatgccagaggccaaggccaggtcgagacggcggggtgtcccccctcagtgagaatacagggtcccgtccctgccctgctccccaagccggggagattcccgggggaaatgccagaggccaaggccaggtcaagacggcggggtgtcccccctcagtgccactaaggcagaacttggcccctggccactggctgctgggggacacaggctgggcagctaaggtggaggaaagggtacaggtgtgtcttctgtgggcacagatctcactcaggccagagaaggggctgtgccgtggggctgctggacacgtccgtttccacctgcggggtgggcaatgccggcacagcgagtggccagacacaggcatgcccagcagacacccaaccgctctccaccacctcaaccttctgtattttcctgaaagcatttaccactccttgaagttatagattaatttgtctctgcattttgttgtccaaaccaggagctcggtgagggtgtgatggggtctgccttggtcaccgtggcaccccagcaccccgcagggtccctctggccaaaagagatgttcactgatgccctagaagcaggaacagaggggctcccctgcgctcgccaagggcgcctgacaaatctggaggcccccatgacagaatcagctccagagtaggaaatgtgtctggctgcacgaaagccccctcgggcgcagcgcctccaggcccacgcagatgtcgctgtcatacattgttggaaacgcctctgctggaaacagtgtttgctgaatcttggagggagaggaaaaaacctagtaaacattcttgttgaggtgatctgggggaatgtctgcaaaggcttggagggctgatggggcagagctgcccaggggcccaggacaaaggccaggcgtgcgcgcgcacacacacacacacacacacacacacacgcagtggcctccctgggggccgtggctgggcgaggcctgctgttgtccgagatgctggaaggagctgtgtctctgggtctgtcccggccgcaccccgttctgtcccacacccaaccactccccacccacaggccggctccagcggccaggtggacgggtgcgcggcccgcgctgtgagcagggaaccatatccagctgaggttttgggtgtgtggggcgggtcgggaacaaggaggccgggttggggggctcagaccacacttggaccatgaaagtgaccacatgcaaatcacagaaacgggatgcagggatccacagacgtgctcctcttgggtccccgttacctcaccgccacccctgaaactgaagacccccaaacccactttaattcctggagacggcccctcgatccacccaaaaggctgccaccacctcgaacccacacccctgtcccggttccgccctgggtccagccacatctccccaaatgcattctctggctccggaaggggacccgggcgctcgcccccaactgccccccgcagcggccgggcccggcgcctgcccaccccgcgcgggacacggcctcgcccccgccactcccgcgccgcgccccgccccgcgccccgccccgcccgcggcccgcgggacctttatagggagcgccggccgcgcgctgggaagtcggtgccgctgccgtctctgcgttcgccatgcgtcccggggcgccagggccactctggcctctgccctggggggccctggcttgggccgtgggcttcgtgagctccatgggctcggggaaccccgcgcccggtgagtggggcggccagaggggcgggcggggcgggccacccacgtggggctgcgcggaatgcggccggggggacgtcggggggcgcggcggcggcggcgggggcgagggcggtgtccggcgcaagctggagccgggaaggtctgaaggagggtcaccaagaggtcagcagagcagaggtttctaatcacaatgaccgctgacatttattgagcgcttagtgtctacctctcccctccctgaacctgtgccatcccgatagtgccggagctctcttcatctccgtcttccagatggggaaactgaggctcagggtcacacagcctgtagcaggcaaagccagggttctagccgcgaccgtccgggtcggtcctggtgccgagaggtagtgctgggtgtcgggagccaggccctccagctggggctgagagctttcccgggtcctgggtagacggggcatggagtctcacacctgggacttgccgggaggtgccaggcaggagacggccccactcctggcctcagtttcccctcctatgatgggtgccaaggtgctgcgttccacaagctggtccctggcagtgtctgtgaaccagcaagcgctctgggatgggggctgtggccgttcctgcccccagggacgggggaagaaatggggggctctctggctccccaccccccatccctgcagccccaccccaccccagccctgcgccaaagggagagcagagccccctccccgaaggccacgtccctggggagacagtgagctcatgcaaggggaatgttcccaagttggagtgagtaagaggcgggccaggcggtgggggggctgccaggcgcggggctccgcgtgccctcgccctcgggtgctgtctagacagagggcagaggcgggagaagcggctccagggcctgctgaccctgacatgcccagtgcctggtgtttggtggtgtttgaggggttgggcagggtgccagcccctggcctgggggcttggagggtacgggaagggacctcctggggtgggtgggggttggtggtgaggctgtgggggggggcacgtggagctcagaggggaggagacatttccagggttctggagccagggtggggacacccatgtggttttctgccccttcttcctgggtgggggtagatcattccgtgcgtaactactcagcaccacctgcatgcatctgtgggcgggccagaagctgggtgtcaggagtggcccaggagagcaccccgttccccggcccgcaggtggtgtttgctggctccagcagggccaggaggccacctgcagcctggtgctccagactgatgtcacccgggccgagtgctgtgcctccggcaacattgacaccgcctggtccaacctcacccacccggggaacaagatcaacctcctcggcttcttgggccttgtccactgccttccctgcaaaggtgagacctcaggccagaagcagggcagacgtctcagctcaggaccagccacaaacagtcatggtggtcgagggccgaacgtccagggactgagcccgtcacaggggtatgtaggaggctgcagggggatcccagcctcagagagggactggggggacttcccggttcccaggctccagcctcttgcagctcaggactcaggaagagaccacgtggctccagcctttgctggggctgagctctctgcctgggtggctcttcccacctggtcgataaatgtctggcttgcacctagctcctgggaaggtgggtttgccattctggcctgtgaccccaaatgtccacaccagggaccttcactgcagactccagggtctgcggtggggttacagctgcatgtttaacaagcatttgcctcgggaccctgttttgagaggatgcctcccacatcagactaggggctcttggttggcgagtggcacagaacgaatgaataagattctccgcactggaggatgatggttttttttttttttttttttttttttcctgagatggagcctcgctctgtcacccaggctggagtgcagtggtgcgattttggctcactgcaacttcggcctccgaggttcaggtgattctctttcctcggcctccccaggggctgggactgcaggcgcgcgccaccacacctggctaatttttatgtttttggtagagacagggtttcaccacattggccaggctggtctcaaactcctgacctcaagtgatctgccagccttggcctcccaaagtgctgggattacaggcgtgagccaccatgcctggcctgttggggcacatcttgaaggaggtgggcattagagctggggtgttgggggatgtctaggagtttgccagatggggccggtatgggagagtggatcaggagagaacatggcttgaggttaggtcctggtgggtggggtcaggcagaggagccaaggggaggctgaagctgagggctgcagacccgaaggccaggctgaggaactctgctggcctctgagatgtgattaatcccagatcagcctggctgggtggtcctgaactcactgccacatacccctgctccctccagacccccctctggcttctgggagaaggacagtcttcaaaaagtgcctggcctgggcatgagacggcccaggaccccccacccccaacctcatctggccctggggacggaactcaggcccccttccgttctcgctcgcataaaagccaccctggccgagcatttccagatgtgcctgtgagccgctgtgccggggccgcccaggtgcggcccacatgccctgcaagggctgcgtggcgggcgctggccatcccctaaggagtgccgcactgccttggaagtggggctccctcgtcagccccactttacacacagagaaactgaggctggcacataaactcaacagctgtgttcagaggccctaccagacccccagataacagaaagggggttggtcatctgggtcctggctgcagctttcaaactgaggtgcttgggcccctgcactcatagctgcgacccggcctcagtttccccatctgtaaaatgatgacttgggaagatgcgataagcctaggaggcgatgagcattcacattgaaagcgggggcggggaccccagagagagcttccctagcaggacctcaatatccctgtctgagcagcggggctgcggggcagctcctggttcagaggcctagggctgtggggggccccctcccctggaatcgctccccaggccaggagggccgtccagcgccccgccctccccgacgcctcctgggggaaggtcctggcagccccagactcgcgcctggcaagggcggaacaccccaggctgacgcagctggggcccctccggccttcccagaagagcgcgtgcatcgggagcagacgtcagccagctgcaaggaggagcggcccggggctgcgtagctccgctggaccccgattccgggcagagacccccccccgccccggcccgcgcgcaccgagcccagcccccgccccccagcgcaggcgcagcgcggacctcggccccaccggtcccgcgcccggaccctgagccctgcccctgggaacccgagggccccgactccgactgaccctgacctgggacggcgcccccgcctccgccctgcagaaggggcgcagggaggggccccgaggccttcgcgcggccccacgcccgggaccctcccgcgcccggccccacgcgcgtgtcctctgtccgcagattcgtgcgacggcgtggagtgcggcccgggcaaggcgtgccgcatgctggggggccgcccgcgctgcgagtgcgcgcccgactgctcggggctcccggcgcggctgcaggtctgcggctcagacggcgccacctaccgcgacgagtgcgagctgcgcgccgcgcgctgccgcggccacccggacctgagcgtcatgtaccggggccgctgccgcagtacgtgggggcgtggtctgtggaggggcggggcgggacctaccggacctgcgcgtcatgtatcgaggctgctgccgcagtaggcgggggcggggcctggggcgggaccacccggacctgagcgtgacgtatcggggctgctaccgcaatgcgtgagggccaggcctgcgggggcggggcctgctggaggggcggggcctgctggaggggcggggccgctgccgcagtgcgtaggggcggggcctccagcccaggacaggtcacatgggtggcggtggggcctgagtaagggcgtctttatacttccgagggagtatcacggggtagggtcttttgtagggttgggatttggaaaatagtgggcctctgggggctcacactgggcaagaggtatgtggcatggtcagagcgggagcgtgactcagagaggggcttgtgggtgtaaccagaggggcatgatggaaccaggggggtgagactgggtcatgtaaggggcggggctcttggctggggcgtggttcctgggtggagatgggcggggatttgtgggtggagtttgggtgggcggccccgcagtcgcggaggggcggggctttgggtagcataaggggcaggagctcacgaaagaggtgtggctcctgggtacaatgggaagggcagggcttgtgggtggagcctgaggggtggaatggagaggggggctcacggggggcgggggggtgcttgtgtctcctaccagagggttttcgcatcttgggggttaagggtgggtcttggggccaagagccctgcggggttctcagcgagatgtcccctgaacttcccctggcacccggcctgcagagtcctgtgagcacgtggtgtgcccgcggccacagtcgtgcgtcgtggaccagacgggcagcgcccactgcgtggtgtgtcgagcggcgccctgccctgtgccctccagccccggccaggagctttgcggcaacaacaacgtcacctacatctcctcgtgccacatgcgccaggccacctgcttcctgggccgctccatcggcgtgcgccacgcgggcagctgcgcaggtgcagacgcagggcgggggcacaggcctgtcctgggggccggagaaccccctgccctgcgccctcaatgctcttatcgacccttgcaggcacccctgaggagccgccaggtggtgagtctgcagaagaggaagagaacttcgtgtgagcctgcaggacaggcctgggcctggtgcccgaggccccccatcatcccctgttatttattgccacagcagagtctaatttatatgccacggacactccttagagcccggattcggaccacttggggatcccagaacctccctgacgatatcctggaaggactgaggaagggaggcctgggggccggctggtgggtgggatagacctgcgttccggacactgagcgcctgatttagggcccttctctaggatgccccagcccctaccctaagacctattgccggggaggattccacacttccgctcctttggggataaacctattaattattgctactatcaagagggctgggcattctctgctggtaattcctgaagaggcatgactgcttttctcagccccaagcctctagtctgggtgtgtacggagggtctagcctgggtgtgtacggagggtctagcctgggtgagtacggagggtctagcctgggtgagtacggagggtctagcctgggtgagtacggagggtctagcctgggtgtgtatggaggatctagcctgggtgagtatggagggtctagcctgggtgagtatggagggtctagcctgggtgtgtatggagggtctagcctgggtgagtatggagggtctagcctgggtgtgtatggagggtctagcctgggtgagtatggagggtctagcctgggtgtgtacggagggtctagtctgagtgcgtgtggggacctcagaacactgtgaccttagcccagcaagccaggcccttcatgaaggccaagaaggctgccaccattccctgccagcccaagaactccagcttccccactgcctctgtgtgcccctttgcgtcctgtgaaggccattgagaaatgcccagtgtgccccctgggaaagggcacggcctgtgctcctgacacgggctgtgcttggccacagaaccacccagcgtctcccctgctgctgtccacgtcagttcatgaggcaacgtcgcgtggtctcagacgtggagcagccagcggcagctcagagcagggcactgtgtccggcggagccaagtccactctgggggagctctggcggggaccacgggccactgctcacccactggccccgaggggggtgtagacgccaagactcacgcatgtgtgacatccggagtcctggagccgggtgtcccagtggcaccactaggtgcctgctgcctccacagtggggttcacacccagggctccttggtcccccacaacctgccccggccaggcctgcagacccagactccagccagacctgcctcacccaccaatgcagccggggctggcgacaccagccaggtgctggtcttgggccagttctcccacgacggctcaccctcccctccatctgcgttgatgctcagaatcgcctacctgtgcctgcgtgtaaaccacagcctcagaccagctatggggagaggacaacacggaggatatccagcttccccggtctggggtgaggaatgtggggagcttgggcatcctcctccagcctcctccagcccccaggcagtgccttacctgtggtgcccagaaaagtgcccctaggttggtgggtctacaggagcctcagccaggcagcccaccccaccctggggccctgcctcaccaaggaaataaagactcaagccattttggggtgtccaggcctcagtttgtctcctctctcaaggcttcaggccgcccccacggctgtgggatgggcagcctggggcctggggtgccgcatgggtgctctggaggcacgggaagagagacccagcattagtccttgggcagcctctggccgcctctgggcctcagtgcctctccaggcagtggacaagcccgggaggggctgaggcagagcgggaggggagggagagaaaggaggtcttttgggagggcacacaggatagacaagatggcttagggcagccctaagacaccagctggcttgggacccagaaatggaggcccggtcttgaatgacttgggtgtaacgatagcagtaataaaaataacaggattagggcccgggtggggtagctcacccctataatctcggcgctttgggaggccaaggcgggcgggtcacttgaggccaggagttccagaccagcctgggcaacatagtgagaccctcatctctacaaaaaaaaaaaaaaaaaaaaaaaagacccaggcatggtggcatgctcctgtggtcccagctactcaggaggcggaggtgggaagatggcttgagcccaggatgtcaaggctgcagtgagctgtgttggcaccactgcactccagcctgggtgacagagtgagactgtttctaaaataataataatagcataattggccgggcgtggtggttcatgcctgtaatcccagcactttgggaggccgaggcaggtgaatcatgaggtcaggagttcgagaccgacctggccaacatggtgaaactccaatctcggtgagccgagatcgtgccactaaactccagcctgggggacagagcaagaccccatctcaaaaaaaaaaaaaaaaaaattagccaggtgtggtgtcatgcacctgtagtcccagctacttgggagggtgaggcaggagaatcgcttgaacctgggaggcagaggttgcagtgagccgagatcgcaccactggactccagcctgggtgacggagtgagactctgtctcaaaataataataataataataataataacaacaacaacaacaaaaaggcccagcgcggtggctcacccgcgcctgtaatcccagcactttaggaggccaaggctagcggatcacgaggtcaagagatcgagaccatcctggccaacatggtgaaaccccatctctactaaaaatacaaaaaattagccgggtgtggtggtacatgcctgtagtcccagctagttgggaggctgaggcaggagaatggcttgaacccaggggcagaggttgcaatgagccgagattgcgccactgcactccagcctggtgacagagtgagacgtcatcttaaaaaaataataggccgggcgcggtggctcacgcctgtaatcccagcactctgggaggccgaggtgggtggatcacgagatcaggagatcgagaccatcctggctgacacggtgaaaccccgtttctactaaaaatacaaagaattagccgggtgtggtggcgggcgcctgtagtcccagctacttgggaggctgaagcgggagaatggtgtgaacccgggaggcggaacttgcagtgagccgagatcgcaccactgcactccagcctgggggacagagcgagactccatccaaaataaaaataagtaaagataaaaaaataaaataataataaagaaaataaaatctaaaaataaaaaaataataacacaataacaaactgtgacaataacatcacctgggacttgctgtgcaccccgcgctattctctggttttcagaggatgaccacgaggcttgatgtgtggccagaccctcttgggactcctcggcgcggccggtgcaagcccgccctggtgtccagcagcccccacgccctgcacagggagctcagggcttcctggcctccgtttcccagcggactcgcctgcggtgtggttaggcggctggagggaggtggaggaacggcattccaggtgggaggctgcaggagtgtgggttgcaggggcgcaggggtagacccagaggggttcacggtggggggcatgggaaggtggaaaggggctgcggaccgagccgcgacacgaatgccggtggaccctgcagctgaccgcccacgggtgaggctggaagtcagttaacattttactgggtttgcttctgccctttgcatgtggaatgggtgtgccccaccgctgcccgtcccaccccaaccctgaacatcaggcttcccgtggggcccagccacggaacattccaggcctggagcggccatctcatttgcatgccgcaaggttgtggctcaggcggcttctcctgggggcctggtggtcccaggcagggggccgggctggggactgctccgccgaaccacgtcccagatccaggccacaaaggcggacacctgcgtgtacacgtcgggggtcttggggtcgccgcaccagaggcccgagaaggaaacgaggccgtgagcccggttcctgcacaccaggggccctccggagtcggcctggagtgaaaggagaggtgaggtcagggcctctgggagctgctgcaggcacatctcaccacggccctccctgcctcagaaccctctgtggctccctactgctctccaaggaaaaagtaaattcatttctcccctccaggccctgaggacccagcccccacccacttctctgccctccccgctgagcctcctcagtgctccacggcctttgtatagcctggagacctgttcctgccctgcgctggatgctgcctgtgtgaacattcgagtctgcagtgttttgggcagtgcacaacctacacagctgtacgcggcagccctctactaacaggtctctctgccttgcgtgtgtttcctcagatcttctaaggattccttcaagtctcagctcaaaggtgctctccttggagagggctccccgtatactcaccctaaaatccctcatcctaccctcctgccatctagaatccgctctgataccatcaactggatactaatagtgtagcagttttacagatggagaaaaagaggcccagagaaatcaagtgacttttccaaggtcacgcatcgggaaagtggacagtctcatttctcctggactcgggctgctgggctaagtgtgtgtcctgaaccaagtcgctctcttgcctgcggtaaaagaccctccagggccagtgtctcccttggcacctggggattcgtttatctggcaaggttttaggagtgggagctgcttcctctcaatctgttactaccctctactgaatactgcttgtataaatacacaagtgcttggctctttgtgcagtgcgcaacctgcacagctgaacatggcagccctgcatgacccttgccaactccctgccttccctgggcctcagcttctccgtctggtccaacatcaatgggactcagttcccaaggcccttcctggccctgaccctctctgtgggccttggtttccccacacagtaagtgggtggagcagggaggggatcttaccgagcagaagccccgtctgtggctgtccccactgcgggtgcagagcatggtaagtgtcaggtggcccttccaggagctgttgcagacgtccgggtccagcactcggaccttggcctccatcagtccaggcggcagctcctcaaagtcagacacgaagccccagccagccacccggcaccgtgtccccgctgtggggggcctggcccttctccctggcggcctcagcagccccactgcagggcccaggacagcagagccgttcagctgcagggagagcatgagttcaggccactgggctccctccccacccccgctcctgcctcagtttatccatgggacccctggtcctgcccttgtgaagcaaaatcaatggcggccaccatgaggccgggtcaggaggccccgttccttctgccaacacaggcccctacccctcaggcctccagggtcaccgtcagctgcccaaagggtctttctgttctgttcttttcttttttttgagatggagtctcgctctgtcgcccaggctggagtgcagtggcacaatcttggctcactgcaacctccacctgccaggttcaaccgatttctcctgcctcagcctcccaagcagctgggattacaggcgtgcaccaccacacctggctaattttggtattttagtagagacggggtttcaccctgttggccaggctgttctcaaactcctgacctcaggtgatccacccacctcagcctcccaaagtgctgggattacagagtgagccgccgcgcccagcctcaaagagtctttcaaactccatctccttccttactctaagccctcccacggctcccgattgccctcaagacaaaacctctttgctcaccagccagggcctctgagggctctccagcctcagcctcccctttggccaggcaggatgaatttacagctactccctgggcctgccacacacctcccctcacaccagacccccagcctgaaacacttttcctattcagccatctcagcatggatgccacctcttccaggaagtcttcccagactcccaggctggcacgtgagtcttctctgggctccctgcagcctgttgaggccggtttacccagtgaagactgagtgacaccccgggctctgtgtggcccagcaccgggcctctggccctggccctggcaattggcacacagctgatgctcagttaatgggcctgggaaggacggctccaatccctgtctctggttctctgatttgtgcgtcttgggttcattcctgacattcttgatgtctcgctcagcctcagtttccccatctgtgcgatggcctctgggtgaaccagcgctggttccaggcttcagggtttcacagatgagaaaaattcacccaaaagctttggctactggcacttgctcctcctccttttttttttgtttttttcagagtcttgctctgttgtccaggctggaatgcagtggcgcaatctcggctcacggcaacctccgcctcccgggttcaagcgattctcctgcctcagcctctggaatttaattttgggatgctgggtagaagcgtcagggaaggggtcgtccctcgagcaggagggggccaggcgggtctgcatggatgcaccacgtgtgggaggagcagcttcccacccggaggactccacccagggacttttttttttttttcagatggagtctcactctgtcacccaggctggagtgcagtggcacgatctcggctcacggcaacctctgcctcccaggttcaagtgattctcctgcctcagcctcccgagtagctgggatgactggcacccaccaccaggctcagctaatttttttatttttagtagagatggggtttcaccacgttggccagtctggtttcaaactcctgacctcaaatgatctacccgcctcggcctcccaaagtgctggggttacaggtgtgagccaccacgcccggccccacacagggactttaagcgtctcctccacacagggcaggggcccgagaggcacattcattccatttcagcataaactttgagcgcctgctgtgtgccataaatggccataaaggtgataaaaaatccctgcccgttaggttcagaggaagcgggaatgaggaagcgggtggtccaggggttagcaggtgacaagcaggtgacgacggggccggaagggtggtccaggggttagcaggtgacgacggtgctagaagggtggtccaggggttagcaggtgacgacggggctggaagggtggtccacaggttagcaggtgacgacggggtggtccaggggttagcaggagatgacggggccggaagggtggtccaggggttagcaggtgatgacggggctggaacagggttgcagggagggggtatgtggtccagggcggcctcctgggaaggtaacatttgagcaaagacttgacaggcgtgaggggaaaggctcgcggtgtctggggaactggtgcactgggtacagctggtgcagagctcggagcggagactgtgctggggatgggatggcccatccgggaggtctgctggcctcgagtcagaaaggtgacaggcatggattagcagggcctgtgggcaccaggaggatttgtcctgcaggaggtgggagccactggggggtccagggcacaggaggaatgggacctgacgtccaactgtctttaaaacctaagtcaggccaggcgcagcagctcaggtttgtaatcccagcactttgcggggctgaggcaggaggattgcctgagtccaggaggtcaagaccagcctgggcaacatggtgaaaccccgtctctactaaaaatataaaaattcgcctggcgcagtggtacacgcccgtgatcccgacactttgggagaccaaggtgggcggatcacttgaggaccggagttaagaccagcctggccaacatggtgaaatcccatctctactaaaaatacaaaaattagccaggtgtggtggtgggtgcctgtgatcccagctactcgggaggccgaggcaggagaatcgcttgaacccgggagatggaggttgcagtgagccctgactgtgccactttactccagcccaggtgccaaagtgagactccgtctcaaaaaataggccaggattgggaggcagaggtgggcggatcacgaggtcaagagatcgagaccatcctggcaaacatggtgaaaccccatctctactaaaaatacaaaaattagccgggcgtggtggcgggcgcctgtaatcccagctactcggggggctgaggcaggagaatcgcttgaacctgggaggcagaggctgcagtgagccgagatcgtgctactgcactccagcctggggacacagggagatactgtctgaaaaaaaaaaaaatagcccagggctgcttctcctggaaaacactaaacggcggatgacgtcggtgcagtggggcggccctgggatggggaacggcgctggcttcccccgaggcttcggcactggcttccgggctggggccgcggagctcacagaggcaagacagaggataaggagtagacgcctgtcaccaagctgggccgcctggtcaaggacataaagatcatgtccctggaggagatctgtctcttctccctgcccatcaaggaatctgagatcattgaccttttcctgagggcctctctccaggacgaggttttggagattatgccggtgcagaagcagatccgcaccggccagcgcaccaggttcgaggcgtctgttcccaccggggactacaatggccacgtcggtctgggtgttgagtgctccaaggaggtagccactgccatcatcggggccgtcatcctggccaagctctccgttgtccccatgcacagaggctactgggggaacaagatcggcaagccctacaccgtccctggcaaggtgacaggccgctgcggctctgcgctggtgtgcctgatccccgtgtccggggcgctggcatcgtctgggcgcctgtgctcaagaagctgctcatgatggctggtatcggtgactgctacaccttagccaggggctgcactgccaccctgggccactttgccaaggccgcctctgatatcctctctaagacctacagctgcctgacccctgacctctgtattccccaagtctctctttcaggtattcactggccatcttgtgaagactcacaccagagtctccgtgcagacgcccggctccagctgtggttacaacatagggttttatacacgaaaaataaagtgaattaagcctggaaaaaaaaaatggccaggcacgatggctcacgcctgtaatcccaacactttgggaggctgaggtgggtggatcactgggtcaggagttcgagaccagcctggccaacatagtgaaaccccatctctactaaaaacacaaaaaactagccaggtctggtggcgagtgcctgtaatcccagctacttgggtggctgaggcaggagaatcacttgagcctgggaggcggaggttacagtgagccgagatggcgccattgcactccagcccccgtgacagttcgagactctgactcaaaaaaaaaaaaaaagaaaagaaaagaaaagtaggccgggctcggtggctcacgcttgtaatcccagccctttgggaggccgaggcaggtggatcatttgaagtcaggagcttgagaccagcctggccaacatggtgaaaccccgtctctactaaaatacaaaaattagatgggcttggtggcgcgcacctgtaatcccatgtacttgagaggctgaggcaggagaatcacttgaacccgggaggctgaggttgcagtgagccgagattgcgccattgccctccagcccgagcgacagagcgagagactgtctcaaaaactaaacatacgtcagatccacccccggggctcacccgcagcaggcagatgtcgttggcgtgggtcatggggtggtagtcggggtgtgtggtgagagcatcgatgccaaacacctgctgggtgggctccgcagtactcaggacgtgggcgcccagcaccaccaggccagtgcggaggtctctgcagggaggaggtggtgggtgagacgggggtgagggctgcccgtcctgggcctcggtccactcatctatgaaacggaggcccaggccgggcacggtggctcacgcctgtaatcccagcactttgggagggtgaggagggtggatcacctgaggtcgggagttcaagaccagcctgatcaacatggagaaaccccgtctctactaaaaatacaaaattagccaggtgtggtggcacatgcctgtcatcccagctactcgggaggctgaggcaggagaattgcttgagcctgggaggcggaggttgcagtgagctgagattgcaccattgcactccagcctgagcgacagaacaagactccgtctcaaaaaaacaaaaaaaaaacaattacttttgcatcaacttaatattcttttccttttttctttttttttttttttgagacagagtctcactctgtcccctaggctagagtgcaatcgaggcttactgcaacctctgcctcctgggttccagtgattctcctgcctcagccctccaagcagctaagactacaggcgtgcgccaccactcccagctaatttttgtattttcagtagagacagggtttcaccatgttggccaggctggtctcgaactcctgacctgaagtgatccacctgcctcggcctcccaaagtgctgggattacaggcgtgagccacggtgcccagcccccaacttaatattatgataataaattaataattatgtttattatttttcctacctccaatatagaattaactgcaatagttgtggtattaatttgaatcattattataaaaacatatttagaatgaagataatacttattatatttattataagttctatttcaattataatattaactacagtaatttcaatattctcctttttttatttctttaatttttttttttgagacggagtctcgctctgtcacccaggcaagattgcagtggtgcaatcttggctctctgcaagctccacctcccgggttcacgccattctcctgcctcagcctcctgaatagctgggactacaggcgcccgccaccatatccggctaattttttgtatttttttttagtagagacagggtttcaccgtgttagccaggacagtctcgatctcctgacctcgtgatccgcctgcctcggcctcccaaagtgccgggattacaggcgtgagccaccgcacccggccttttttttttttttttttttgagacaaggtctcactctgtcacccaggccgcagtggtgtgatcacagctcactgcagcctcgacctcccaggctcaagcgatcctcccacagcagcctttcaagtagctgggaccacagaagcacagctccggtgcggaggactctgcggggaggagggggtgggtgagatgggggtgacggctgcccgtctgggcctcagtccactcatctatgaaatggaggcccagtaatccatttaatgctcacgccggccccgtgataatattaggttggtgcaaaagtaattgcacgaaaaaaattaaatggcaaaaaccacaattaacttttttttttccgacagaatctcactctttcccctaggctggagtgcagtggtgccatctcggctcactgccacctccacctcctgggttcaagtgattctcctacctcagcctcccgagtagctggggatacgtacagccacttgctaccatgcccaactaattttcgtattttttttttgagacagagtctcgctctgtcccccaggctggagtgcagtggcgcgatctcggctcactgaaagcgccgcctcccgggttcacgccattctcctgcctcagcctcctgggtagctgggactacaggcgcctgccaccacatccggctaatttttttgtatttttagtagagatggggtttcactgtattagccaggatggtctcgatctcctgacctcgtgatcctcctgcctcggcctcccaaagtgctgggattacaggcatgagccaccgcacccagcctaattttcgtatttttagtagagacagagtttcaccatgttggccaggctggtctcatactcctgacctcaaacaatccaccgtgtcccaacgtgagggggactgcaggctggcgggggagctggggacactgcagcccaggaccaacctatcccgtgcctggtgggggctcctgcaggaggggacccacccaccctggccccaatatacattttaatagttattataacaatatgtttaaaacgaggcagggcatggcggctcacacctgcaatcccagcactttgggaggcagaggcgggtggatcatttgaagtcaggagttcgagaccagcctggccaacatggtgaaatccagtctctactaaaaatgcaaaaattagccaggtgtggtggtgggcgcctgtgatcccagctactcgggaagctgaggcaggagaatcgcttgagcccgggaggtggaggttgcagtgagccgagattgcaccgttgcactccagcctggggaaccgagactgcctcaaaaaaaaaaaagaacatagtgacagttacagtaacagaatatgtacttgttgcgcctgttgcttcttctgtgcttcttttgcctccctgccttatcctcctgttttccctttgttgccctttaaatccagcccctgctgagactccccctcctgcaggagccacggcgcccccagctcccccaccagcctggagtccccctcatgtcgggatacggtgtccagaaagaaggggcccgacaggtgagctcacctgtggctgaagcagtgggcggccgagaccacccagcgggctcgcagcaggaagcctccgcagtgatgttggcccccgaagcgcacggatgccatgtagggcctggagtggggggtcacctcgtggcccccgatgatctgggccccccaggagcctgctggagggacggcctgagtcagggacgaggcgggaggaacggatgacggggctggggtcagggcagggggagaagtagcggccaagacagagacagggggtgagattagagacggagagacccagagagctggagacagagcccagacaagccccccagatgcgctgggaggggctcccgagcccgggagatccagggctgggctgggcagagaccccggccggatttccatccatttccagcagaggcagccacgggggctcggcagatggagcaggtggagctctccccagggttctcccgggactgggggttcccgggtgtggcccccgtacggggacttggcgggggcctgggtggggatcccggggggctcctcaccggggggcttcacgggcagcatcagggcggtggccacagtcagcagaggacgtccccagcccctcaacccgagccccatggcagacgcaggctggcgtctccccgcagaggtcttcgggccgtggctcccaccctcagccaacggccggaaagggggagcctggctgtggcctgtggtcgggaggccccaccagcaacgcctggagcccaggcgggcgtttctgagaaatcgatggtctcaggtggtggctggtaataatcatgttgataataatcattgtcccctagtccggaaacagggagaggaggagacagctctggggctgcaagtgacctcgggaaggcaattgacccttctgtgcctcagtttacccagcctccacgtggcccagcatgtgtggggagctttccgaggaaccgaggtcacagcggcactcgagacccgcagctcgcctccggcccccaccccgcaaaccccagtcttcccatctccaaacccagggccgacctcagggctgtggggacagcgaggaaggccggtctcctgggaagctctgatgatttctgcctttattttattttatttttataggtggggttttgctatgttgcccaggctggtctcgaactcctgggctccagcgatcctccctcctcggccttccaaagtgctgagatcacagaagacagccactgcacctggcagatttctgcctttattcagcagttattgagtgcctagtgtataccagacctcatgctaggaggtgaggatgaggcagtgaccgcaccccagcctgtagcactgacgttctgtgggatccggagtccagtgggacatggctgtacatgggggtcttcaccttttttttcttttctttttttttttgagatggagtcttgctcttgttgcccaggctagagtggaatggcaccatctcggctcaccgcaacctctacctcccgggttcgagtgattctcgttcctcagcctcccgagtaactggaactacaggcgcccgccaccacagccggctaattttgtttctgtatttttagtagagacggggtttcaccatattagccaggatggtctcgatctcctgacctcatgatccgcccgcctcggcctcccaaagtgctgggattacaggcatgagccacggtgcccggcctttttttttttttttttttttttgagaaggaatcttgctcttgttgcccaggctagagtgcagtggcgcgatcttggctcaccgcaacctctgtctcctgagttcaagggattctccttcctcagcctcctgagtaactgggattacaggtgcccaccaccacgccccgctaaatttgtgtgtttagtagagacggagtttctccatgttggtcaggctggtctcgaactcccgacctcaggtgatccacctgcctcagcctcccaaagtgctgggatgacaggcctgagccaccgcgcccagcccggcaggtcttcacctttcagtgggagcgttcttagtggcaaagttcaggtcgtaaattgcagctcacacagccgggtgatggcgttcacggcagtggctagcagtggggtgctcgtcagcgcttaataatgaacaggctggggccgggtgcagtggctcacgcctataatcctagcactttgggaggccgaggcaggtggatcacctgaggtcaggagttcaagaccagcctggccaacatagtgaaaccccgtctctacttaaagtaccaaaattagtcaggcgtggtggcaggtgcctgtaatcccagctacttgggaggctgaggcaggagaatcgcttgaaccgggaggtggaggtggcagtgagccaagattgcaccattgcactccagcctgggtgacagagcgagacaccatctcaaaaaaaaaaaaaaaaaaaaagtcatcattgaacgctccagacctgtgttttaccaaatgtaaagtgttctcaataaagaatgaagtgaaatgaagcaacaggaaatgcgtggaaaggaaggtatgaaaaggccccacaacgaactcgggctctgcgagatgcgggcggcctctggaagctaaaaaacggcaggaaacgaattttctcctggagcctccgggaaaagccagccctaccgatgccctgacgttagcccagaagggcctgcaggggcttctgacctccagcactgccagagaataaattggtgccatttcgtttattattattattattatattttcttgagatggagtctcgctctttcgcctaggccagactgcagtggtgcgatctcggctcactgcaagctccgcctcctgggttcatgccattctccttcctcagcctcccaagtagctgggactacaggtgcccgccaccacgcccggctgatattttgtatttttagtagagatggggtttcaccacgttagccaggatggtctcaatctcctgacctcgtgatctgcctgcctcagcctttcaaagtgctgggattacaggtgtgagccaccgcgcccagcctcatttattatgtatatatttattttgagacagggagacagggtcttgctctgccgcccacgctggagtgcagcagtgcaatcaaagctcactgcagcctcgacctcctaggctcaagccatcctcccacctcagcctcccaagtagctgggaccacaggcacctgccaccaccaggcccggctcattatttcattttttgtggagacggggttttgccatgttgcccaggctggtcttgaactcctggcctcgagcaatcctccagcctcggcttcccggagtgctgggattacaggtgtgagccaccatgtctggcccaagttggtatcattttaaaccactacgtttctgggaattcgttacagcagctgcaggaaagattttgggaaatggaaagctgtttccagggcctggggacaggtgggaccccagctcagggtccgtgtacttggggaccatttcctgctctgctgtggtctactggaccgtctggcatcgctgtgaccgcatgggccgtgctccatcaatattgtttttttgtgtgtgggtgtttttttttttttttttagatggagtctcgatctgtcgccaggctggagtgcagtggcgtgatctcagctcactgcaacctcagtgtcccgggttcaagcgattctcctgcctcagcctccccagtagctgggactacaggcgtctgcccccacgcccggccaattttttgtatttttagtggagatggggtttcaccatgttggccaggctggtcttgaactcctgacctcgtgatccgcccgccttggcctccgaaaatgctgggattacaggcatgagccactgcgcccggccctgtttttatcttttagagacagggtctccttctgtcgcccaggctggagtgcagtggtttgatctcggctcactgcatcctctgcctcctgagttcaagcgatcctactgccttagcctcccaagtaggtgggattacaggtgcctgccaccacgcccggctaatttttgtgtttttttgttttgttttgttttatttgtttggtagagatgggttttgccatattgcccaggctggtctcaaactcctgagctcaagtgatcggcctgcctcggcctcccaaagtgctgggattacaggcgtgagccatcgcacccggctgtccgtcaatattgtcaaacgactggacagcaggcactctggtctccacggtcgtcgcgtcagcacgagtgggtcccctggacttgctcctacctcccctgctgccctccgtcgcggagcactgaggcagagacctggaaaacgtccccagctccacgggcgttagaaggagaattgcccgaagctgcaggcgtgtggaactttgttccctcacgatgctgtccctgtcccggtcgctgatggggacacagtagggagagggtaagcgccttagccctgccacacagtgaggagccagggggccggggctgctgcctcagaggagctcccactgcctctcgggaccgattctatccagagctgggccatttccttcccttttggtgaacagttgtgaaataaacaaccgtcctccagcgtctcagaaaaccgagctcctggcagccctgaggagggggctgagtgggggtcactgttcccacttcccaaactgaggcccagagaggggagccgatttgtctggggccacacagcacagggtcttgacccatgagccgctggactgcgattctcctggagggtctctccatggcagatctgagcggctcttcaggagctcagacaccagccactgcagggagtcaacagcaatggtgacaacagcttcctttattgtatttaattttacatttttattttatttattttgtttttttgagacggagtctcgctctgtcacccaggctgcagtgcagtggcaccatctcagctcactgcaagctctgcctcccgggttcaagtgattctcctgtctcagcctcccgagtagctgggattacaggcgcccaccaccacgcccagctaattttttgtatttttagtagagatggggtttcaccatgttggccaggctggtcttgaacttctgatggcaggtgatccacccgcctgggcctcccaaagtgatgggatgacaggcgtgagccaccgcgcccggcccctcccctgcgaaaaattgtttttcaagacgagatgttgcctggtggctgagactgcaatcacagctcactgcagcctctgcctcctggctccgccttccctgtagctgggaccacaggctcacaaaaccaccagggtaattaaaaaaaaaaaaaaagctagacacggtggctcacgcctgtcatcccagcactttgggaggctgaggcggatggatcacgaggtcaggagatcgagaccatcctggctaacacggtgaaaccccatctctactaaaaatacaaaaaattagccgggcacggtggcgggcgtctgtagtcccagctactcgggaggctgaggcaggagaatggcgagaacccgggaggcggagcttgcagtgagccgagatcgcgccactgcactccagcctgggcgacagagtgagactccgtctcaagaaaaaaaaaaaaagtttttttgtagagatggggtctcactatgccgcccaggctggcctcaaactgacctcgactgatcctcccaccttggcttcccaaagtgctggtgtaataggcatgagccactgagcctggcctcactttatttttatttttttgagacagatgctttgtcacccaggctggagtacagtggtgtgatctctgcttactgcaacctctgcctcccaggttgaagcgattctcctacctcagcctcccaagtaggtgggactacaggtgtgtgccaccacacctggctaatttgttttgtatttttagtacggacaggatttcactgtgttagccaggatcgtctcgatctcctgaccttgtgatctacctgcctcggcctcccaaagtgctgggattacaggcatgagcttctgtgcccagcctcactttattttttaaccccaataaatgtatatccacaggacattgcttcttcttttttttttttttttttgttgttgttgttgagagggagtctcgctctgtcacccacgctggagagcagtggcgcgatcttggctctcagcaaccttttcctcctgagttcaagagattctcctacctcagtctcccaggtagctgggattacaggcatgcgccaccacgcccagctaattttttttttttttttgagatggagtttcgctcttgttgcccaggctggagtgcagtggtatgatctcagctcactgcaaactctgcctctcgggttcaagcgattctcctgcctcagcctcctgagtggctggaattacaggcgcccaccaccacccccagctaattttgtatttttagtagagatggggtttcgccatgttggtcaggctggtcttgaactcccaacctcaggtgatctgcctgccttggcctctcaaagtgctaggattacaggcgttgccaacgcgcctgatctttttttgtatttttagcagagacaggttttgccctgttagccaggctgctctcgaactcctgacctcagaggatccacccgcctcagcctcccagaatgttaggattacaggcgtgagtccccgtgcccggacctgcttcctatttcttgaaatggaagatagctgccttaagaatacacattgcactggctggacgcagtggcttgcgcctgtaatcccagcactttgggagactgaggcaggcggatcccctgaggtcaagagttccagaccagcctggctaacatggcaaaaccccatctctactaaaaatacaaaacttagctgggtgcggtggtgtgtgcctgtaatcccagctactcgggaggctgaggcaggaggatcacttgaacctgggaggaggaggttacagtgagccaagattgcaccgttgcactccagcctgggcgacagagtgagactccatctcaaaaaaaaaaaaaaaaaaaaaaagaatacacatagcacaacccaacactacctgccttccagccagactggagagggctggcttggccgctactgggggtccctgagctgtccaaaggccctgctccccggagctctctggcctcagttttcccatctagggaatgggttgccctggggcaatgccgagagtgctgatgagaattcagcaaggttggctgggcacagtggctcacgcctgtaatcccaggactttgggaagttgaggcaggcgggtcacctggggtcaggagttcgagaccagcctggccaacatggtgaaaccccgtctctactaaaaatgcaaaaattagctgggggtggtggcgggcacctgtaattccagctacccggaaggctgaggcaggagaactgtttgaacccaggagatgcaggttgcagtgagctgagatcgcgccactgcactccagcctgggtgacaagaacgagactccgttggaaaaaaaaaaaaacagcaaggtactggatgcggcatgctggtggggactggggccctggcgccccttgtaaagcgcctgtttgcccatccgtaagctggatcctgccccgtccttcccatggaagccatcacagtcagagaagagggtagaagacaggaaaccatccattcattcactcaactcattccgtgagcatttattgagcacctactgtgtacagacagtgttgtgggccttggggactcagcagtgaagaagacaggcaagttcctgcccttgtggggctgacattcagcagagaggcaggaaggaaacgctgaacacaacatgtaaatgacattgtctgtcagaagaatttagtgggaaagagagtgtggacagacaagaggaatagcaaacgccaggcacggtggctcacgcctgtaatcccagcactttgggaggtcgaggcaggtgaatcacctaaggtcaggagctccagaccagtctggccaacacggtgaaacctcgtctctactaaaaatacaaaaattagccaggcatgatggtgggcacctgtaatcccagctactcaggaggctaaggtggaaggatggcttgaacccaggaggtggaggttgcagtgagctgaggttgcgccattgccctccagcctgggcaacagagcaagactctgtctcaaaaaaaaaaaattagccacgtgtggtggtgcacacctgtagtcccagatactcaggaggctgaggtgggaggattacctgatgggggaggtcgaggctgcagtgagccaagatcacatcactgcactccagcctgggtggcagagtgagaccctatcttattcaaaaaaataaaaacaacaagggtaccgagggcacccagtgacaatggggaagctggggaagttctcccagaggaacacacaaggcgtctaacagcaggtgtctggatggctgaagcccaagctggttgtggggcaaggagaggtgagcagggaagagacaggattgtctgggctcagctttgccttgtggggctgcagggcactggggaaccatagatggtgtttgagctggggcaggccagggcatatttctctggtgaaagagtggagtagggagaggaggtggggagacccggaggcgacatggctcagggttggggtgggggccataaggcctcagctaaagtcatggctggggagaggcgaggggggtctctgactcagggacaggggaggagtgaggttttgggacccacctatagcttccggtcgtccaaggctccagagggtggccagatctgcaaggagtggtggggcgtgctgggcggagccccggggtagagctctacggaagtaggaagggcaggggcgccctcagggaaacctcactcctcccctgtccctgagtccaggaaggggtcaggccaacgtcgctctggaagcctggaggcggggccgaggtgcaggggcggggccgacattgcctgggaggcggggctgaggtgcaggggcggggcctacattgcctgggaggcggggctgaggttcaggggcggggccgacattgcctgggaggcgaggccgaggcacagggggcggggccaatgtgcaggggcggggccgacattgcctgggatgcagggaggtggggccgatgtcgggggcggggccatggtgcagggggcggggtcggggcggggccgagatggcctaggctgctgggaggcgggactagggtgcagggtgcgaggctagcggggtgatgcgggggccgagattgcccaggaggcgggtccgaggttcagggggcggggctagggcgcagggggcggggccgacattgcttcggaagctgggagtggggaccgaggtgcaggaggcagagcctcagtgcagtgactgctccccacaggacgcggatgggcgctgcagtgcctgtgggtgggtgagcgcagtgaggcggtggaagtgagggtgtgaagggcaactcgaggcagcttctctccggtccactacacaccccaccttgtcccacctccacacctttgccaggccgttccggccacctggaacgtctccctccaccgtttgcccggcccatttccccggttcaagtggcatcacctccaggcctgtgtgtgctggagtcgggaggtgtgggcggcgcgagtttttcgtgcagggccttgagagtggcaggaggactttagcttttgctcggagggaggtgtgagtcctggaggtttagagctggggcggtgggagaaatgatcccagcagtcccttaccctccccacggcctcctcacttcctcctatttttacacaaaatgcctccaccacccttcaaaccctgaatcttttattttattttatttttgagatagggtctggctctgtcacccaggctggagtgcagtggtgtcttcacagctcaccgtagcctcgatctcctgggtccaactgatcctcctacctcagcctgtgagtaactggaactacagatgcatgatacctcacctagctaattttttaaaaaaaaatttgtaggctgtgtgcggtggctcacacctgtaatcccagcactttgggaggccgaggcaggcggatcaagaggtcaggagatcgagaccatcctggctaacacggtgaaaccccatctctactaaaaatacaaaaaataagccgggcgtggtgtcaggagcctgtagtcccagctactcgggaggctgagacaggagaatggcgtgaacctgggaggtggaaattgcagtgagccgagatcaccccactgcactccagcctgggcgacagagtgagactctgtctcaaaaagaaaaattacatttaaaaatgtatatatggctaatgactgctgtaccgaacaaaccagtccccaaaagcaaatgaaataacagctgccaccaagtaccacggtcacacctaaaaaccaattaacacctcgacagctcctcacgcaggttccgtttactcgggagtaggagccggccacccgatgcagggtcactatgaccccccaagcccgtgcctcgccctgtctcttcttcctccttataattaaaatcttgaaggaccccgatggcagcctgtcccaccgccctgcctgggtctggcccctgcagcttgtgatgcttctcagacccattcccagccctccggggagtcacagaggggtgagatcagacagaggtttgaatccgggggtggcctttccttggatggagcagtatttaaaaaaaaaattgggccaggtgcggtggctcatgcctgtaatcccagcactttgggaggcccagctactcgggaggctgaggcaggagaatggcatgaacccgggaggcagagcttgcagtgagccgagatcgcaccattgcactccagcctgggtgacagcgagactccgtctcaaaaaaaaaaaaaaatttgtagagatggggtctttctgtgttgcccagactggtctcaaactcctgggctcaagtgatcctcccttctcagcctcccaaagtgctgggattacaggtgtgagccactgtgtctggccctgaatcatttattttattttgagccaggttctggctctgttgcccaggctggagtgcagtggcatgatcacggctcactgtagcctcaacctcccaggctcatgcgatcctcccaccttagcctcccaagtaactgggaccacaggcacacaccaccgtgcccagctaatttttattttttattttttattttttttgagatggagtttcgctcttgttgcccaggctggagtgcaattgtgcgatctcggcccactgcaacctccgccttccaggttcaagtgattctcctgcctcagcctctggagtagctgggattacaggcatgcaccaccacgcccgcctaattttgtatttttagtagagacggggtttctccatgttgctcaggctgatctcgaactccagagctcaggtgatctgcccacctcagcctcccaaagtgctgggattacaggcgtgagtcactgtgcccggcccaatttttaattttttgtagaaatggaagtctcactaggtagcccagggtcttcacctcctggattcaagtgatcctcctgcttcagtctcctgaagtgttgggattacatgtaacagtcacttcattcaccctgaatcatttatgtaggggacaaaaatcaccgtctctccaaggacagaacttcttttttgttttgttttgttttgttttgttgagatggagtcttgttctgtcacccaggctggagtgcagtggcgcgatctctgctcactgcaacttctgcctcccgggttccagccattctcctgcctcagcctccccagtagctgggattacaggcgcgcaccaccatgcccagctaagttttgtatttttagtagagaaggagtttcactggccgagcgtggtggctcacacctgtaatcccagctactagggaggctgaggcaggagaattgcttgaacctggtagacggaggttgcagtgagccgagatcgcgccattgcactccagcctgggcaacaagagcgaaactccgtccaccccagccaaaaaaagaagtggttttgccatgttggccaggctggtctctaacttttgacctcatgatccaccagcctcagcctcccaaagtgctgggattacaggcgtgagccaccgcgcccggcctggtctcaaacttttgacctcgtgatccaccagcctcagcctcccaaagtgctgggattataggcgtgagccacggcgcctggccgcaaaaatggaacttctgcatcacaggtgactaacggtgccaggcacacagtaggtgttcaataaatcactttggactaaaagaacacagaggccaaggggaagtgaagaaacgactcacaggtcagttttattgggtgcctagtgcaggggtcagtacactacggccctcggatcagctctggccctctgcctgtttttgtaaataaagttttattgggtgcctagtgcaggggtcagtacactacggccctgggataagctctggcccactgcctgtttttgtaaataaagttttatgggcacagagccatgcccatggttttacatattgtctctggctactttcactctgcgatggcagagcagagtcattgccgcagagactgtggcctgcaatgctgaaaatatttactctctggccctttacagaaaaagtttgccaaaccctgagctagtgtgtgctgggccctgtgccaagccctttgtgtgtgctcactcagttaaccctcccacagccttaagggtgggggcaggggggtgggggggaataaggctccgagaggttgagaaacagacccagggtcacacagcttggagatgggtgagctgggaatcagacagacccgggacccctgatattctttaggatcttagctttgttaacctttgctaatttatcttattgtcttaaatgctaaaatgaatacacattcattgtaaaaagggaggaataaagaaaaggtgttgacggccttcttcagcctggggtacatcctgccgtatctttctccacagctcatccggggctactttcctttaaatctacagccattcagcaaacatcggcagaggagaaccgttttataagaaaactaagaagtttggaagaatctttccttcctgcccaccctggacccccatgagtaggtgtgctggggctggtctgcagtgttctcacgggaaaccaggaagctgggcccaaggcctacatgttggggaagacaggtcctgcctgtctcctgctgtggctccccagtgctctgaggacaaagcctgagctctccctgattctccaccgtccctctcactcactctggtcgtctggtcgctgggcctttagtgagtgtgccatgggggccctggggccgattaaattccagccccggggaccaggctcagctcccagccagggcacagacagatcagcacctgcggttgtctccaccccaacccccggcctttgcaggcacagcgccctccaccagatactccggcaaaggaggcctggggaccctgcgagcggggccgggggtgcagggagctgtcagctcctcgcagcggcctccccaggacccccctatcccctcgctcgccctgaaatgtgtgtccctctcggcgtctgggctctcgagaaaggcctttgcttgtctgacttcgcgagggtcccggctctggcccaggagctggggaggggcgggacttggtgacagccgggtcccagcaccgcgcccagacctaggcccttctcaggggtgccccggggcggggcgcgcggggcggggggcggcggcggcgcagccggcaggaggcgcagcgcccgctcgcagcgcggggaggtgggaggggagcggggcggggagcggggcgggcgggagggagaggggagcgcgccggagacgcgcgcgcccagcccaccccccgcgcccgccgccgcccggacaataaacagcagctttgcgcggggcgatgcccgagccggtgccgccgcccccgcgccgcgcagccccggccgccaggccttagcccgccccggcccccgccaggccgcgtccccctcccctcccctcccccgcgcgccacccgcgcccgcccccgcccggcaccgcggacccacccggacctcggcggggagatggagtgagtaggcgcgctcgggccgcggggctgggggcccggagctccgggagccggggaggggggaggccccctctctcgcgccccattgggggcgtcgctgcccccgcgaggagcaggaggcggcgcggggctgctggggccgcagcgcagccgggaagagactcgggctgggccgcgcctgccgggaggcctccccgctcccggaccccggctgcccacccaccggcgcgtggggacccgggcagcggcggctcgggccagtccaggacgcggggagggggaggctcgcgtctccgcccgcgccccgcccgcgtctccagggcgagcctcggctctcggccacctgtgggtggccccggggagatggagcgacccctccccagattgcaccggtccggcctcgcgctcacgcacccttcccccgccccagtctgagcgcacggctcctggcgccctggacgcgcgcgcgggccggtgccccccacccccgcccttcccaagggcctccaggggtgtcctgagccccccgccactgcgcaggtcccgagttaccgctggagggagaggggctgccctcggcttcccgggtctctggggtgtgtgagaagggagaggaaccggcgttttccagcggggcgcctgggtgggataccctctcggggaagtgtctcggagctggggctccactggtgtagctacaggagtgggctggccctgggctgggatccctggacccccgcatggctgcgcctgtgtgtgtggggggggggtggccagtggaggcaccgagcgagggcgcgtggtcatttcggacaccggtcccctcctcccggtgctcgggtgcccctctgcccctcactcccacaggtgggcactgcacgggcaggggtcaggaggctcctcctggggtcacccacctgcccacttcaggacaggggagccagctgccctgctgaggcccgggtccccaccccagcccgaggaccgaagaccggatctggaggccgcctgtggccccctgcccttcccactgggcgtgttttctaagccgccaactttccccggggattcacccgtgacccgccacgcccgcggctgggtgggggccgctgcctccctccctccctgggaaagcgagacacccagtgtcctctgcttttgaaaacccagacaaaggcctgacccctctccccgtcaccccgccccgggagctcagccaggggctcaggggagccagggcccagacttgcctgctccacacccccaccccccagccttgtttatctgccctgctcgccaggccccggaggagcctctgggcctctgacagccaggcctgggcagggtgtggctgtggggagggggctgcctaggaggacgacggagatctccctcccagaggaggggtgtcagcgaacactccgggtcgggcccattgtttccttcctgccaccccttcctttcccacgggggatactgaggcccagagaggagctgctgccccccccccaccccccctccatcacacagcacctggggccggggggcctcggtgcctcctgctctgctccacggtttctccgtcctgggtcagagggtggcccacaggtcccccattgggtcatcattgcttttggggatgcagacatgggacaggcacccagtgttaaccggctgctgtgagccgccattcgaggacgactctctccccggttcccgggctgacaatgggtggggacaggcccatctggtgccgcccggccttggacacctgccccctcgttcttctccccggcgggcttcaggcacgaaggccccgtccgctagaacgtgatcgcttgcctcctcccgtttccacagattttccagtcgaagacacgggagctggctgtggtttgtggtggtgcccgtctcgctggaaagtttcacaaatgaatttaagaatttaaagaattttaaatgtcattcaagaacaggttattttttgttaatgtgaggatttaaggagaactagcgggttgctaaccacagggccgatgctgccaaggtgaggagaacgtccaggaaggagctggggagaatctctgcttcggagagaatctctgtgctctgggagggtttgtgtggcccctgcgtgacacatggtctggctggtaaaataaagatattttggcctggagcagccattctccagcacccacagccctgtcctgggtacaggcaaggctcaaacccccgggatagggaggagaacagacttgggcctggacagatggtcaagaccggcccagactcctccctgctcgcagacctggaaattttcaataggaaagtctccgttgggtgctaactgggtccttaacgctccttcacacttgctaatccccctttttaatgagaggcagagcctgttaaaaggcaacagtacctagtgataattgaatttaataacaagcttttacttccgttgtatctgtttcttcctccatgtttccgctgtcttgtttgtggcggtggcttctggtttgcccagtgttgatcacaatataatgtttctttctaaaacaaggcgatttgatttacactggagtggttttgaaggcaaggaatagacagatactgtccaggaggtggcggaacatgggaaggtggtttctttcttttttccatgttgcccaggccagtctcgaactcctgggctcaagcgacttccctgcctcagcctcccaagtagctgggacgacagcattgcatgggaaggtggtttgagaagtgcaggcgtaatttattcactcggcaaccattaagtgggtacctgccttttccacggccctgttttgagtgctctgtatgtgtgtgaattcctctgatgcttttttttttcttttggagacagagtatctctctgttgtccacactggagtgcagtgctgcgatctccactcactgcaacctccgcctcccgggttcaagcaattctcctacctcagcctcctgagtagctatgactacaggtgcccgccaccacgcccggctaatttttgtatttttagtagcgacagggtttcaccaggttgcccaggctggtcttgaactcctgacctcaggtgatccgcctgcctcggcctccccaaagtgttgggatgaaaggcgtgagccacgtgcctggctgacacttgccttttccatggccctgttccgaatgctttatgtgtgagaactcccttgacccttgatccttctttttttttttgagacagagtcttgctccatcacccaggcagtgcagtggtgtgatcccggctcactgcaacctctgcctcctgggttcaagcggttctcctgcctcagcctcccgagtagctgggactgcaggcgcccaccatcacgcccggctaattttttgtgtttttggtagagacagggtttcacagtgttagccaggatggtctcaatctcctgaccttgtgatccacctgccttggcctcccaaagtgctgggattacaggtgtgagccgccatgcctggtttttttttattggagacagagtctctctctgtcacccagactggagtgcagtggcgcgatctcggctcactgcaacctctgcctcctgggttcaagcgattctcctgcctcagcctcccgagtagctgggattacaggtgcctgccaccacgcccagctaatttttgtatttttagtagagacaaggtttcgccatgttgggcaggctggtctcaaactcctgacctcaggtgatccgcccagctgggcctcccaaaatgctggcattacaggtgtgaggcaccgtgcacggcccactcccttgatccttacagaagccctgcgagagagggaaactgaggtacagggtggtccagtggcacatgtaaggacacacagctgcagaggcatgggtggggggtttgctgctgggtgggccgagcatgctctctctaagccgccggggacaggggagggtttttggtacctgtgtctgggggttgtggtcttgtggggcgtggtggtctggatatcagacatcctggtgtcggctttcaatcctggtgtgtttattgagaaacacagacggtggccttgtcggtggtcttggctcctggggcatctgccctgcctctgtgcccatccacgccgttctgtgatttgggagaggagtgtggagagggggtcctgactccccgtcacaccttagcatgtcagtctcctccgggcctcactgttctcatctggcgagtggggatgtgactgccatcattaggggagataggggtagaggaagggcaggtgctttatgggcctggaccctctgagcaccacccagtgggggcatctctgcctctgcccattagccaggttcatccttaagggcctcagattttgaccctaggaaattggcttatgttctttttgtttgtttgtttgagacacagtctcgctgtcacccaggctggagcacagcggtgtgatctcggcttatagcaacctctgcctcctgggttcacgcgattctcatgcctcagcctcccaagccgctgggactacaggcatgcgccactgcgcctggctaattttttgtatatttttagtagagacggggtttcaccatgttggccaggctggtctcgaactcctggcctcaagtgatccgcctgcctcagcttcccaaagtgctgggattacaagaatgagccaccatgcccagcctatgttctttttttctttctttctttcttttttttttttttgagacagagtctcgctctgtcacccaggctggagtgcagtggggtgatctcggctcactgcaacctctgcctcctgggttcaagccattcccctgtctcagcctcccgagtagctgggactacaggtacccgccaccacacccagctaatttttttgtattttcagtagagatgcggtttcactgtgttagccaggatggtcttgatctcctgaccttgtgatctaccctcctcggcctcccaaagtgctgggattacaggcgtgagccaccgcgcccggcttgttgtatattttttagtagagacagagtttcaccatgttggccaggctggtcttgaacttctggcctaaagtgatccgcccacctcggcttcccaaagtgctgggattacacgcatgagccaccgcgcccagcctacgttctttttttctttcttttttttttttttttttcagatggagtctctctctgtcgcccaggctggagtgcagtggcgagatctcggctcactgcaagctctgcctcccaggttcatgccattctcctgcctcagcctcccgagtagctgggactacaggcgcccgccaccacgcccggctaattttttgtatttttagtagagatggggtttcaccatgttaaccaggatggtctcgatctcctgacctcgtgatccgcccacctcggcctcccaaagtgctgggattacaggcgtgagccaccgcgcccagccttcttttttttagactgggtcttactgtgttgctcaggctggagtgcagaggtgtgatcatagctcactgcagcctccacgccccgggctcacgggatcctccacccagcctcttgagtagctgggactacaggtgccaccaccacaccctgctaattattatgttttgttttgtttttgtagagacggggtctccctgtgttgcccaggccggtctcaaactcctgggctcaagcatcctcccacctcagcctcccaaagcgctgggagtacacacatgtgagccactgcacccagcctgatgttctttaaaagcatcatatgggccgggtgcagtggcttatgcctgtaatcccagttctttggaaggccgaggcaggaggatcacctcaggtcaggagttcgagaccagcctggccaacatagtgaaaccccatctctactaaaaatacaaaaattagccgggcgggcgtggtggcgggtgcctataatcccagctactcgggaggctgaggcaggagaatcgcttgaacctgggaggcggagctttcagtgagccgagattgcaccactgcactccagcctgggtgacagacagagcgagactccgtctcaaaaaaaaaaagcattatatcacctttttctgagtgtgggcccctgtttcctctcatcctttcttgatctaggaaacctgtcatttgtttattgaacaaataaatgctccctcctcaccatcctcgtgctgtgcgggatcagcagggtctggaaagctatgcagcatcttctctgaggtgtgagaaaggcttcctcatccagtccatcatgaaccttttctgagaaggatgtttcagggttcatccaggcaggcagaaggatgcaccttgtggaaggactggcatgtgcaaagggctagaggtgggaaagcattggaagaagagaatgctctttggtgtttgttcctgctaggccttgagtgccaggatggggagtcatggatagtgtgtgagcaggggaggagcagtggctgacctggtcatcaaaaaaggcgctggcagctgaggagtgagcccagggaggagcaagtcatggccaagccttgattgtggctgcaggggcagcatgcagagaaatggcagagccagagggggcaggaccccacgtctaggagggcaaacacaggattccagaactgcgtgtggtcagtgatgcccacagggacggggctccctggctggggagaagtagcctggtccctggatacatgagggggtggagggcgtcctctaggaggatggctgcgtggacgtcttggtgtctgaggagtgtaaaatcaggccagagtggctgtctcccgccccagggtttcaagcagaaattcagggacagtcagagccagtcaccaggacagagcctggactgggtgggaagagggaaggggagctaggccttgggatggggaagacttagattagggctgggcatggtggctcacgcctgtaatcccagcactttgggaggccgaggcgggcagatcacctgagttcaggagttcgagaccagcctggtcaacatggtgaaacccccgtctctaccaaaaatacaaaaattagccaggcatggtggcaggtgcctgtaatcccagctactcgggaggctgaggcaggagaatcgcttgaacccaggaggaggttgcagtgagccgagattgcgccactgccctccagcctgggtgacagagcgagactctttctctcaaaaaaaaaaaaaaagaaagtttagattaggaccagagtgaggccagctgagtgggaggcgctgcatggtcaacagactggtggtgggacagggccaggcctgggagcccctcctgggtgggcagaggctgtgggcaatggaggcagagatgcgggaccctgaaggccggggagggacagaggcccagggttcttcagtaacccctgtcagggagcgagaagctgatgtcctcatcagtttgtattcaaacgcttccagccatggaaagtctcagggcagggccagcaggggtttcagcactccatgggggttgggaaggaccccagcccctggcctggctcttgttgagaaggctggcattcccattacacatgcacgtatacacacacgtacacaggtatgtatacacacgtctgtatgtatatcattcttaacagcttcattaaaatacatttcacacgctacacagtctggctgcttaaagtgtacagctcaggcgtttttagtacactgacagggtgtactttttttttttttgagacagagtctctctgtcacataggctggagtgcagtgacgtaatcccggctcactgcaacctccgcctcccgggttcaagtggttctcctgcctcagcctcctgagcagcggagattacaggcacgtgccaccacgcccggctaatttttgtgtttttagtagagacggggtttcaccatattgaccaggatggtctcaatctcttgaccttgtgatccacctgccttggcctcccaaagtgctgggattacaggtgtgagccaccgcgcccagcagagttgtgtatctttcaccacaattgtagaacattttcatcacccccaaaacaagccctgtccccattaggcatcccctcccgtccccctccccccagccctcggggagccagtccccttcctgtctctggatcggcaggtcctggacatttcgtagacatgggatcacacgctgcgtggccttctgtgtctggcgtctctcactgagcgtgatgtcctcaaggtgcatccgcgccgtggcctgggtcagagcctcgctcctgttcacggctgagtcatgtcccagtgcgtggacggccacattgcgtttacccacacatctgtggatggacacccgggttggtttatctgtgaatctgtagttaccccccgagatggttggagcttgtgctctgttcacactgaggagtccgggtcctactttacataagtgtaagtcgtgacagtgagtttctttaaaaagaagaggcagtgatcagatgacaggtggccctgggagtggcgggagtgtgagaagagggggccgggattggggggacctctgggtgggggcttcctctgaagatggaaagaccctaatcgactccctggggcagcaagcatttattgagcacctgctgtatgcctggtgccagggacatggcagggacaaaaatgacacagttgctgtcctagtgggaagacaagatcacgcctgtaatcccagcactttgggaggctgaggcgggcgaaccacctgaggtcaggagttcgagaccagcctggccaacatggtgaaaccccgtctctactaaaaatacgaaaattagccgggcgtggtggcatgtgcctgtaatcccagctactcaggaggctgaggcaggagaatcacttgaacccaggaggcggaggttgcagcgagccgagatcgcgccaccgcactccagcctgggcaacagagggagactccatctcaaaaaaaaagaaaagaaaaagataagtaaagtgatccgggtggtgacagctgcaggggtgcctggggctgaaaattaggacagaagaggcctaaatgaggaggtgacgtctgcagaaaggccttgggcctgaggcccggggaggtctgggtgaccgtgcaccaggcagcaatgcagccagcacaatggccctgcagtgggagctctgtgggacgtctcaggagtgtggctggagtgcagtcgcgtggggagggaccatggggcctctgcagcagggtttgccctgagaccctgctgaaagccagggaaggccccgttcacgcctcactgccccgtcttcccctgagggcccgggcagggtcccttcccaccccaggttaataggcaacaggtttgcttctctgcatctgtggcctgctttgacctccgtcttctcctctcccccggggtgatgcctctctgccgtaacccgtttagggttctcggtgccccagagactgggatggccctgggggcctccgtgctgcatcctgggagggctgggaggaggttccttcctggaaggctgcctggaggaggtggctgtgcttgagctgatcttggcggtggagaagggaaaggggaagctgggagctgatgaagggtgaggggctgacattggggcttggactccggggcttggagcagggcagggcggtggaggaagcagggccgggggtgccagcgctcaggggagacacaggctctgaggaccgaggatcaccgggactgggaagcagctggggtccagactccccgaactccatcccctgctgcccccgcaccccacacctcgcagccccgcgtgactcccccaccccccacaatggccaaggtcaccgtcagctctttcctttcaattagcagcaggaatgttcccggcgctgggctcggcgcctgcccgggcagggaccccctcgttctggctggagctgcccgggcgtgggttctggaaggacgagtgcgacgcccccatcccacacacgcccctcccgcctcggacagggcccgccctgctcgctgggtgaccttggccgttgcgtaacctctctgggcccttccaacaccaacgccccgcaccgcggaggcctctgcggggctcccgtcgggtttgggcctcatgaactcatctcctggagcaggactatctcacgcgctccagacgacgccctcgccgggccccgagccgcccacaccgccacacgccgtaaaaagcatcgcggggacgggaggcctgtgcgcgccggggtgggcgtcgggcggggggcgtggcgctccaggggctctgcgcggctgccgggagccagggaggctcggagacccagcacctgccccgggacccccagcacctgccctgggacccccagcagcaccaggaccgccgccgccctgagcttttccacgcctttgcccgggactcagctcctccgcccagcatgtaagaccttttgtgatccgacctccgcttccttccgtgacccctgcgccggggtcctggtcccagcctcgccgatcacacgggaatgagactcccccgcgcctggcgggccccgcccgcaggaggatgaacgccgggagaaggccgccctgcccggcctcagtttccccgtcggtgaaatggggctgacccggccgcaggagggagcgagcgctgggggaggcgttctcggtttgtggccgttttgatccgtgcgtcgtggtcatatttcgcttaatttttccaatctgtgacgtggagcgttctgtcggcctgaccttggctacccggcgtcgggggcgggtccacacccctcccggatggaagccccttcctgggcgggcgccccccggacgcccagacggggacccccctcccctcccccagccgcagcgcgggggagaaattcccgacccctcccgcccgtctaggccgccccaggcccgaagcctcggccccccccaatccccccaagcacaggccgggggcgggagatgctgcgccggccccacccccgcgcgccgggcctcggcgttgccatggggacggcgcggttgccacggcgaccgcctcccgcgggcccctccatccatcaccggggcggcggcgcccgggtctggggaggggcgaggggggcgcatcctgcgtgtcctggggaaaggcgagggggcgtccaggcccggggaggggcgaggggggcgccgggtctggggaggggcgaggggggcgccgggtctggggaggggcaaggggggcgcatcctgcgtgtcctggggaaaggcgagggggcgcccgggcctggggagaggtgaggggggcgccgggtctggggaggggcgagaggggcgcccgggcctggggagagtgaagggggcgccgggtctggggaggggcgaggggggcgccgggtctggggaggggcgaggggggcgcccgtgactgcgggggccaggggggcgcgtcctggggaggggcctgcgccctggggctgcttcccgcgcgttccctgcccgcccgcctgacattcccccgccctggccggccgggcagggacaggctgccccagacactaccgccttgtctccagcctgggaggcggccacacagccacactctgtccccgggtccggtctgagcggccacctgcctgccgggtggggacctgggcagtcggcgaccagcctgatcctggggcccaggagttccgccgttttgtggacctcccgccccagctctgctccctccggggtggccccgagcccacttagagctggaaaccaggactgtggggtggcccggggctgggcggttgttgttccaatctggctgtgcccagggccacgctgtgccctccctggacgtggcttccagccatgggaagaaggtgccgggcagggggaaccgtgtgtgagaggccctggggtaggaggcttggtgcatagccagggggccctgcaggagtagaccaacgggggaagtgaaggggccgacctgagggttcctctaagggctgatgggagccagggagcctctagagctggagagggacagggtctgattaattattattattattattgttattttgagatagggtttcactctgtcccccaggctagagtgcggtggcacgatctcggctcactgcaacctccacctcccgggttcaagtgatcctcctgcctcagcctcccgagtagctgggattacaggcgcctggcaccacccccagctaatttttgtatttttagtagagactgggttttgccttgttggccaggatggtctcaaactcctaacctcaagtgacctgcccaccttggcctcccgaagtgctaggattacaggcatgagccaccgtgcctggccttctttttttaattttaaaaaaattttttgtttgtttgttttgttttttgagacagagtttctctcttgttgcccaggctggagtgcaatggtatgatctcggctcaccgtgacttctgcctcccaggttcaagtgattctcctgcctcagcctcctgagtagctgggattacaggcatgtgccaccatgcccggctaatttttgtatttttagtagagatggggtttctccatgttagtcaggctggtctcaaactcctgacctcaggtgatccacccgccttggcctcccaaagtgctgggattccaggcgtgagccactgcacctggcccatttttaaaaattttcatttttttaatatatattttttgagacggagtctcgctctgtcgcccaggctggagtgcagtggcgcaatctcggctcactgcaagctccgccttccgggttcacgccattctcctgcctcagcctcccgagtagctgggactacaggcacccgccaccacgccgggctaattttttgtgtttttagtagagacggggtttcaccgtgttagccaggatggtctcgatctcctgacctcgtgatccgcccgcctcggcctcccaaagtgctgggattacaggcgtgagccagcgcacccggccttaaatttttatttttgagacaaagtcttgctctgtcacctaggctggagacagtggcacaatcacggctcgacccagcctcaacctcctggattcaagtgatcctcccacctcagcctcccaagtagctgggaccacagggacataccaccacacctggctttttatttatttagttagttagttatttttgtagagacaggctcttgctatgttgcccaggctggtctcgaactcctgggctcaagcgatccactggccttcacctcccaaaatgctggaattacaggcttgagccaccacacctggcctagggtctgattctctttttgagaagctgcctctggctggcgggtggagagggagctgtgagggggcagggagttggcagggaacactagaggcctgggctagggtggggaacttggggtaggcaggaagcgagggcccgggcctcaagggaacgcacagtggatggttcactgcctgcatcacccgttgctggggctgaccgagaactccagctgagctggctattcaggaagggcccccaagccagaaagctggatcaagcctttcctgaaccccacccggtgaaggcagctgaacccagcctccctgaggagggagaagggaaagccacagagggcgcagctggtgttcccgggcccctgggaggcaccgggaagggtaggtgtcacctgccaggaagggaggagccggtggggtcacctctggggcatgggagctggacaacttcacaggcctcagcagggccaggaaaccaaacccgagtggggtgggcaggcggggcgcctcgggctccagggaggtcttgacccggagcagcctcccaggcggggctgggggtgagccagtgcactgtgcagtttcattttctctgctgaactgggggaggggatgggggcacaagggggacgtcataggaggccttagagctgcaggcatctgtgcctccgtgtttgcgtggatggggaaactgaggcccagagaggcacgagggctctttggaggcagggctggctctgggccctgacaccaggctgagagggctgggggtggcagcagacacgaagggcaggctgtaatttcagtctctgggaagataagatgttgggggtcgggggaacctgtctcccacccctcacccctggttcccgccaggccctgcccgtcagcctgggcctccccctgttgatgccgcccagagcttgggacacccaccgccaacccctaccgtcctctccctgcctcgctgcaacagccttggaagcctgagggtcgctgggaaggtcaaggccaagctcagccccagtctagggctcggtgctccttgcgtttttctttttgttgttttgttttgttttgtttttgacggagtctcgctttgttgccctggctggagtgcagcgcgtgatctctgctcactgcaacctccgcctcctgggttcaatcaattctcctgcctcagctcctcaagtagctggttttacaggtgcctgccatcacgctcggctaatttttgtattttttggtagagacggggttttaccgtctctgttggccaggctggtctcgaacttccgacctcaggtaatccgctcgcatcggcctcccagagcgctgggattacaggcgtgagccaccgcgcccggcctgctttttgcattttactaagcacctactacgtgcagctttctgagggcccacagaccagggaggggaggggagggtttgggtggcaaagctcttcttctagcaggtgggaggggaagcgagaaagcagtggggtgggggtgccctgaactccgtgtgaaccacggggctgcagacagatgaggagaggggctctgcaccagcttctggagctgcagggcgaggttgctgtggggaggtcagagaaccacagaattcctcggttctttcctgggcgagtgagcgtgtggtgggtgcctggtgggggtggcgagggcttcggtttctggacctccttcccacaccacaaagggccctgtatctttgaagcctgaagcccggtcccttcaggcgtatccggcaacagtggtattcattcattcatttattgtttgtttgtttgtttgaggtggagtcttgctctgttgcccaggctggagtgcagtggcgcgatctcggctcatgcaacctctgcctcctgggttcaagccattctcctgtctcggcctccaagtagctgggattacaggtgccgaccaccacgcctggctaatttttgtatttttagtagagacgggggtttcaccatgttgggcaggctggtctagaactcctgacctcaggtgatcctcccacctcagcctcccaaagtgctgggattacaagcgtgagccactgcgcccggccattcattcatttttgagacagagcctcatgctgctgcccaggctggagtagggtggtggggtcatggctcactgccccctggacctcccaggctcaagcagtcctcccaccttagcctcccgagtagctgggactacaggcgcacaccaccacaccttgataatattttttatttttatttttggtagagatggggtcttactagattgcctaggctggtctcgaactcctgggctggagtaatcctcccacctcggcctcccaaagtgctaaaattacaggcgtgagcagctgtggttttgcttttgttttgttttgcgacagggtctcactctgttgcccacgctggagggcagtggcgcgatctcggctcactgcagcctcgacctcccgggttcaagtgattctcccacctcagccttctgagtagttgggagcaattctcgtgcctcagcctccacgcccagctaatttttgtatttcttggtggagacaaggttttgccatgttggccaggctggtctcgaactcctgacctcaagtgatccgcctgcctcagctgccccctgatatttgttaagcgcctaccacataccagccctgggaggtgaggctacagctgcactgggtgggctgttttcaaaagacaatgattgggccgggcgcggtggctcacgcctgtaatcccagcactttgggaggccaaggcgggcggatcacctgaggtcaggagttcgagaccagcctggccaacatggtgaaacccctgtctctactaaaagatacaaaaattagccgggcgtggtggcaggcacctgtcatcccagctactcaggaagctgaggcaggagaatcgcttgaacccaggaggcggaggctgcagtgagctgagatcctgccactgcactccagcctgggagacagcaagactccatctgaaaaaacaaacaaaaccacaatgattggataagagcgagtctggggttgaatccggacttggatcctttgctgtgcgtccttgggaggctcgtctccctgtctgggcttttgcaagcccaggcttgggaggtggggctggtgggtctttcatcctctgtttgcccctcctggggctgcagagtaggtcttggtgggcaggagggtgcagagaggactgtcctgatctgtcttatggtctgggccaggaggtgatacacttccttcttcccgaaacacccttctctggcctttgatgcctggtgaactcctatgtatccttggtggccctgcctcaatgtccccttctccccaaacccttcctggtcgctaggcagagcctcgtcccctcctgtcctggcttccttggccgctgagggggcagggagggccccactttacagaaggggaaactggggttcagagatgaaatcccttgccctggttacccctaggggaagaggcagagctgggatttgaaccgcgtctgacggacagcagggctcagtgaaccagagcttgaccttatctccctcccgcagggtcctggcggcagagaccacgtcccagcaggagcggctgcaggccatcgcagtgagtttccgccgccccgcagacggtgtggtcagggtggggaagtggggggacctggggtctcgggccctggacctgtcctaggacctggaaccagggcatggtgggtggtgagttatttgcttgggaaacttggatcctgctgacccgcagagaatggaagtggagaccccctgagtcggcagctcctggacccccggcctcgctctgcctgatgggtcggtggggaaactgaggctggcattccctggaaccctgccctcgtcctgcaggaaaataaactttggtgatgggagcacagatgtgctttggtgccatcttggtggcctctggcccaagaaggccctcttggtgtccgcagacccctctctgtgacccgaccctcctgtgacgtggcccgattcctgggttcaagtgactctcctgcctcagcctctcgagtagctgggattatgagtgaccgccacgacgctgggctaattgttgtatttttagtagagatggggtttcaccatgttggccaggctggtcttgaactcctgaactcaagtgatcctcccgccttggcctcccaaagtgctgggattacaggcgtgagccaccgtgcccggccagtcattgattttcgagacagggtcttgcgctgctgtcccgggctggagtacagtggtgcgatccgctgtcacctggaagccagtgggccacgaggatccccggacagaggaagcaggatcgggctgggcagagccttgtgtgggggtgggggggtctccgggacccccacgcccatccctgaccccacccggccctccccacaggagaagcggaagcggcaggcggagatcgagaacaagcgccggcagctggaggacgagcggaggcagctgcagcacctgaaggtacgagcggggcagggacccagggtcagggagtgcaggcggctgtgaggcggaggccccggactcctgcccaaccctgaccctgaccccaatcccaacctgaccctgaccctgcctccagccctgaccctgaccccgaccctgaccccgaccccgaccccgaccctgaccccaacctgaccccgaccctgaccccaacctgaccctgaccccgaccctgaccctgatctcagtcctgactctgaccctgacctgaccccaacctcaatcctgaccctgaccttgactctgacccagaccctgacccccaacctcgattgtgattctgacctcagcactgatcccaaccataaccctgaccccaaccttggtcctgcctcaaccccgaccctgatcctgaccctgacctcagtcttaagtcttaaccctggccctggtcctgcccacgactctgacctggatccctgctgctcagtccaaggcactgcgggagcgctggctgctggaggggacgccgtcctcggcctcagagggggatgaggacctgaggaggcagatgcaggacgacgagcagaagacacggctgctggaggactcggtgtccaggtgggggctgcagcgtgggtgccaccgggctgggtggggcctcgggggccgctggctcccgggagggtgtgggctgggaagagtcgtcagtgtgctttgagggagatgcgtggaccgggcaggccaggacccaacatgctttgagggggacgcaggacgggacagatcaggttggggcatccacctgggtctggggcagcttgctgggggcagaggctggctgcgtggcctcaggcagggagatacccctttcccttcccaccgccctcgtttgagccagcgagggacgtggcgtcgagctcctgggtccctggagctggccagcgggggacgtgacgtcgagctcgtgggtccctggagctgggtgttgccggcattggcctccctgggggcttcctggcgccagcccagctggcgggcaagcgctcccatggttcgaacgggatggatgcagagcagctgggcccgcaggaagctcgggcgggggcaggaaggggacaggatggggaaagtggcaatccctgtgggggctgggaccaaaggcctggagtttccggcgggcgggaggcccaggctgtgctcgggggcagcagggtcagggtggagggaagtgacgaccaagattccaaacgtctgccctggccagggaaggtgcccagaggcgggaggccggccggatcacacggacctcgcaggcccttcccagacgctgggttctgaccccgtgggggcccctccctgcccagttctgcccatttgctttgaagaaagcacgttgggggtgttcgggatggacttccctcctgggcagggcgtgtaaaggcatggacaggccgggtgcggtggttcacacccctgatcccagcactttgggaagccgaggcaggaggatcacttgagatcagaggttcgagaccaacctgaccaacatcgtgaaaccccatctttactaaaaatacaaaaattagcctggtgtggtggtgcccagcctgtaatcccagctactccggaggctgaggcagaagaaggccaggcgcggtggctcaagcctgtaatcctggcactttgggagaccgaggtgggtgaatcacgaggtcaggagatcgagaccatcctggctaacacagtgaaaccccgtctctactaaaaatacaaaaaaattagccaggcgtggtggcgggcacctgtagtcccagctactcatgagactgaggcaggagaatggcgtgaacccgggaggcggagcttgcagtgagccaagatctcaccgctgcactctggcctgggcaacagagtgagactgggtctcaaaaaataaataaataaataaaaataaaggcatggacatgctgggcgtgggtggggctcacacctgtaatgccagcactttgggaggccgaggcaggaggatcacctgaggtcagagatttgagaccagcctggccaagatggcgaaacccagtctctactaaaaatgcaaaaattaggtggattagtggcgggcgcctgtaatcccagctactggggaggctgaggcaggagaattgcttgaacccaggaggcggaggtttcagtgagccgagatcaagccactgcactccagcctgggggacagagcgagaatctgtctaaaaaaggaaggtatggacagggtggggcagttctggtgggtttggggccttggaatgagccgagtgttacccactccctgggcctcagtttcctcacctgtgaaccagggaggcaaaaatcccacggtgcgtctttttttttttttttttttttttttgagaaggagtctcgctctgtcgcccaggctggagtgcggtggcgcgatctcagctcactgcaagctccgcctcccgggttcacgccattctcctgcctcagccttctgagtagctgggattacaggtgcccgccacgcctggctaattttgcatttttagtagagacggggtttcaccatgttggttaggctggtctcgaactcccaacctcagctgatccgcccgcctctgccttccaaagtgctgggattacaggtgtgagccactgcgcctggccccactgtgcatcttaattccagcaaacattaagcaccagctgtgtccctgggctggacgggatgttcagaccgaggtggggctgagacgggcctggccctgtctgcagagaggtggatggtcagacacctgggcgaaggcagtgggagttactggccgtgggggctgggcacactggtgttcttttcacgcggccctagtgggcacaggctcaggcccctcgatggagggtgaagacctggcttgaggcctagtttgctttcagaggcttcagcttcacccctccccagggcagcctgcttctcaggtgctgaaactgagctgctctgggtctccactacccaccttctgcctgctcaggggctctgcccaggcacctcctgcaggaagccctccaggctgactgtgggctcccagacacctcctgcaggaagccctccaggcggctgtgggctggacccctcttctggttggaggggacacaagtctggctctgtgtccaacctgtcagcctgggcccaccttgttagacttacgcactcagccctcgtctgtcctgtcctcaggctgaggctgagctgccgtgaatgtcgcccgcccttgccagaccccggggctgggatttcatatcccggttttgttttcctggatctgcttgtcccgttatctcttctaatacttggaaagtgacatggtttttccagtttccctggtgagataaagtttcctgttaaaatgtgcaaatttgagcgggaaaggagagttcatttgatacagacagtgacataaacagcgcaggccaggggtcaggggacacagggagtcagccctggtttggatcccgcctctgctacctgctggccatgtggcttttgcactccgtgcctcagtttcccccatcatgaaagagcacgatgcctcttggggctgcctgggagccttaaattcagagagctaggccgagtgcggtgggtcacgcctggaatcccagcactttgggaggatgaggcgggcagatcacctgaggtcgggagttcaagaccagcctggccaacatggtgaaaccctgtctctgctaaaaatacaaaaaattagctgggtgtggtggtgcacgcctgtaatcccagctactcgagaccctgaggcaggaggatcacttgaacccgggaggtggaggttgcagcgagccaagatcacgccattgcactccagcctgggcaacaagagcgagaatctgtctcaaaaaaaagacactggggagctgtcgtacagaaggtgcccagagccccaccggggatgcaggagtcaccctcacaggcacaccctctccccaggttggagaaggaaattgaggtgctggagcgtggagactccgccccagccactgccaaggagaacgcggcggccccgagcccagtccgggccccagccccgagtccagccaaggaggagcgcaagacagaggtggtgatgaattcacagcaggtaagggggtgactggggggagcggatccccaggcacccactcccgctggccccagagcgaggccccagcccttccatgtcagcgtagctgaggggacaggcacagactagagccaggcacttgatttccagctcaccggagccacttcccagctgtgtgagccgggacacgtggtttcgccttgctgggcctcggtttccccatctgtaagatgggggagtaatcagagcagccaccgctgggggcatcagaaggactcagggaagcaggagacccacctgggggcatcagaagggctcagggaagcaggagacccacctgggggcatcagaagggctcagggaagcaggagacccgcctgggggcgtcagaagggctcagggagcagcaggagacccggtgctggtgggtgtggtcatagtgtttttttgcttttgttgttttttgagactcgttctgttgcccaggctggagtgtagtggtacagtctgcaacctccacctcccaggttcaagcaattctcctgcctcagcctcccaagtagctgggactacaggcgcctgccaccatacccggctaatttttttgtatttttagtagagatgaggtttccccatgttggccaggctggtcccaaactcctgacctcaggtgatccacccaacctcggcctcccaaattgctgggattacacgcatgagtcaccttacttggcctggttattttgtttctgtgtttgtttttgacacagggtctcactctgtcacccaggccagccagagtgcagtggcacaatcacagctcactgcagcctcgacttccccagctccagcgatcctcctgcctccgcctcccgagtagctgggaccacaggcacgcaccaccacgcccggctaatttctgtatttttggtagaaacggggtctctgctgtccaggctggggttttcatggtttctatcgatcacctgcatctgtttcatgtggccaaggctcctgaaagcccttcctgtgggaacagtatccccgtgtgatggaagtaaaaatcgcagcccacagaggcagagaggctggctcaaggccacacagctgagtggtccttagtggagtcggctgttaattctggcatctgccatctaagccagacgatgttaaaaccagacccttggccgggcttagtggctcacgcctgtaatcgcagcactttgggaggccgaggcaggcacatcatttgaggtcaggagttcaagaccagcctgaccaacatgataaaaccccatatctactaaaaatacaaaaattaaccagatgtcgtggccggcacctgtaatctcagctgctcgggaggctgaggctgagaatcacttgtacccagggggcagaggttgcagtgagctgagatcacgccactacactccagcctgggagacagagcaagattctttctaaaaaaaaaaacctggttctgggcacagtcctggacctcactgagctcacgtcaggtgggaagatggcgtgtattggggaccacccagggagggtggtcaggccgaagaggtgggaagcccagggcgctgtggaatccccaaggaagtgcctcattcgtgggagggctgggcaggcgacctggaggatgtgggtttcgtgggagggctgggcaggcgacctggaggacgtggggtggtttttttgtgtttttttttttgagacagagtttcactcttgttacccaggctggagtgcaatggcacgatttcagcaacctctacctcctgggttcaagtgattctcctgccttagcctcctaagtatctgggattgcaggcgcccgccaccacgcccagctaattttgtatttttagtagagacagggtttggccatgttggtcaggctggtctcgaactcctgacctcaggtgatccgcccgcctcggcctcccaaagtgctgggattagaggcatgagccaccgtgcccagccaaggaagtgggttttgaaggttgaataggagttctccaggtgcttttccctgaaggttgtttgagcatggactagtgctgtcatgggagactcagcaatacacatgcacggcccctgccttcctgacgggcacacccagtgacgtgatgagggaagagtgcactgagggagcatcagacaccacagccctgagacaggagtgtgtcccagaaacagcaagaagaccagggatgccagggcacagttcagggagaggggcctgtgtgcagggtctgaccatgcagggcagaacgggttcagacaggcgacactagaccctgagcctcgcacagtggctcccaggaggccaagggaggaggatcgcttgagagcaggagtggacgagactggagggggcacggaggagccggctggattcagggtggcctgcgggagccgctgatgcgggggtatgtggggagggagggaagaaatgagatggagcggacgtggtggctcagcctgtaatcccggcactttgggaggccgaggtgggtggatcacctgaggtcaggggatcgaaaccagcctggccaacatggagaaaccccgtctctactaaaaatacaaaattagccaggtgcgatgacgcaggcctgtaaccccagctactggggaggctgaggcacgagaatcgcttgaacccaggaggcggaagttgcagtgagccaagattgccccattgcactccggcctgggcgacaagagcgaaactccatctcaataaaaagaaaaaagaaagatgacctctgtgtttctggccagagtcccaagaggataggatgagaagcgggtgcgtatgacgtcacccactgtgccatgccctccccaggctcctgaccccatggctccccttcctcttcccggggatgctgacgcccctgacccttctctcttctttcttgcagacgccggtgggcacgcccaaaggtaggacctctggaaggaactcgtggggcctcggcgcactctggtggccagagaggggatggcagggcggggagtgaagctacaaagttgctcggtgcctcacgcctgtgatcccagcactttgggaggccgaggcgggtagatctcctgaggtcaggagttcgagaccagcctgaccaacatggcgaaactcagtgtctactgaaaaaatgcaaagacaattagccgggtgtggtggctcatgcctgtaatcccagcactttgggaggctgaggcaggaggatcgatcgcttgagcccaggagttcaagagcatgctgggcaacacagggagaccctgtctctgccaaacataaaaaaattagccgccggccaggcccagtggctcagacctgtaaccccagcgctctgggaggctgagacaggtggatcccttgaggtcaggagttcaagaccagcctggccaacatagtgaaaccccgtctctactaaaaatacaaaaattagccgtgtgtgctgcacgcctgtagtcccagctgctcgggaggctgaggtgggaggatcacttgagcccaggaggttgagctgtgatcgcaccactgcaccccagcctgggcgacagagcgagaccctgtctgtaaactgcatttcacggaacgtgtccgcttctgtatcgatagcgggacagccaccagccgggattgacgctggcgtctgaagtgcttctggcctggtttgttgtgtgttaattattcataaggagagtgtcttcttgtcttactgtagaattaaaaattaatcattaaaaaaatccagacaggcctctcagggattttgtgaaaatcactgggctgaggatgaggaatgaactgtgaggctgcctgtgggattttctaggggttgcggtgggggtccaggtgcctgtgtctgtgcggggcctgtgtctgggggcccaggtgcctgtgtcctggtgtctgggtggggtctgtgtgtctgggggcccaggtgcctgtgtcctggtgtctgggtggggtctgtgtgtctgggggcccaggtgcctgtgtttgggtgtctcggtggggtctgtgtgtctgggggcccaggtgcttgtctggatgtctgggggcccacaggtgcctgtgtccgggtgtctgggtgggatctgtgtgtctgagggcccaggtgcctgtctggatgtctgggggcccaggttcctgtgtccgggtgtctggatgggatccgtgtgtctgagggcccaggtgcctgtctggatgtctgggggcccaggtgcctgtgtccgggtgtctgggtgggatctgtgtgtctgagggcccaggtgcctgtctgggtgtctgggggcccaggttcctgtgtctgggtgtctgggtgggatccgtgtgtctgagggcccaggtgcctgtctgggtgtctgggggcccaggtgcctgtgtccgggtgtctgggtgggatccgtgtgtctgagggcccaggtgcctgtctgggtgtctgggggcccaggttcctgtgtctgggtgtctgggtgggatccgtgtgtctgagggcccaggtgcctgtctgggtgtctgggggcccaggtgcctgtgtccgggtgtctgggtgggatctgtgtgtctgagggcccaggtgcctgtctgggtgtctgggggcccaggttcctgtgtctgggtggggtctgggtgtcaaaggcccaggtgcatgtgggagtccggatgcacttctgtgaaggggcgttgggctgtctggggggtccatgtgacctctcctctgaccctcatctctctctccgcttccacctcccgtgcagacaagcgagtctccaacacgcccctgaggacggttgacggctcccccatgatgaaggcaggtgggttggcccccaggctctgggccccagatccagccgctgtcagggaccaagtctcggtccggggggccgggtggggcgggggcgacaccgacctgctctccgcagcgtctgacggggccgtggttatgggggtggcagctggaccgaggccgaggctccgagcctggggtgggggccccctctgctttgttgccctggtcccacgccggcccacgcttccccgagaagacgggccccacgcatggcggctctaaccgacgcgacctcacggctttcattccaccctaatctcacggctccctcctggggcccgctgggggtggcgctcacgcctgaacatgctcgctgcaaatcttacctgctccagtcctcgggcagtaggactggctgccccgggagaaagtgggtgccccgtccctggaggcaaccaagccaggtccccagcaccgctgcgcttccgagaagcaggggaaggtgggggttgacgctgagtgccacacggtgctcaagtcaggctcgaacccctggtctgccgccttgaatttctccgcctgccagaggggtgggacctcagtacgccatcctggggcccggcacaggacaggagcccaataatgagaaatcgtcgcagtgggcaaaaccactgctatgtgagtgagctggaacagcacagaaagaaggcagagggccgggcgtggtggctcacacctgtaacccaccccagcactttgggaggccgaggcgggcagatcgcctgaggtcaggagttcgaaaccagcctggccaacatggcgaaaccccatctctactaaaatacaaaaattagccgggcatggtggtgcacgcctgtaatcccagctactcgggacgctgaggcaggagaatcgcttgaacctgggaggcggagtttgtagtgagccaaggtcgtgccactgcactccagcctgggcgacaagagcaagactccgtctcagaaaaggcagcaaggcagggaggtgaagaaggactctggggtggctgcccaggacgggacagggctggaaggaaggagagccacccggaggcccaggtctccagcacggtccagggtgggggttgccccaggatgcagcagacagaggcatttgtcagagcaggtggtgcctgtgggcctctgtgccagtgagaccagccctggcagacaccgaggcccaggtcccccgctgatccccgtggccactgactttgtgcagtgcacaacctgctcaacagtgtgggcagctctggactagctgtctggggtggagggctgaggctgtgcagagctatagagttgaaaaacagtcgtcccttcacccagaatgcctttcaagcgcctgctgcatgccaggcattgggggagagggtattctaatgagggccacaacctctactacggtagaaaagtgaggccaaggacgttgagctggaggaaggagaatttgaaccagagggctcaggggaggggagcgttcaacgtaagaggtgacgtctgagcaaagacccagaggtgctgagggagcaaggcacgcagctatctggaggaaggtgtccaaggcacgcagctatctggggaaaggtgttccaggcagagggcacggccagtgcaaaggccccggggcaggactgcgcctggggtgttggaggaacggccaggagatccgtgtggctggagcagcgtgaggagggggagagggcggaggagagatgatggagagattgttgagggccctgtggcaggggcgggaggggacgtgggcttttcccgggagggaggcaggaaccatggggggctgcaggcaaagccgggactgccccgactccgtgctcacccacgccctctggtgactgcagggagaacagaccgtggacggtgccaggtggaggggacagggctgctgggggaggaggctgggatgggccgtggaggggcgagcagtgggcggttccttatgttctgaaggtggagcccccagggtttgaggagaaacgaggtgtcagggaggactggccaggcacggtggctcacgcctgtaatcccagcacctttggaggccaaggcgggcagatcatttgaggtcaggagttcaagaccagcctgagcaacatggtgaaaccccgtctctactaaaaaatagaaaaattagccaggcgtggtggctcacccctgtaatcccagcactttgggaggccgaggggggcagatcatgaggtcaggagatcgagaccatcttggctaacacggtgaaaccctgtctctagtaaaaatacaaaaaattagctgggcatggtggcaggtgcctgtaatcccagctgctcgggagccttaggcaggagaatcggttgaacctgggaggcagagattgcagtgatctgagatcacgccactgcactccagcctgggcaacaagagcaaaactttgtctcaaaaaaaaaaagagggaggactgagctgcccccaacgggtgggaagagccagggtgggggcaggtgtagggggcagattgggagtagtgttatggacgtgtgagagtggggcccctgtggataggggctgagtccaggtcaaggtccaggtggggatgggtgtgcgggagattagagccgagtgcctgggcgaggtccccggcgcagagcagagtccagggccgcagccgggcctaagcgtcgaggttgggtgggaggagggaaacgaggtggctatgggggccgaggggccaggcgatggcagggctgcccacgatggggaccgatggcccctcagaagtggtgaggacatgcagctatctggggggtgtgccaggcattgggaacagcctgtgcaaaggccctgaggctgggccgcacctggggtgcagtgtcatgggtcaggccagtcctggcagccctgttcagctcccgctgcggggcggggtctcagggaggtgcctggtgatccccagtgctcgtcatcttcaagcaggcctgggggtggcgggcagccaccagtcgctgttaggatgcaggctctgtgtggtttctgcaggaatgatttttacagagtggggcgaggtgctggctgtggagttagggccctgatgagtagcaagttcgactatctcaggagggttccttcattctgagtctaaatagatgacggcgtgtccaaccgttggctggaaggaggcgtcaagtcctgggagcttggatggtcggggcgggggctgtgggtctgcagactgagccccagtctccgccgtgaccccgggcaaggcaggatctctctgggattcacctgctcctctgagaaaccaggaatggtggggctcgagggctcacgtttataatcccagggctttgggaggctgaggtgggaggattgcttgagcccaggagtttgagaccagcctgggcaacatagtgagacccccatttccaaaaaagataaataaattagccgggtgtggtggcgcacacctgtggtcccagctacttgggaggctgaggtgggagaatggggtgagccaggaaggtcatgactgcagtgagctgtgatcgtgccgctccactccagcctggccaacagagggagaccctgtatctatttaaataataggctgggcgcggtggctcacgcctgtaatcccagcactttgggaggccaaggcaggtggatcacctgaggtcaggagtttgagaccagcctgaccaacatagagaaaccccgtctctactaaaaatacaaaaattagctgggcgtggtggcgggcgcctgtagtcccagctacgtggaaggctgaggcaggagaatcgctagaaccgggaggtgagtccagatcacaccactgtgctccagccggggcgacagagcaaggcggctccatctcaaaaaaattaaaaagatccgggaacaatgaaggctttccagatgggctgggctggaacctgagcttgacagacaatagtttggtggcgaaacagaggacacagtgcagagtacagggacgaggaccatctgggcggacagcaggatgggcctcaaatgccaaggagaggtgttcagactggtcgtctccaggcactggggagctatggagggatgtagagttggggagggccgcgtcgagaaggtgcccaggcatccccggctccgcctgccccatcgctgcttggctctgcgctgctggctcccccctccctggcttggccgcagcccggcgggggggtgcgggggcgggcaggccgtggtgtaaccccgtgactctcgtgccagccatgtactcggttgagatcactgtggagaaggacaaggtgacaggggagaccagggtgctgtccagcaccacgctgctccctcggcagccgctccctctgggcatcaaagtctacgaggacgagaccaaaggtacgagcaccccggcccctgccctccctccacctgggccagagccccgaacacgtgtgctcccagcgtgtgggtctggcgtctgccccggaatcaggaccccgattcgatgtgaagcagatgacgctgttcaggccagggcctcaccccctgtggcccacagctgggctcagaggtcgttcagccctgggctcactgcccaatcattcatccactccagaaagctgcctgaaagctgagccgggcaccaggtacccagctgggctctggagggaaatccggaggtagattcagcttctgtccttgccgggtggcaaaccgggcccttccatctggagctcctaaataattcgtttaaataattactgctagcccaagggctcacgcctttagtcccagcactttgggaggccgagggaggaggatcgcttgagcccagaagtttgagaccagcctgggcagcatagcaaggctccgtctctaccaaaaaaaaaaaaaaaaaaaaattaccctggcatggtggtgcgtgcctgtggtcccagctacttgggaggctgagatgggaggatcacttgggcccaggaggttgaggctgtagtgagccgtgatcgcaccactgcactccaacctgggcaacagagtgagaccctgtctcttaagaataaaaaataataataaagaattgctagcgtgacagaagccacagaaaatgcacatccagggggctgtgagaagtctcacagggtgaggatggggccgggggaggcttcccagaggaggcaagcaggggctcatcagagacacgcagtgcatgggaaccacacctggcagagccgcagcccctgcaaaggccctgaggtaggatggagtcagctgggctggagggctgaggggagttgggctgcaggagtgaggggagacgggctgcaggggtgaggggagacgggctgcaggggtgaggggagacgggctgcaggggtgaggggagacgggctgcaggggtgaggggagctgggctgcaggggtgaggggagacggggtgaggggagacgggctgcaggggtgaggggagacgggctgcaggggtgagggggaaccaggttggtcagggagttgaggagctgggctcacgcagggaggagaagggtgctttgcctggaggcagggggacaggcggggccgtgtcctgagggctttgggaagccttgggtgcgttgggtcctgacggtgctgaggtctaatttggttttaagggctcctcctagaggtcaagaggcaaacaggctgtgggagatgccagggaccccaggaggaggagggaagctccacactgaagccccactctctctctttctttttctttttatttatttactttctgaagaaagagtttcactctgtcgcccggcccgcagtgcagcgatgccatcacagctcactgcagcctccagctcctgggctcaggcgatcctcctgcctcggcctcccgaaatgctgagaccacaggcatgagtcactgcacccggcctctttttcttttatgagatataattcgcagaccataaaattccgccttaatgggaggctcatctgggcccgggacattgaggctgcaatgagctatgatggcacccctgcactccagcctgggccacagaccaagaccctgtctcaaaaacaagaaagaggagagaagccccatccccatcagctgtcacttcctgtcccctccccagtcagcgtcactccctatcccctccccagctctggcacccacgcatcccctcctgtctctctggattggcctgtcctggacatttcatagaaatgagatcacacggccgggtgcggtggctcacacctgtaatcccggcactttgggaggccgaggcgggtggatcacctgaggtcaggagttcgagaccagcctggccaacatggagaacccccgtctctgctaaaaatacaaaaattagctggacgtggtggcggacgcctgtaatcccagatactttggaggctgaagcaggagaatcacttgaacccaggaggcggaggttgcagtgagccgagatcgcgccactgctctccagcctgtgcgacaagagtgaaactctgtctcaaaaaaaaaaaaaagaaagaaaagagaataaatggggtcacacactgcacgtggccttctgtgtctggcgtctctcactgggcgtgacgtccccaaggtgcatcggcactgtggcctgggtcggagcctgactccttttcatggctgaatactattccacgggttgggtgggccatggtgggtttatcccttcttccatctgtagacagttgggctgtttctaccctttggctgcagtgagtagcatgctggggaatttgtgtgcaagtatttgttcacgcccctgctttcgaggcctttgggtgtacacgtaggagtgaactgctgggtcctgaggcgactgtgtggagctccgtgaggacctgctgttttccacggaggctgcaccgtcccgttcccacaggtcgtggatgagggcccagtttctccacgtcctcaccagcgctcgtagcccattctcgtggctgtcctggtggcgtgacgtggggtctccctgtggtttggattcccaaagccttctgttctcagaggcagcttggcctctgcggtgccccagatgctgtcagaggggtccccgcagcccagctctggagtggctttggggtgtggcgttggtggcatctcagctctagctctccccagctgtgtggccctgggaagtccccatgcctcgtcttccggatgaggtcctcacccccatcactccaccctcctcagcctcacctggtccctggggattccagacctgccaggctggacactggttgcttagcaacgggcaggtgatccgtttccatggcagccgagggctccaattcctgtcttggggcagcggccagtgggacacactgagttcagttccgcctgatccagacacaccccaccctctgggcctccagcccaaagtcattgagatgccttgaagcatggactcccctccctgggggcttagaaactgaaagtggagaacactttccttctggtctgtagccaggaacaggagccctgacccttggccgagaggaggcgagtccctgggaccccccttgcgtccctcccaactcccagcgtggcccaggcagccgtgtttctagaaggaatttgcagggctgtgagctagggctggtgttagatcatagcagggagccgtggggtgctgaaatccggtccttggagagtccaacacacctcaagaaatgtcaagtcagagacacacagataaggaaatttggaaagacttgagaaacacatttagcaagattgattatatgtataaaatgctacccagtggagaatacacattcttttcaaacacagaacattgtcagaaagtgaccaccgtggcccaggctgccaaggaggttttaggactgttaacagagtttgtatcttctgctctgtgttcctctcctccctgaaatttaaaaacaccctctaaataaattgtggcttcctgtggcaatcaatcaaactaggaattaaaaactatttacacttgaaaatgaataacattggccgggcatggtggctcacgcctgtaatcccagcactttgggaggctgaggcaggaggatcacgaggtcaggagatcgagaccagcctggctaacaaggtgaaaccccatctctactaaaaatacaaaaaattagccaggtgtggtggcaggcgcctgtaatcccagctagtcaggaggctgaggcaggagaatggcgtgaacccgggaagcagagcttgcagtgagccgagatggcaccactgcactccagcctgggcgacagagcgagactccatctcaaaaaaaaaaaaaaatagaaagtgaataacatcatctaactcgtaggacacagccaaagcagacctcagaggaaaatgcatagcctttagggaagctcctagaaaacaaaaataaatgaatgaaactttaactcaagttagaatgaatgaaaatttcaatttaagatcaatcaaatacacccatagatggaaaaaatcagaatccctgtaatggccaggcatggtggctcacacctgtaatcccagcactttgggaggccaaggcgggtggctcacctgaggtcaggagttcaagaccagcctggccaacgtggtgaaaccccatctctactaaaaatacaaaaatcagccgggcatggtggcgggtgcctgtaatcccagctactctggaggctgaggcaggagaattgcttgaacctaggaagtggaggttgcagtgagctgagactgcgccactgcactccaccctgggcgacagagggagtcaaaaaaaaaaagcagcaggcacggtggctcacgtgtgtaatcccagcaccttgggaggccaaagtgggtggatcacctaaggtctggagttcaagaccagactggccaacgtggtgaaaccccatctctactaaacgtacaaaaatcagcctggtgtggtggcaggtgcctgtaatcccagctactctagagactgaggcaggataattgcttgaacctggaaggtggaggttgcagtgaactgagatcgtgccattgcactccagcctgggcaacaagagcgaaactccatctcaaaaagtgaaagaatccctgtaacctccagttccccagggtgggtggtcctgtcttgtagaagagaaacaggccccgatgcggggaaggagcaggggtttggctctgtgaccttggcccagctgtgtcccttctttgaactttcatttttgctatctttacagcggaaatgaatccctacttttcagggtgatcacgtgggagctagttggctaaagaatatggaattacaggccaggtgcggtggctcacgcctgtcatcccagcactttgggaggctgaggtgggcagatgacttgaggtcaggagtttgagaccagcctggccaacatagtgaaaccccagctctattaaaaatacaaaaaattagccaagcatgttggtgcatgcctgtaatcccagctactcaggaggctgaggcaggagaattgcttgaactagggaggcggaggttgcggtgagccgagacagtaccactgcactccagcctgggcagctccatctcagaaaaaaaaaaaaaaaatcccaattcattcctttccactctttcttggttcctaataaatgtttttgtgcttataaattttcctcattgtcggctgggcctggtggctcacgcctgtgatcccagcactttaggaggccaagacgggcggatcacctgaggtcaggagttcgagaccagcctggccaacatggagaaaccccgtctctactaaaaatacaaaattagctgggcgtggtggcggattcctgtagtcccagctactcaggaggctgaggcaggagaatcgcttgaacccgggaggtggagcttgcagtgagctgagatcacgccattgcactccagcctgggcgacagagtgagactccgtctcaaaaaaaattttttttcctcattgtacggcattggctgcatccacagatgccaacagggggctttaattgtctgtcagttctgacggtgtaatctagttcgtgatttcctctttagcctggaggaggatacaagccttgccaaggtttccctcctgcctgagccaggtcactctctctgtccctcctgcctggagctgggtcattctctctgtctctccttgtacagtggtccatgctgtggacggcaccgccgagaacgggatccaccccctgagctcctccgaggtggacgaactcatccacaaagcggacgaggtcacgctgagcgaggcagggtccacggccggggcggcagagacccggggggctgtggagggggcagcccggaccacgccctcccggcgggagatcaccggtgtgcaggcacagccaggcgaggccacgtccggcccgccggggatccagcccggccaggagcccccggtcacaatgatcttcatgggttaccagaacgtggaggatgaggccgagaccaagaaggtgctgggccttcaagataccatcacggcggagctggtggtcatcgaagacgcggctgagcccaaggagcctgcaccacccaacggcagtgctgccgagcctcccacggaggccgcctccagggaagagaatcaggcggggcccgaggccaccaccagcgacccccaggacctcgacatgaagaagcaccgttgtaaatgctgctccatcatgtgagccggcccccgagaccccggcccccaccccacaccacagacacccaccagcccggcccctcccggcgcctgcccaccctccacccacagcctcacgggtccaggacttggcgtgttgttacatgttccttccgagttttctttcgctggaaagagggacaggggcccccacccgtcaccacgccccaacactccccccgaaccagagccgtgcacttgtgcctggtaggagagagacaggacagacccgcttttcccgagacaaggaccccccatgtcacggcagcttcacagacgcggctcgcgcccaccggggtcctggcgggtgggacccgcagcctccacgcggcccaggccagcctgccaccctctgggcctcctacctgtgcctttctctgaggggacaccccgccagagagggccccgggagccgggggtgggtactgaggcctgctcaggccctggaagtgaggctctatggggttccctggccaaggcgctggccccccaatctcaggcagttggggtgaggccgtgcctctttgggggctaaaggtcttgggtggaggacaggcccctctgctgtgcccctatgccctgtgtgggcccaaccagtggacaatggagtctgggggagggggaaccccggggacatgcccccacccgggaggggccggtaacccctgggctatcttctagacggggcgaaccaggggtcattgacctgccccctgcacagggcagggaccgagtgagccactccttgtcccgagctcccgcccccactgggccctccttcctcctggtgctaatttggggaccccaggggccgcccccggcctcttctccatcctgcttggaccagggtcctgggtcttcccaaccataccccgagatcaggccccacctgccagctctactgggcttggagcacgtccgggcagtggagggagggacacagcctgggacaggaagcctcttgggttggagcaggagaccctcatttgccacccagaccaatgtgagcctgcccccagccccctctcattggaagtggcaaggggcttccctcctgggggcagctacactcgtccccagaggcacattcgtgcacattctcacagacaccgtctcacacgttggctttggacaaccaggccccaacttggtccctgccctagggacctccagcctggtgcccagtgctcaggccacctcctggtccagtcaccacctgcagcctcggcagggcaggtacaggggccacctcagatgggagcctgggtccctgcctccgctctgcccctgggtggctgggaggagaggccctctcgggggtgacctgggcgtcagccgtggaaccccctcctcctccctggagtctgcctgagtccctcgagccgcgagccttcgctgaagtgcccttgctataaccccctctgcttctggtgtgtgacgaggcccccgatgttcttgattttcccagagaagcaaataaacagcgtgaacagccccagttcctggagttcttgcctttcaacctggcgaggaaggcgtggccaggccagggggtggggcctgccggcctttgagccattaaagggaggctgagcagggttgcggtgtgctggcttcacctgcctgcacccgctcaccctgagcgccttggggtggtgggaggcgctggaatccccactgtgcaggtaaggcctggctgtaaggggctgctgtgggggggcaggactggcttcccggggggccctcgggttctgcggccgccccgtcctgtcctttgttcctccctttgctgggctcacagcccctgggtgatgacagagggtcccctggacacccacaagctctgtagagaagccggcccctgggaaatacacaggaggcctggggaggaggtgtctgtagagaccagtgtcatgctcacgggaaggtgctgccccgccagccccactctctcacgctgtagtcttggagaagtcgctgcctcctctgggcctcagttttcccatctgtaaaataagccttcgtggccgggcacggtgtttcacacctgcaatcctagtactttgggaggccgaggtgggcggatcacaaggtcaagagatcgataccatcctggccaacatactgaaaccctgtctctactaaaaatacaaaaacttagccgggcgtggtggctcacgcctgtaatcctagctattcaggaggctgaggcaggagaatcgcttgaacctgggaggcggaggctgcagtgagctgagatcgtgccactgcactccaacctgggcgacagagcgagactctgtctcaaataaaataaaataggccttcggagccctgagtgggaggccagcctcagcctgggcgtgggacgtctccacagtgcccccagctcatgggcgatccagcctccaccctgctggggcctcagttttccccgatgaggtggtgagtgtggtggagagcactgctgagggaactcaggttccaattccagcctaaacccccgccattcctgaggcgcgattttaagctttccgtacctccgtttccctatctacaagccagggagaaaaggacgtgaagggggtggcgggaggcggcggtgggaggcgccgtgaggccgcgcaccctgagctttcacacacccagcagcgttaggtgccacgctgtcctttgggggccctttatccagatttgtccttaaacacccccatcttggccaggcgccgtggctcgcgcctgtaatcccagcactttgggaggctgaggcgggggcatcacctgaggtcaggagttcgagaccagcctggctaacgtggcaaaaccctgtctctactaaaaatacaaaaatagctgggcgtggtggctcatgccagtaatcccagctactagggaagctgaggcaggagaattgcttgaacaggggaggttgccgtgagccgagatcgtgccactgcactccagcctgggtgacaagagcgagactccgtctcaaaaaaaaaacacaaaaaaagcacccccctcctgagcagccctgctggattcgtagctgggggcctttttactcgaagaagagactgaggttcagaggggctccacaagcagcccctctggcgtaggtcaggacagagccccagcctggggaactgaagtccctgccccctcagctgtgttccctgccctcatagacggcgctaggcccagtggcccgacttccccacagatgctgggctccccacagtcccagcaaggcctctgcaccttgactaagaatccaggaggaccatgggcgcctgagggcctctgcgtccccatctctcggggtggcctgggtcttttgacggcctcgtgcggttcttttttttttttttttttttttttttttgagttggagttttgctcttgtcgcccaggctggagtgcagtggtgtgatctcggctcactgcaacctccaactcctgggttcaagtgattcttctgcctcagcctcccaagtagctgggattataatagcgtgccaccataccccgctaaattttgtatttttagtagagacggggtttcgccatgttggccaggctggtctcgaactcctggcctcaagtgatccgcccgcctcggcctcccaaagtgctgggattacaggtgtgagccaccaagtccggccccctcgtatgggtttttatgtggatggggcctagggaattcctcccagcagccctgagggagcccgggcgtgatgttcccccacgtcccggaggagaaaacagggctaagagaggtcaggtgggatcagaacccaggccacaccaaacccccccgagtctgccaaacctggtttatgcaagaagggggccatctaggggagttgccccaaggggtgggctgggccagaaggcacggacgggattgggactcagcccctccggccccccaggagacacaggccactgtgcacgctgagctgctgtgtggccctggacacctgctgaccctctctgagcggtgctgagaggcggtgggagggccaggcagccaagggaggtttcggctgagttctggctcctcggggccacctggaggccctgggggtggaggggcagccggcagcgggcacggtgcccgcccttgcccagcctggtatcctctttctccctcctcctcctctggactttgtttcctgatcccaggtggggctggggggagggggcacacctgcctcccctgggtggggcctctgttccctggcaacctggcgggcagggcggagctgggaggcctctgtgcccatcgaggagtcagagtggaggctgcagactgtggagccgggagccggcaggtgaggctgggggcgccccgggccgggccgggcggggatcctgtgtggggcggttggatccacatttggcgtgggagcgtcatgtgtctgtgggcggggtctgcttgcctggcggcacttgggatccagggaggccccctgccccaccccgtcaccctcggagcctccctgaggcacctttccctctgcccccgctaggtactctggggcctcaagggcacccactgggagagcagagaggcccttgtccctgaactctgctggggcttttgaaccccaaatcccagagccctccaagggaggggccgggttggcacccccatggtcagaggccagaggggcccctccatggttctgggaattccagaggcttctggagagatgcttatccgtcccaccaggcccctgactgggaggctctgggcagtaaacacccccgtggggctgggggctggtttggggacacggaggaggggtggctgagtacaggcggaaggagtctcaggccggggctggggacttggcctgggtcctcgggtgggggtgaggtggtagcctgggatcccgggcagccagcagggactcggcccagcgtctgccggtggagctccgcccaggagcccaaggagctgagatgactcaagggtgactgcaaccctgagggatgggaaaaaggaacggggccctcccttctgcatggcctccttgtctgagtctcggccccacaagggaacctttgcccctcacatagagccaactggctgatgaggaaggaggtgtggcaccagggtccataaacccagtttcattctggtatcaacagagttcagggtgaggctgggaggagcaacccagggggcttcctgtaggagggggtgatttggagcaaagtctgaaaactggcttcagacacttgctctgtcatcgctgtgtgacctcagatgagcaggttctcctctctgggtcccagctccctctctcgaaaaccggagtcgaaaacggttccaaggtgttgcaggaagagtctcaggacgccgaggtccttagccaccgccgggccttgcaggggccatcttccgtcctggggctcttcccccgagggcagcgccgctgcccaagaatgccggccatgagagccgccgtggatccaggggtttttttggccgacacagtgaaaccccatctctactaaaaatacaaaacttagccgggcgtggtggcgggcgcctgtagtcccagctacttgggaggctgaggcaggagaatggtgtgaatccgggaggcagaggttgcagtgaatggagatcgcgccactgcactccagcctgggcgacagagggagactctatctcaaaaaaaaaagcggggggcgggggtgggcactgaggcacaggcagcaggggagggggcccagtggccttgaacccaagagctggaccccaggccccacccgctggcttcagtgaatcactggggaggaatgagcagaggaggatgcgtgccttcatccccacccaaccccgaccccactgggagacccggcacctgctcgaggctgggcggacagctccctttctcccggagttgacgtctgatgtgggttataaatcccgctgtgtaaacgtctgtccactcactgggcaaacattcctacacccgccctccccggggagctccagggtgcagggcgtggacctgcccagcccttcagggccagaaggcacggtggagccggtctgcattccgcaatgagcccgacccccacgtctgagcagctgggatgagtggtgtttgcccagccagtatttattaggcgcctgctgtataccagactctgggctgcaggaagggtgctgacctgtggccacagcaggcgagagcgaggcctgggctgacggtttcgggtgggagaaggcaaggccttccgtgagctgggcaggcggcgtccacggaggaggaggcctcgggtcaggggagccatctgtgcgtcacgctttgggaggaagctcagctgtttgtgtgggatttattcaccaatgccgcctggttttcaatgtttcccctattttagtttctgacatttgatacgcgcggaagattgcatgacacattgcgtgtagtttcaacacggctccccacggtctctccactttatgctgtttgatgccactttccagttcagagaggggctaagtttttctttttttttctttttttctttttttttttttttgaggcggagtctagctctgtcaccaggctggagtgcaatggtgcgatctcagctccctgcaagctccacctcccgggttcacagcattctcctgcctcagcctcctgagtagctgggactacaggcgcccgccagcacacccggttaattttttttgtatttttagtagagatggggtttcaccattttagccaggatggtctcgatctcctgacctcgtgatccgccaaagtgctgggattacaggtgtgagccactgtgcctggccgaccctgtctgtttaaaaacaaaaaaaaatgctgctggttggtgtaaaggcagcagatctaaataatagccttggtggcccgggagcgacagtcctgctttgtgggggtttgtttttcttttgagacagggtctttctctgtcacccaggctggagtgcaatggcacaatctcagctcaccgcaacctccacctcacaggttcaagtgattctcccacctcagcctcccaagtagctgggattacaggcctgagcccctgtgcccagccgacagtgctttttttaggagtcaggagctcaagcttttgagatccctgtgtcttcaggtgaggcttcctttcctcaactatgaaagatgatgtctgctggacacggtggctcacgcctgtaatccctgcactttgggaggccgaggcaggcggatcacctgaagtcaggagttcaagaccagcctggccaacatggtgaaacccgtctctactaacaatacaaaaattagccgggtgtcctggctgggcgcggtggctcacgcctgtaatcccaacactttgggaggccgaggcgggaggatcacgaggtcaggagatcaagaccatcctggctaatatggtgaaaccccgtctctactaaaaatacaaaaaattagccaggcgtggtggcgggcgcccgtagtcccagctctagggaggctgaggcaggagaatggcgtgaacctgggaggcagagcttgcagggagccgagatcgcgccactgcactccagcctgggcgacagagtgagactccgcctcaaaaaaaagaaaaaattagccgggtgtgggggcgggtgcccgtagtcccagctactcaggaggctgaggcaggagaattgcttgaacccgggaggtggagattgcagtgagctgagatcacgctaccgcagtccagcctgtgcatcgcagcgagactctgtctcaaaacaaaagacaatacctaagacgggtgctgggtacaaggcctgacatgaaggaggtgttcagatgatggctctgggggaggggcaatctgggttacttcctggaggaggtgtccatgggcttcagcagaggaagccgtggagaagcagaaacaggcagcctcgagacagagagagctgcaggtagaggaggagggcgaggtttggggtggaggaagagggcctggtttggggtggaagaggagggtctggtttgggttggaggaagagggcctggtttgggtggaagaggagggtctggtttgggtggaagaggagggtctggtttggggtggaagaggagggcctggcttggggtggaggaagagggcctggtttggggtggaagaggagggcctggtttggggtggaagaggagggtctggtttggggtagaagaggagggcctggcttggggtggaggtgcccacagaaattggggtttcgtgctaaggccaggagcagggtgtgagaactgtgccctgcagatgccaggagccacagaagcgatgcgagcaggtgtgtgacctccgggaaggctcctggaactgagcccagcagcaacctggacccttgggagagggcgagagccggaaggcactgggtcagggtgtcacccgctcgctccacggccccacctgggcccagcgggacaaggtccacggtgttcctttgcccatcctggctttatggcgacaaggcccaggcggggatgttgtctcagatgggacgaggtgtccagctgggcagggcagggtggagaaccaggatgtgggagccgggaaactggagttgctgtcagtccttctctctgggcctcagtttctccatttgacatcccttagcaaggggccatctgtaattgtcagatggaaaaatcccacaccaggagtctcagagtgagctcagggtggaaaggctcagtgcacaggagacacagataaatatggtgcggccaaggaaggcttcagagatcaaggctgaggccaggcgcggtggctcacgcctgtaattccagcactttgggaggccgaggcgggcagatcacctgagctcaggagttcgagaccaacctggccaacatggtgagacctcgtctctactaaaaatacaaaaaattagccggacttgggaggttagcgcctgtaatcccagctactcaggaggctgaggcacgagaattgcttgaacctggaagcagaggttgcagtgagctgacattgtgccactgcactccaggctgggcaacagagcgagactccatctcaaaaaaaaaaaaatcaaggctgagctggactccacagggcaggtgtgtgtgtctgggagataaggtgggcagggcaccctgattttattgggctgcaaatgttagaaacatataatgcgagttgttggggtagtaaccgggacattcagagattcaggtatggttggaatcagggagcttaaaagttttcaggatgctttgctggtgttggggttgctgtcaagcaagctgtacccactgggggcatttacgtccccagcaattcactatctcattccatcagcctaacaagaccagcgggaagagggtcccatcttctgcattaattgtaaagtcccagggtctcatgtcattggctagactgggtcacatgctcatctctgaaccaattacagaggccagagggtgaaatgctctcactggctggactaggtcacttacccatctttgaaccaatcacagaggccagtgggtgggatgctctgattgatcaggatgagtcacttacccatccctgaaccaatcacagaggccagagaatgggctactctgactggccaggctgggccatttactcatccttgaaccaatcacagaggccagaaggtgggatgctctgattggccaggctgagttacttacctatcccttagccaatcacagagattagacaatgggctgctctgagtggctgtactgtgtcacgcacccctaaaccaatcacagaggttagagaatgggatgcactgattggctggactgtcacttacgcacccctaaaccaatcacagaggttagagaatgggctgctctgagtggctggactgtgtcacttacccatccctaaaccaatcacaaaggccatttgatggaccctttgccctttgggggactggaggctgttcctctccctaggtgctctgacttgatggccctcatttccttctcctccctcagtaagcccagaggtctccaccccacgggaggaaggctgaggccaagaccccggaagagatggaccgcgtgaccagataccccatcctgggcatccctcaggcacaccgtggcaccggcctggtgctggatggagacaccagctacacataccatctggtgtgcatgggccccgaggccagcggctggggccaggatgagccgcagacatggcccactgaccacagggcccagcagggcgtgcagaggcagggggtgtcctacagcgtgcatgcctacactggccagccgtccccacgggggctccactcggagaacagggaggatgagggttggcaggtttaccgcctgggcgccagggatgcccaccagggacgtccaacatgggcactccgcccagaggacggggaggacaaggagatgaagacctaccgcctggatgctggggacgctgaccccaggaggctgtgtgacctggagcgggagcgctgggccgtcatccagggccaggcagtcaggaagagcagcaccgtggccacgctccagggcactcctgaccacggagaccccaggacccccggcccacctcggtccacgcccctggaggagaacgtggttgacagggagcagattgacttcctggcagcgagacagcagttcctgagtctggagcaggcgaacaagggggcccctcatagctccccggccagggggacccctgcaggcacaaccccaggggccagccaggcccccaaggccttcaacaagccccacctggccaacgggcacgtggttcccatcaagccccaggtgaagggggtggtcagggaagagaacaaggtgcgtgctgtgcccacctgggccagtgtccaagttgtggatgaccctggctccttggcctcagtggagtccccggggacccccaaggagacgcccatcgagcgggagatccgtctggctcaggagcgtgaggcagacctgcgagagcagagggggcttcggcaggcaaccgaccaccaggagctggtggaaatccccaccaggccgctgctgaccaagctgagcctgatcacagccccacggcgggagagagggcgcccgtccctctacgtgcagcgggacatagtacaggagacacagcgtgaggaagaccaccggcgggagggcctgcacgtgggccgggcgtccacacccgactgggtctcggagggtccccagcccggactccggagagccctcagctcagattccatcctcagcccggccccagatgcccgtgcggccgacccagctccagaagtgaggaaggtgaaccgcatcccacctgatgcctaccagccgtacctgagccccgggaccccccagctagaattctcagccttcggagcattcggcaagcccagcagtctctccacagcggaggccaaggctgcgacttcaccaaaggccacgatgtccccgaggcatctctcagaatcctctggaaaacccctgagcacaaagcaagaggcatcgaagccccctcggggatgcccgcaagccaacaggggtgtcgtgcggtgggagtacttccgcctgcgtcctctgcggttcagggccccagacgagccccagcaggcccaagtcccccatgtctggggctgggaggtggctggggcccctgcactgaggctgcagaagtcccagtcatctgatctgctggaaagggagagggagagtgtcctgcgccgggagcaagaggtggcagaggagcggagaaatgctctcttcccagaggtcttctccccaacgccagatgagaactctgaccagaactccaggagctcctcccaggcatccggtgagaaggggctccagggagtggctgcttggctcagggtctcagaggttggagcaggggagggtggggaggtggagtttgaggctgtcaaagggctggggttggggagacattgcctcctgactgttcatcccctcagtcgctggtttgtctgcctgtctattaaaaatgtagattttggagagaaatgtcaactttaccttagggcttttgctttatggatttggatgccttgttgttaggcgcataaatgttcatatatgttttgtgtgttttgtttttgtttttgttttttgtttttcggttttcttttttgagacggagtctcgctctgtcgcccaggctggagtgcagtggcaggatctcaactcactgtaacctccacctcctgggttcaagcgattctcctgcctcagcctcctgagtagctgggattacaggtgcccaccaccactcccggctaatttttgtatttttagtagagacaggtttcatcatgttggccaggctggtcttgaactcctgacctcaggcgatccaccctgccttggcctcccaaagtgctgggattacaagcatgagccactgctcccggcctgttcatatatgtttatcctcttggacagttgcacctttttgacaatatgaaatattccttgtgtcacttttaatgttttttttttttttttttgagatggagtctcgctctgtcacccaggctggagtgcagtggcgcgatctcggctcactgcaagctccgcctcccgggttcacgccattctctcgcctcagcctcctgagtagctgggactacaggcgcctgcctccacgcctggctaatttttttgtatttttagtagagatggggtttcaccgtgttagccaggacggtctcgatctcctgacctcgtgatccacccacctcggcctcccaaagtgctgggattacaggcgtgagccaccgcgcccggccacttttaatgttcttcaccttgcatgtcggcccatctgtgcatccagtttctcctgactggctactttggtcaatctgtcagtttcccggatagtcatctgctctgtctgtccatacatctgtctccttagctgctggctagagactctgtctcccgagcagaggtctgacaaatgttctaatgttctgccctccctgctcccctacaggcatcacgggcagttactcggtgtctgagtctcccttcttcagccccatccacctacactcaaacgtggcgtggacagtggaagatccagtggacagtgctcctcccgggcagagaaagaaggagcaatgggtgagtctggaacccgtctctgcagaggccaggctgaggtcagacagcccctattagggccacaggaagttcaagcaggactcaagcctgacctgggttcaagcactacccccacccctggccgtgcctcagtctcctgcagatgtcaggtagaagatgataaacttggtgtccttgtatctctgggcttctgcttggagaggccatataagctggggtctttgtccccatcaggaggtcatctccaggatcaaagaccaaaggaccaactctgcttggaggaggaggacactggcaatttgtcatcgtcaccagcattagtttctttttttttttttttttttgagacggagtctcactctgtcgcccaggctggagtgcagtagcacgatctcggctcactgcaacctccacctcccgggttgaagtgattctcctgcctcagcctcctgagtagctgggattacaggcgtgcaccaccacgcccggctaatttttttgtatttttagtagagacgtggtttcaccatgttagccaggctggtctcaaaccgatctcaagtgacctgcccacttgggcctcccaaagtgctgggattataggcatgagccactgcacctggccacagatatttacttctaagaaagagagagagagagagagaaggcaggagggagggagggatggagggaaggaaggaacaaagcgaggaaggaagggagggagggagagggagagacggagggatgtgtctgtcacacgctggctcggggcttccaatgaaccacacctttagcaccctggtggtctcacatgcccagggttaggcagctcatgaacccaggcttgactccaggacctacaggccacagagctttgccttaggggttttactttatgaattttgatgccttgttgttagacatgtaattgttcatgtatgtttatcctcttggatgagagctccttttgtcagtatgaaatattcctcacgtcacttttaatgacacgaggaatatttagtgccatgaggaatattatgtccttttttttttttttttttttttgagatggagtctcgctctgtcacccaggctggagtgcagtggcacgatcttggctcactgcaacctctgcctcccgggttcaagcgattctcctgcctcggcctcccgtgtagctggaattacaggtacgtgccaccactcctggctaaagggaggctgctagggaggctccatccgggaggtggaggttgcagtgagccgagatcgcaccaccgcactccagcctgggtgatagagcaagactcagacccaatataaataaataaattaattaattaaattaaataaatcatgaatgttggacagaggctgcactgaggggaacagcatgaggaacagcaagggggatggctgtgagtctgggtgatcgtgggacacgtgttgagaacactcagggcaggggatgccttccactcttccccaaatggtgacagagagggctgtgtgggagctctggtcggactctgcaccgggcagggcagaaaggcctgggctgacttgtgttcctttcctgtagtacgctggcatcaacccctcggacggtatcaactcagaggtgagtatgctcctgggcacgaagactcaagtctttcccccccacatctgtgcccctgcacacaggggccaacggaagccccttcctccaggtgtggggatcgtattgggtgtcttctcaattggtagtgtctgctcagggtggattttgctgtgatctgcttgtgatgtctgccatgggcatggattaggagaagagggttcacatgccacctctccaccacgtggtgaaggtttgtgaggttagaccccaaacaaaggcaatgttgctttttttttgtttttgtttttgtttttgtttttgagacagagtctcgctctgtcgcccaggctggagtgcagtggtgcgatctcggctcactgcaagctccgcctcccgggttcacgccattctcctgcctcagcctcccgagtagctgggactacaggcgcccaccaccacgcccggctattttttttttttgtatttttagtagagacggggtttcaccgtgttagccaggatggtctcgatctcctgacctcgtgatccacccgcctcggcctcccaaagtgctgggattacaggcgcgagccaccgcgcccggccaaggcaatgtttttttgggaggatggagtctcgctctgttgcccaggctggagtggagtggcttgacctcggctcactgcaacttccgcctttcaggttcaagcgattctcctgcctcagcctcccaagttgctgggattacaggcacccaccaccatgcccagctaatttttgtatttttagcagagatggggtttcaccatgttggccaggatggtctcgaactcctgacctcaggtaatcctcccgcctccacctcccaaagtgctgggattacaggtgtgagccaccgcacccagccaaaggcactttctttgaggaaggtatgcatctgagactattcaagccaagccccctcagtcggtttatggcacacgtgtgtggccctcctttttatttttatttttttttatttttacttttttgagacaggctctcactctgtcacccaggctggagtgctatgatgtggtcccagctcactgcaaccttgacctcctgggctcaagcaatcctcccacctcagcctcccaagtaggaacataggaatgtgccactgcacccagatagtttatttttatttatttatttatttatttttgtacaggcagagtctcactaggttgcccaggctggtctcgaattcctgcattcaagggatcctcccacctcagcacaccaaatttctgggattataggcatgagccactatcgcctgacccctctttgagctgaatccgaaatgccaaatacattggacaggcacggtggctcacgcctgtaatctcagcactttgggaggccgaggcgggaggatcatgaggtcaggagatcgagaccatggtgaaaccccatctctactaaaaatacaaaaaattagccaggcgccgtagcgggcctctgtagtcccagctactcaggaggctgaggcaggagaatggtgtgaacctgggaggcagagcttgcagtgagccaagatcgcgccactgcagtccagcctgggcaacaaagtgagactccatctcaaaaacaaacaaaaaagccaaatacagacatttttcctgccctggagctcagcatgagttagcatattctttgatcatattactaggagtagagggtctgaaacagaggaggggatcctactttacccccgttctaggcctctctaatgaattggcagttggaggagacatcttgggggtgtggtaggacctggatcgggggaattcatgcctcctttttgcaggtcctggaagccatacgggtgacccgtcacaagaacgccatggcagagcgctgggaatcccgcatctacgccagtgaggaggatgactgagcctcgggatggggcgcccaccccctgccctgccctgaccctcgtgggaactgccaagaccatcgccaagcccccaccctaggaaatgggtcctaggtccaggatccaagaaccacagctcatctgccaacaatcccaccatgggcacatttgggactgttgggtttttcgtttccgtttctatcttcctttagaaatgtttctgcctttggggtctaaagcttttggggatgaaatgggacccctgctgattctttctgcttctaagactttgccaaatgccctgggtctaagaaagaaagagacccgctcctccactttcaggtgtaatttgcttccgctagtctgagggcagagggaccggtcaaagagggtggcacagatcgcagcaccttgaggggctgcgggtctgagggaggagacactcagctcctccctctgagaagtcccaagctgagaggggagacctgcccctttccaaccctgggaaaccatccagtctgagggaggaggccaaactcccagtgctgggggtccctgtgcagccctcaaacccttcaccttggtgcacccagccacacctggtggacacaaagctctcacatcgataggatcccatgaggatggtccccttcacctgggagaaaagtgacccagtttaggagctggaggggggtctttgtcccccacccccaaactgccctgaaataaacctggagtgagctgcctgccttggtccctgcctggtccggacaaagtcccctgggcctccactctctgtttcattttcttggcgacattaggttccaccccgctaggccgtgagcctgtggggctgtcaggttcccatgggggggttgccagcatctgcatgcagtaggtgcttagctgatgcttgttgagtgactgacaattgatcatggagaggcaccttcagcaacaccaggcccggggcccaacctcaccagcccggctcctccagccccgtctcaccacgtccatcgcagtacccagggtgcttattaagcatttgctgaatccctcaccactctggtctcagaggaggccggagggtcattaattcggctccgcatgtataccaggctcacatccagggaagccagatcctactggtcagaggcgtgggcgctggacccaagtcctggctctgctgcctgctgtgtggccttgggtgggggggggtcctctcactgccccatgcctcagtttccctctgacacacagggataacgataggaccaggctcccgggcagtaggagttaatttacgtaaagctctcggcacatggggaccattgacgttggattcagtgcctgatggcaggggcgtgtcctcagacaccccccaaagcaggcctcggcccccaggctcccccaaccctgctgggagcagcgggtgttaattacacctaggccagtgtctcctccttggctgctcagtgtccgctgcgctgcctcagggaaaaccgcgcagccacgccgggcccaggcaggcagatgtggaaccgaaatagctgggcagtgggggctgtggggaccctggggaggcgggggaagggggctgaggggctacatctgggcagagcagagactgagggaggagggagagcccctgtcttcagggagaccccagtctgatggaggaggcatctgccttcacagagatcccaggctgatggaggaggcccctgcccccagggagaccccagtctgacggaggaggcatctacccacagaggggccacagtctgacggaggaggcctctgccctcagggagaccctatctgatggaggaggcatctgccctcgggggaccccagtctgatggaggaggcaggttatgtgaccatagagggaggctcagtggccatagttggtgacttctttcatgtcggggcaattctattccaaccccaagaaccaaacgtggggcctgcgggaagggagggcctcacacacagtcctgggtgagtcccatcagtttctccactgtctgccaccccatcttcccccgatgccccatgttctgtccctctgtccctgtgctctgaggatgtgtgagcctccactggctactataacaaatcaccacccacctaatgacttaaaacagcagacatggttgggcgcagtggctcacgcctgtaatcccaacactttgggaggccgaggcgggcagatcacctgaggtcaggagttcgagaccagcttgaccaacatggtgaaagtccgtctctactaaaaatacaaaaaattagctgggcctggtggcaaatgccagtaatcccagctacttgggaggctgaggcaggagaatcacttgaactggggaggtggagattgcagtgagccaagatcgtgctattgcactccagcctgggtgacagagtgagactctgtctcaaaaaaaaaaggcaatctctccctgtctctctcaggctcaccttcctgcctcctctcgtgagggccctatgaggacactgggcctccatgtcacccaggatgttctcctgtctcacggtccattactcagtcccatctgcaggtgcttctgccacgagaggtgacacggccacaggtcccggggattaggaaagggatgtctttggggccattgttctgcccaccagaggatctcgacatcccccttctccgtgactcttcagtcacctctgctcagggccggccaggactgttgcacaggctgtgccctgcacaagccccctgccaagaccaaagggcaaggctctgtgtgcggccagggtccccgtcttcagtgtccctggccctggctgtggcctgttgccagacaccgcgtcaccaaggggtgcattattcccacatcatcccagttggacggtcacctcaccctgcccatcgtcctgccagcaagatggtcccacagcggcctcagttctcagaggctcggcagggtctcccctgaccccgtaatgcccctcactgcccctgggcgctgggttcaagaagaaccgcctgcttcgttgcaggaagtgatgtccacccccaactctggatcggaagccacgatctatcctccagacccaacaccaggtccccagccctttatctctcctgtctgtctgtccatttctggtgttcaggcctctctctccacgtctatctccctgtttctgtccctcctgacctctctctttttccatgatttttgctttcctccctccccgtctcatcctaaatttgtttttttgtattttgttttttttttgagacgaagtctcgctctgtcgcccaggctggagtgcagtgacgccatctcagctcactgcaagctccgcctcccgggttcaagggattctcccacctcagcctcccgagtagctgggattacaggtgcccgccaccacgcccggctaatttttgtatttttagtagagacggggtttctccatgttgggcaggctggtctcaaacccctgacctcaggtgatccgcccgcctcggcctcccaaattactgggattatgggcgtgagccaccacgcccggccctcatcctaaattcttaaaacctgctctcctctcagccatgattttctttgtcctgtgccataaagaattctcagaagcaggatgcagcttctgctgctcaagggtgagcccagccagtgggatctggtgtcgctgcccgcagacccctcagtcaagagcggggtggggggcagcaggagctacagtaacagcccggatggtcctgctcctgaaggcaccccaccctgctgtccagaggagagaccgaggctcagacatttgagccccacataacccagcctgccacacaccgcagactccaacagtgtagcccctgtaccccagaagtcacttcagcaaatcactcagggctccacctcacatctgtccccaagtccttggggacttgctcactcagcagaagaccaagagaagccagatgcagtggctcacacctgtaatcccaacactttgggaggctgaagcgggcggatcacctgaggtcaggagtttgagaccagcctggccaacatggtgaaaccccgtctctactaaaaatacaaaaaatagtcaggtgtggtggtgggcgcctgtaatcccagctacccgggaggccgaggcaggagaatcctttgaacccaggaggtggaggttgcactgagccaagattgtgccactgcactccggcctgggcgacagaacaaggctccgtcctaaagaattaattaattaatttaaaaataaaaagaaaatgtgcactttcatcttgtattattctgtccttttgtttgtttgagataaagtttcgctccatttgcccaggctggagtgcgtgatctcggctcaccgaaacctctgcctcctgaattccagtgattctcctgcctcagcctctcgagtagctgggattacaggcccacgcccccaccatacccagctaattttgtacttttagtagagacagggtttctccatattggccaggctggtctcgaactcctgactccaggtgatccacttgcctcagcctcccaaagtgctgggattacaggcgtgagccacctcgcccggcctattctgtcctgtttttttaagatttagtttgccgggcacagtcactcacacctgtaatcccaccattttgggaggccgaggcgggcggatcacaaggtcaggagatcgagaccagcctggccaatgtggtgaaaccctgtctctactaaaaatacaaaaattagccgggcgcagtggtgcgcacctgtaatcccaattactcgggaggctgaggcaggagaatcgcttgaacccgagaggcggaggttgcagtgagccaagatcgcgccacggcactccagcctgggcgacagagcaagactgtgctcaaaaaaaaagatttagtttaattcctgtaatgagtcagccccttggaaaatcagacagaattctgcctgctgagcagacacattccagaagttactctgtgagaggtttagacgaattcctagtgaaatttccaggggcgggagagcgtgtctggaaggtctgcggacatcacagcaatcacagaggcctttggggcgggcaaaactgtccgctggcgctcgctgctagcaggagggagttcatattctttcctggtttcctcctggctcagtgtatcatgatatgccagggaaaggaggagaattctcttttttgtttgtttggttttttgagacagagtctcacgctgttgcccaggctggagtgcagcggcgcaatctcagctcaccacaacctctgcctcctgggttcaagcgattctcctgcctcaacccccggagtaactgggattacaggcacccaccaccacgcctggctaatttttgtatttttagtagagacggggtttctccatgttgggcaggatggtctggaactccagacctcagatgatccacccgcctcagcctcccaaagtgctggggttacaggcgtgagacactgcacctggcctcaactccattttaattaaccctgcaggggccaggcatggtagctcatgcctgtaatcctggcattttgggaagctgaggcaggaggtggatcacctgaggtcaggagtttgagaccagcgtgaccaacatggtgaaaccctgtctctaggaaatacaaaaaattagctgggcgtggtggcaggtgtctgtaatcccagctactcgggaggctgaggcaggagaatcacttgaacccaggaggcaaagatcgtggtaagccgagatcgcaccattgcactccaggctgggcaacaagagcgagactccatctcaaaaaataaaaataaataaataaaaaataaataaaaataaaaaaaattagccaggcgtggtagcgcgtgcctagtcccagctactcaggaggctgagacacgagaatcacttaaacccgggagatggaggttgcagtgagctgagatcgcgccactacactccggcctgggcaacagagcaagacttcgtctcaaaaataaataaataaataaataaataaaataaagagatttaggagaggacacaagcaaacataactcagactgactttggcaaaactaggctttatgggttcccgtaactgaaacatcaatgtagggccagcttcaggctcagctggttccaggtgccacacagcatcctcaggttccttcggtgttgggagctcaggctccaagcccaggacagattcccagctctgccacatgcccctgagggaccctgggcaaggcctacccctctcccagcctcagtgtccttatctgtaagtgaagtcgccacattgacatccctgccctgggggacgtcatgagggtcaccgggcacctggtgaaaatcagtgaggaataagaatgaatgttgaggccaggtgcggtggctcacgcctgtaatcccagcactctgggaggccgaggcgggcggatcacgaggtcaggagatcaagaccatcctggctaacatggtgaaactccgtctctactaaaaatacaaacaattagccgggcgtggtggtgggcgcctgtaatcccagctactcgggaggctgacgcaggagagtggggtgaacccaggaggtggagcttgcagtgagccgagatcgcgccactgcactccagcctgggcgacagagcgagactccgtctcaaaaaaaaaaaaaaaaaaaaaaaagaatgaatgttggttctgaccaagtaaattaacgaattgtcaccagacaatgacttccatgtgactttctggtgtgagccggagaggagccgatgcacgctgccaccagagggcggcaaacaccaaggatgcagccgcggccctcgccccgccagggagaaaacgcacctgccgccactctcaccttctcattcccgtaaccggatggtgtttgcttagtgctccttgaaagcctggacagggccgggcgcggtggctcacgcctgtaatcccagcacttcgggaggccaagacgggtggatcacttgaggtcaggagttcaagaccagcctggccaacgtggcaaaaccccgtctctacttaaaaaaaaaaaaaaaaatagccgggtgtgatggcgttcacctgtaatcccagctactcaggaagctgaggcaggagaattgcttgaacctgggaggtggaggttgcagtgagctgagattgagccattgcactccagcctgggtgacagaggaagactccatctaaaaaaaaaaattatttgtagagatgacagagtgagactccatctaaaaaaaaattatttgtagagatggggttctcaccatgtttcccaagctggtcttgaactcctcaagtgatcctcctgcctcatccccacaaagtgctgggattactggtgtgagccatcgagcccagccctgaccaactatttagaggttgaaaacagagcccgcagggccgggcgcggtggctcacacctgtaatcccagcactttgggaggccgaggccctcggatcacgaggtcaggagattgagaccatcctggctaacaaggtgaaaccctgtctctactaaaaatacaaaaaaattagccgggtgtggtggggggcacctgtagtcccagctactcaggaggctgaggcaggagaatcacttgaacctgggaggaggcggagcttgcagtgagccgagatcgagccactgcactccagcctgggcgacagagtgagactccgtctcaaaaataaaaataaaaataaataaataaaattagccggaagtggccgagtgcggtggctcttccacagcagccagagggcgcctgtgaggctgactgggggtgtccctgctctgcccacagccctccatggctcccatttccctctgggtagaagcccaagtcctccgtgcagcccacaaggctctgcccagtcccctctctcctctccctcctctgtctactctccctcctccctgtctccccctcctcctctgcccagtcccctctctcctctccctcctccctctctcctctccctcctccctccctatctccccctcctcctctacccagtcccctctctcctctccctcctccctatctccccctcctcctctacccagtcccctctctcctctccctcctccctttctccccctcctcctctacccagtcccctctctcctctccctcctccctgtctccccctcctcctctgcccagtcccctctcctctccttcctccctgtctccccctccctcctccctgtctccccctcctcctctgcccagtcccctctctcctctccctcctccctgtctctccctcctcctctgcccagtcccctctcctctccttcctccctgtctccccctccctcctccctgtctccccctcctcctctgcccagtcccctctctcctctccctcttccctgtctccccctctgcccagtcccctctctcctctccctcctccctgtctccccctcctctgcccagtcccctctctactctccctcctccctgtctccccccttcctctgctccagccacacgggcctcctccctgttcctccaacttgccaggcggggtcctgccccagggcctttgcctccccaggtgaggtccggccccagggcctttgcacggccatgtcctctgcctggtttcccttccctaggtacccactgggttcatttcttcacttctttcaaggctttggtgaacgctcccctcatcacacagctgttgctcagtaaatatggcagaataaatagctgggcagggctcagtggctcatgcctgtgatcctagcacttctggaggctgaggcaggaggctcacttgagctcaggagttggagactagcctggccaacgtagagagactccatctctacttagggtgaccaggggagagaacaaaatcatgggctcattttttttttttttttgaaatggagtcttgctctgtcgcacaggctagagtgcagtggtgagatctcggctcactgcaacctccacctcctgggttcaagcaattctcctgcttcagcctcctgagtagctgggattacaggcacatgccaccacacccggctaattttgtatttttagtagagacagagtttcgccatgttggccagggtggtctcgaactcctgactgcaggtgatctgcccgcctcaccctcccaaagtgctgggattacaggtgtgagtcactgcacccagcaaaaaatgtttattattcccatttcacagaccagcaaactgaggcccagagggagccgcctgaggaaactggattgcgcagctgatggagtctcaaccagagaaggggcccgtggggcctagattcagacttccggctgtgcaggcaagcaggagggccccccagtcagggtccccaggacaccaaccccaagccaaatgaggccaccagaggctgtgcccagccccagtcccgcacggggcaggtgtggagcaaatgctggcgggatagagggatggagaagggggctgcctgggagtgaggggctgggtgccccacccacctggcctcagcctcctgccctatccgagaacagagctctggtttcctgcccggcagcccgtgaggagcagcgaggcatggccagctgggggccggacagtcctgaagagcttgaggactggctcctggctcctaaagcatagcgccggctctggggatctgccagggagagaccagctccagggcccctggatgcaggttagagctcaggctgtcccctgatggcctcggtgctatgggtgagtttctccacctctctgtgctcagcctctcaccggagagggggtgggtgatcctggcctgagtaggtgaccaaggcatcctcctctgtggctggtatttcccaacaccctcaataaattcacaggtggctcaggcctgtaatcccagcactttgggaggccaaggcaggcagatcacctgaggtgagcagtttgagaccagcctggccaacatggtgaaaccttgtctctactaaaaatacaaaaattagggccgggtgccatggcacatgcctgtagtcccagctactcgggaggctgaggcaggagaatcgcttgaacccgggaggcggaggttgcagtgagccaagattgtaccacttcactccagcctcagcaataagagcaaaactccatctcaaaacaaaataaaaaataagggcgcagtggctcatgcctgtaatcccaacactttgggaggccaaggcaggcggatcacaaggtcaggagattgagaccatcctgaccaacatggtgaaacctcgtctctactaaaatacaaaaaattagctgggcatggtgacgggcgcctgtaatcccagctactcaggaggctgaggcaggggaatcgcttgaacctgggaggcagaggttgcagtgagccgagatcctgccactgcactccagcctgggtgacagagcgagactccatctcaaaaaaaaaaaaaaaaacaaaaacaaattggtttgtttattttcctgttgatttgtgggagttctttatatattctggacctgagtccttgattacattatgcactgctagctagtaccttctcccagtctggcactttccttttgagtcttcttctttttttttttttttttttttttttctgaggcgcctgccaccacacccggctaatttttgtatttttagtagatacggggtttcaccatgttggccaggctggtcttgaactcctgacctcatgatccacccgcctcggcctcccaaagtgctgggattacaggcatgagccacagtgcctggccccttttgagtctcttaatggtgtctttggacaaactcatttgttcaaaataaaatgcaatttttttttttttagatggagtctcactctatcacccaggttagaatgcagtgggacaatctctcccaggctcaagcgtctcttctgcctcggcctcctgagtagctgggattacaggtgggtgccaccacgcccagctaattttgtgtatgtttagtagagaccaggtttcaccatgttggccaggctggtcttgaactcctaacttcgagatccgcctgccttggcatcccaaagttctgggattacaggcatgagccactgtgcctggccatgttaggatatttctttttttcttttcttttcttttctttttttttttttttgagagtctcgctctgtcacccaggctggagtgcagcggagccatctcggctcactacaagctccgcctcccaggttcatgccatctcctgcctcagcctcccaagtagctggaattacaggtgcccaccaccacgcccagctaattttttgtatttttagtagagacggggtttcaccgtgttacccaggatggtcttgatctcctgacctcatgatccgcccgccttggtcccctaaagtgctgggattacaggcgtgagccaccgcgcccggcccatgttaggatatttctgagcaaatctgagggtttggcctggaaccctcaatttgaggttgcaaaccctgtttcctgctaagccagacagatggtgctggagatggggaggccatggtttatgttttgtccactctgggtgctgcctggacaggtgactcatgcatgtggcggagcagtccagagtgaggactgtacccctacagacactcccccagaccatgctggtggcctgagctgggggctgcccaagtcccctccccgggatccacttctggggcctcccaagccttccctggggtcagtgagtgctggaagggcagccagcagtgtgtgtccacgggggggggcgggtcaccacttatctgggcattaaatatttgggggggtctcaaaataatggaaaacagggggccagaagtggtggctcatgcctgtaatcccaacactttgggaggccgcagtgggaagatcgcctgaggtaaggagttcaagatcagcctgggaaacatagcaaaaccctgtaatgaaaaacccaaaaattagcccggcgtggtggcaggtgcctgtgatcccagctactcgggaggccgaggcgggaggactgtttgagcccaggaggttgaggctgcagtgagctatgattgcaccactgctctccagcctggacaacagaacgacccactttctcaaataaataaataaataaatacgctgaggccaggcgcggtggctcacgcctgtcatcccagcactttgggaggccgaggtgggcggatcacgaggtcaggagattgagaccatcctggctaacatggtgaaacccccgtctctactaaaaatacaaaaattagccaggcgtggttgcgggcacctgtagtcccagctactcgggaggctgaggctggagaatctcttgaacccgggaggctaaggttgcagtgagcccgagatcacaccactgcactccagcctgggtgacagagtgagactctgcctcaaaataaataaataaataaatattaaaataaatagggccgggcacggtggctcacacctgtaatcccggcactttgggaggctgaggcaggtggatcacgaggtcaggagatcgagaccatcctggctaacatggtgaaaccccgtctctactaaaaatacaaaaaattagccaggcgtggtggcgggcgcctgtagtcccagctactcgggaggctgaggcaggagaatggtgtgaacccgggaggcggagcttgcagtgagccgagatcgcgccactgccctgcagcctgggggacacagcgagactccgtctcaaaataaataaataaataaataaataaataaaaataaaataaaataaaataaattaattaattaaaatagagatgagatctgcctctgccgcccaggctggagtgcagtggcgtgatcatagctcaccgcagcttccaactcccgggctccagcaatcacaggacaaacctcccgcccggccctgcagccaggtgctcacaccagccctatttataacaggaatccatggaaatttctggccccaccaagctgctgtcatgaataagtcatcgtccggatcaatgattccacccagggagcatctgcaagtttccacctcgttctccctgggccccggacagcctggctgggacgtcagagctaccagtcaggctgcggaaacagcctgggggttcctctgtgaccaaaccattccacgccgtggtctctacccagagaaaggaaaacacaggtccatacgcgtgttcgaggcggcatgattcataacgaacaaaaggagaagacaggccgggcgcagtgcttcatgcctgtgatcccagcactttgggaggccgaggcgggtggatcacgaggtcaggagatcgagaccagcctggccaacatggtcaaaccccatctctactaaaaatacaaaagttagccgggcatggtggcaggtgcctgtaatcccagctactcgggaggctgaagcaggagaattgctctagccagaagggtggaggttgcagtgagccaagattgtgctgctgcactcagcctgggagtcagagcgagcaagactccgtctttaaaaaaaaaaaaaaaaagaaaaattcagccgggcgcggtggctcacacctgtaatcccagcactttgggaggctgaggcgggtggatcacaaggtcaggagttcgagaccatcctggctaacacggtgaaaccccgtctctactaaaaatacaaaaacttagccagtcgtggtggcgggtgcctgtagtcccagctactcgggaggctgaggcaggagaatggcgtgaacccaggaggcagagtttgcagtgagctgagattgcaccactgcactccagcctgggcaacagagcgagactctgtctcaaaaaagtaaaaaaaaaataaaatagatgtatataaaatatataaataaatatatataaatatatatataaatatattttttcttttttttttggatggagttttgctcttgtagcccaggctgggtgcaatggcgtgatctcggctcactgcaacctctgtctctcgggttcaagcaattctcctgcctcagcctcccaagtagctgggactacaggcgcccgccaccacacccagctaatttttatatttttagtagagacggggtttcaccgtgttagccaggatggtctcgatcttctgaccttgtgatccaccctcctcgacctcccaaagtgctgggattacaggcgtgagccaccgcgcccggcctattttttaaaagattatggatttagggcacctcctcccttctccttttagccccagataacattccattctcgatgtttatctgctcgcctgccgaaggacgttttggtggcttccagggctgggctgttatgaatagcagagctgcaggccgggggcggtggctcacgcctgtaatcccagcagttcaggaggccaaggtgggagggttgcttgaggccaggcaatcgagaccagcttgggcaacacagcaagaccccaatctctaaaaaacatacaaaaattagccaggcatgatggtgcacacctgtggtcccaatggttccagccactcaggaggctgaggtgggagaatcacttgagcccaggaggtcgaggctgcagtgggctatgactgcaccattgcacctcagcctggacaggaggacaagaccttgtctcaaaaaaaaattttttttttgagagggagtctcactctgtcacccagggtagagtgcaatggtgagatctcggctcactgcaacctccacctcccgggttcaagcgatcctcctgcttcagcctccagggtatctgggattacaggcgcctgccaccacgcccagctaatttttgtatttttagtagagatagggttttgccatgttggccaggctggtctcaaactcctgacctcaagtgatctgcctgcctcagcctctcaaagtgccgggattacaggcgtgagccaccatgcccagccaaaaaaaaattttttttttaaataataaaatagaggctgggagtggtggctcacgcctgtaatcccagcactttgggatcacctgaggtcaagagttcgagaccatcctggccaacatggcaaaaccctgtctctgctaaaaacacaaaaattagctgggcgtggtggcttgtgcctgtaatctcagctacttgggaggctgaggcaggagaagcgcttgaacccaggagccggaggttgcagtgagtcgagattgtgccactgtgctccagcctgggcaacagagcgagagttcgaatcaaaacaaacaaaaaaagccacaggcggccacacatagaccgtcactgacctcctggagcttctcttctcagggaaaggaacttccagactcagaaaactggggcaggaaacatccaggccagtttttccagcccaccggatctcaggcagcttccaggaggattgcctgaactcgctgaaattgcccaattccctcctgggcacatggttttcagatgatgaacacacaccctgcaccggggctgaggcctcaccctggcgtttgaatcctgggccccgggtttagtccacaggaggagaagccacactggctgctgggagggaatgggaagcgggcagccgccgtggaaaacatggatcagtgcttcagaaagccagacagcggcgccgtctaaccccaccgtgcggctccgaggaatccaccccagataaccgaacacagcggctctcaataaacatgttcacagcagcatgagccacgggagccaggggtggacggaaacagtggcacgagccacaggagccaggcgtggaaggaaacagtggcacgagttacgagagccaagcgtggaaggaaacagcagcatgattcacgggagccaggcatggacggagtccacaggagccaggcgtggaaggaaacagtggcacgattcacgggagccaggcgtggatggaaacggagaggagcagagagcaaggctctgacgccagccacagcgcagatgcaccctgaggatgtagggctcagacggatgcccgacacgaaaggccacacagcgtgtgatcccatttccatgaaatgtccagggccaggcgtggtggctcacgcctgtgatcccagcactttgggaggccgagccggcggatcacgaggtcaggagatcgagaccatcctggctaacatggcaaaaccccgtccctactaaaaatacaaaaattagccgggtgtggtggcgggcgcctgtagtcgcagctactcaggaggctgaggcaggagaatggtgtgaacccaggaggcgcagcttgcagtgagccgagatcgcgccactggattctagcctgggcgacagagcgagactccatctcagaaaaaaaaaaaagaaaagaaaagaaaaaggaaaaacagaattaagcattgtagtgaataattcagtgggatttggtgccttcacggtgctgtgctgctgtcacctctaattccaggatattcccatcatcctttgtggttggggcatcatctgtcactccccatcccctccccatccctgagaatccatgcatccccttcctgtctctgtggcttggtctgtctgtcctggacatttctttttttctttttgttgttgttgttggttttgtttgtttgtttgttgtttgtgggttttttttgagacggagtctcgctctgtcgcccaggctggagtgcagtggcacgatctcagctcactgcaagctccacctcccgggttcacgccattctcctgcctcagcctcccgagtagctgggactacaggcgcccgccaccacacccggctaattttttgtatttttagtagagatggggtttcgccgtgttagccaggatagtcttgatctcctgacctcgtgatcagcctgcctcggcctcccaaagtgctgggattacaggtgtgagccactgcgcccagcctagccttttatttttaatagagatggggtcttgctatgttgccacgctggaatttttttttttgaggtctctctgtgttgcccaggctggagtgcagcggcacgatcttgacccaccaaaacttctgcctccctgcttcaagcgattctcccacctcagcctctggagtagctgggattacaggtgcccgccaccacacccggctaattttgtatttttagtagagatggggtttcatcatgttggtcggggtggtcttgaactcctgacctcaagtgatccgcccgcctcgccctcccaaagtgctgggatgacaggcgtgagccaccgtgcccggctgcccacactggaattctatgttataggaacttcatctcactgaaagaaaaaggggactcctggatgggtcctgaatttagacatttatttgttcatgaaacaaacgctgatggggccgttgcacacccaggtctgcactggccgccctgtggggccccggaggggcgggggcagggagaggccgcctgagaggcagtggcccgggtggaggacccagggctgggcctggcgatgctccgactgcagcttccggagaacaatctcaggtccacaatgtggagacgttggcagatgctcctgctgaggaccgacagacatcatccccgcttcatcctgctttttcctcccatgaggaggtcaaagtcacaccgtggggccaggcccggtggctcatgcctgtaatctcagtactttgggaggccaaggtgggcagactgcctggacccaggagttcaagaccagcctgggcaacatggtgaaatcccatctctactaaaatacagaaaattagctgggcgtggctgggcatggtggttcacgcctgttatcccagcactttgggaggctgaggcgggcggatcatgaggtcaggagatcgagaccatcctggctaacagggtgaaaccccgtctctactaaaaaatacaaaaaaaaaaattagctgggcgtggtggcaggcgcctgtggtcccagctactcaggaggctgaggcaggagaatggcctgaacccgagaggcggagtttgcagtgagctgagatcacgccactgcactccagcctgggcgaaagagtgaaactccgtctcaaaaaataaaaagaaaagaaaagaaaagaaaagaaaattaggccggtgtggtggcacacacctgtagtcccagctgctcgggaggctgaggcaagagaatcgcttgaacccgggaggcgagggttgcagtgagccgagatcgcgccactgcaagactccgtctcagaaaaacaaagtcgcacaggagagtcacgtccaccccctgggccaccggacagtcgccacagaccaggcagctgaatccccgctctacagacaaccccatcaaggctggggcagtgagacgctctgaaggccacaggcccccaggatcccaccccgtccgtctctccctccctgctgtccctctgtgagccacaccctgcggctgtcagcggcagtgatgggggctgcaggggctggggacagagggggatgagtttccagccaggcggcctgggagggtagctttaatccccacctcggttttgtcttagaagcagttgcatggctgtgctccaggccgtccagggttcaggctgagccaccgtctaggtctagacgtcagtgtccatcaggacctggcgtgccctgcaagcagacatgtgctccttcgacctccgtcaaccctggagatgaagcagggaaggggccctggctggaggcttggacatccatccggaggggcggagtggcctcgaggcggtgtgtgagtccccggggaagatgcaggggacgctgggtggccggtggcacgagtgaggctcggggtcccgcagccccccgtggtgtgggtgcctgagttggggggtcctcgaggaggacaagggagggaactgaagggggccaggacacccggtagcttggctgccgggggctctgtgatatgctaagtccctcctgctcaccactaaacccaagaggaaaaggaattcctggcagagtccaatttaaagtcaacaaacaaacaatgtgggaaggagagaaggaatcccaggaatgtgggcgaggtcctcctcccgccggggccaccctggacccggcgagaaatcgaaggtcccccaaggacccacgtccaggagccaacagcctctctgtgcaaaccagacaaccctgcaggaactgtgcttgaagaaaccgtggaaactgcccccaaccctcccgtctctatttctttctctgttttattatctcattcttggctgtgaggtaaacaggagaaaatgagaaggtggttctggaggacccgaccgaatttgctttcgtgacagggtcaagcgccctttcctcgccggccgcagccctcaccaaaggggatttgggggcctccggacaggggtcctgaaggttttgaattgttcaatctctgggggtacaggaacccctgcaggaggtttcaaaggcaagagtttcgcagagagaaaaaaaccatgaactttgcaggttggtggcggaatctggtgatttaagaaaacgtgtttaagcctcggccgggccgcgcctgggctgtctgcggtgctcttccggaattctctacaatatctggaagtgaccaagaaaattccagaacccggaggctgcgccgtggagataaacatgggcacctgggtatgtttgtttttattgttaggacctattttatcacaagcaaaaaaaaggaagctgcccagaaatccaggggtgatggatagaaggcgatggggcctgcagtggcccaacggattctagaattttcctctaggaagatgcccgggaattttaaccctgttggctcgacccagaagctcggggtggcagggaaaggatcactgtggccttccttccttccttccttccttcctggaatttcgctctgttgcccaggctggagcgcagtgacgtaatcatagtttgctgcggccctgaccccaatggcacaaatgagcctcctgcctcaatctcctaagtagctgggactacaggcatatgccactacgcccggctaaattttttttttttttttttttgagacagagtttccctcttgtcgcccaggctggagtgcagtgtcgcaacttcggctcaccacaacctccgcctcccaggtggaagcgattctcctgcctcagcctcccaagtagctgggattacaggcatgagccaccacgtctggctaatttttgcatttttagtagagacggggtttcgccatgttagccaggctggtctcgaactcctgaccttgtgatccacccacctcggcctcccaaagtgctgggattacaggcgtgagccactgcgcccggcccattgtttatttatttatttttgtagagacagggtctcgctgtgtcacccaggctggagtgcagtggcaagatcacatcccactgcagcctcgacctcctgggctcaagtgatcctcctgcctcagcctcctgagtagctgggaccacaggcatacgccagcacgcccagctaattaaaaaaaaaaaaaaaaaactttagcagccaggcacggtggctcactcttgtaatcccagcaatttgggaagctgaggcggacagatcactagaggtcaggagtttgagactatccctgtctctactaaaaatacaaaaattagccaggtgtggtggcgcacatgtaatcccagctactccggaggctgaggcaggacaatcacttgaacccgggaagcagaggttgcagtgaggtgagatcgtgcccctgggcgacagagggagaatccatctcaaaaaaaaaaaaaaaaaatttccggatggggtctcgccacgttgcccaggctggtcttgaactcctgagctcaagtgattctctcacctcgacatcccaggttggtggattacaggcgtgagccacagtgcctggccctggcttttcttcttgtttgtcaggctctgctgttgtgataggaaggcttgaggacttcaaaggggcggctggtgtgcggggttggggacgatggcagggacaggagggaggtgctgttggcatgtgtggaatgtggcattggcgctggatggacgggtctgtgtgcgctgactgcgtgtccgatgccagggcctgtgttccccctgcacgtccccaggaaggaactgctggaccagcagaatgaggggccaacgccaggggcagcactgcccggccacagaggactgtggccccacagatgacaccctcagctaccagctcctgcatctggaagatgaccaggaggaggaaggacggtctgcaagtgttcaaagtgatgtttccaggccgggcgcgcttgtaataccagcatttgggaggctgaggcaggcggatcacctgaggtcgggagttcgagaccagcctgaccaacgtggagaaaccccgtctctactaaaaatacaaaattagccaggcgtggtggcgcagctactcgggaggctgaggcaggagaatcgcttgaacccgggaggcggaggttgcggtgagctgagattgtgccattgcactccagcctgggcaacaagagtgaaactccgtctgaaaaaaaaaaaacctctataacatccaaaatactaaccacttgttacctctagattgtttggggatgttagatttctcctttgttgccagctcttttatttttatttatttatttattattattattattattattattattattattattttgagatggagtcttgttctgttgcccaggatggagtgcagtggtgtgatctcggctcactgcaacctccgcctcctgggtttgagcaattctcctgcctcagcctcccgagtagctgggactacacgcgtgtgccaccacgccaggctaatttttgtatttttagtagagacggggttttgccatgttggccaggatggtcaggaactccccaactcttatttttaaatgttgggccacacaagtctgggaaatgttagttttcaaacacatcagggaataaatggatacaaaagtcttgaggaccacttaagaaatgaacaatagcagatgtgtaacagttatactacgctgctaccttgtaaaacattttagaaacatctgtttccagccgggcctggtggctcacgcctgtgataccagcactttgggaggctgaggtgggcagatcatgaggtcaggagttcgagaccagcctggccaacctagtgaaccctcatctctactaaaactacaaaaaattagccaggtgtggtggcgggcgcctgtaatcccagctacttgggaggctgaggcaggagaatcgcttgaacctgggaggcggaggttgcagtgagccaagattgcaccactgctctccagcctggcaacaaaggaagactccatctcaaaaaaaaaaaagaataaaaagaatacaaaaagaaaaaaaaaacatctgtatcatccttgtagattctggggtttggaaacaggctttgaaaaaagtcctgaaacaggccgggcgccgtggctcacacctgtaatcccagcacttctggaggccgaggcgggcggatcatgaggtcaggagatcgagaccatcctggctaacacggtgaaaccccgtctctactaaaaatacaaaaaaattagccgggcgtggtggtgggcacctgtagtcccagctactcgggaggctgaggcaggagaatggcctgaacctgggaggtggagcttgcagtgagccgagatcgcgccactgcactccagcctgggcgacagagcgagactctgtctcagaaaagaaaagaaaagaagagaagagaagaaaagaaaaaatcctgaagcaaatggagcaaattttgaacagcttgaatacctgagacaggccaggggtgcggggcaggctcattttatattcttcacggttgtgtgaatttcttgcaattatatgtagcaattttttcaccaggatttagtatattagcatgtttcgggctgggcacggtggctcacgcctgtaatcccaacactttgggaggccgaggcaggtggatcactaggtcaggagtttgagaccatcctggccaacatggagacacctcatctctactaaaaatacaaaaattatctgggcgtggcggtgggcgcctgtaatcccagctacttgtgaggctgaagcaggagaatcgcttgaactcgggaagcggaggttgcagtgagctgaaatcgcaccactgcactccagcctgggcaacagggcgagattccgtctcaaaaaaaaaagaagcatgtttcctagcaagccaattcagaataaaaagaaaacaaaggagaaaatataatcccaataaaatatattgaaataaatatgtacacacatatatatatgtgagtttatgctttgttttgttttgttttctggaagacggagtctcgctctgtcacccagactggagtgcaatggcgtgatctcagctcactgcaacctctgcctccctggttcaagggattctcttgcctcagcctcccgagtagctggcattataggtaccaccacgcccggctaatttttgtatttttagtagagacggggtttcaccatgttgtccaggctggtctcaaactcctgacctcaagtgatcctcccgcctctgctatttatttattctgggttttttttattcttttttgttgttgttttcattttatctttcttttcctatttatttagagacagggtttcgccatgttgcccaggctggtctgaactcccggactcaagccatctgcccatgccggcctcccagtgtgctgggattacaggaggaagccactgtgaccagcctgaaagtgttcatttttaaatttttaatagagatggggtctcactatgtcacccaggctggtccgaaactcctgggctcaaaccatccgcccacctcggcctcccaaagtgctgggatcacaggtgggagccacgcgcccggccccaaagccctccttgcacaagcacctgagccgccatggcccacaggcccatcaaaaccagagcaaactggtacctgtgatacagcctccactccagccccagggcccagccccaggccacccgagccggctgtgggtgacctgagaccaagtgtcgtttcctgctataaactattgatgcctgagcagtcacctccaggagctccgggcttggctacggtgtcctgggttccctgtaatgaagcccggggcagctgcggcctggagggcgtctgctccgcctccatcctgggcccgcctggggctcttttccttctaggcctggttccctccaaaattagcttcctatcgggatcccacatcccctcacaatggaggcctgacctctggggagacacaatgtcagggtcactgtgaggtttttatttatgtacttttatttttatttatttgataccgagtctcactgtgttgtccaggctggactgcattagtgtgatcctggctcactgcaacctctgcctctcgggctcaagcgattctcctgcctcagcctcccaagtagctgggattacaggcacccaccaccacgcccgggtaatttttttgtatttttagtagagacggggtttcaccgtgttcgccaggatggtctcggtctcctgacctcgtgatctgcccgcctcagcctcccaaagtgctgggatgacaggcgtgaaccaccgcgcccggcctcgatttactcattttttttgagagagagagagagtctcactctgtcacccaggctggagtgcagtggcgtgatctcagctcactgcaacctccgcctcttgggttcaaataataattctcctgcctcagcctcccgagtagctgggattacatgtgtatgctaccacacccagctaatttttatatctttggtagagacaggcttttgccctgttggccaggctggtctcgaactcctgacctcagggcatccacccgcctcagtcacccaacgtgctgggatcacaggcgtgagccaccgcgcctggcctgactttattattgttttacaaagagcagaccttccacctgccatggataaaacgccgagttctagaggacactggagacagagtgttccccagaacaaggcctgggcgcagcagcctgcagggctggggtctccactcccgggggagcgtgcagcggggcctgccatccctctgtgcccccgccccacccccactctgcaggccgctgaccctgtggtcgggctggtgagcagatggctgctggatcactgacagcccggctcacgttccctctccctatggagacatcttccttttaataaattttgcaaggccgtggaggggggccagcgctctggcccacgtctgtctcccatccccatcaccacacgaggccccagcacgcctggctggcctaagtccccgcaggatgaatgggcttccggggcctgctgggaccaggtaagcaggctgtgcggcttaaaacaacacaaatacactctcgtctctggaggccggaagtctgaagtgaaggtgtgcaaggtgccaggcgagtaccctcccggcctcttccagctcctggtgccgacagccacctctgaccctcctggacttgcggccgcttccctcccaattctgcctctgctgccccacggcggtctcctctgcatctgtgtccaaatttcccttgtctcccgaagtcgcctgtcactgcggtggtgcccgccctaatgatctcatcctaactaattacatctgcagaaaccctatttccacataaggtcccatttgtaggtgcctggggttcacgcaaagacagatctttgagggaactcaattcaccccaccccggggagtttgcctttgtggccggcccttccccctcagatcaaattctgcctcctcagcgaggccttcctgaccctcccgggcccttcctgcctttctctctggctgcggctgtttcctgcggggctggctgcagctcccggcggcgccctgtcctgtacctgtttcatgtccatcgtcggcaacccctggcttctaacacagctcattgcccgcaggacctcccagcaggagcagggacccagtaggccctgcgtctccgtccgaaccacaagctgctgtgggtggtcacttgacagaaagacccctgcccccccttccttatttgtttatttgctttttctgttgctttagagactggattttgccctgtcatccaggctggagtgcagtggcgaaatctcggttcactgcagcctccatctcctgggctctggtgagactacggccttagcctcctgaatagctgagaccacaggcgtgcaccaccacgcccagctgattctttgacttttgtttatacagggttttgccatgttgcccagggtggtttcaaagtcctggcctcaagcaatcctcgtgcctcgccctcccgaagtgatgggattataggcatgaacaactacccacttcactccatcctttcctttttttttttttttgagacagagtcttactctgtcaccaggctggagtgcaatggtgcgatctcagctcactgcaacctccgcctcccaggttcaagcgattctcctgcctcagcctcccgagtagctgggattacaggcatgcaccaccacacctggctaattttgtatttttagtagagaaagggtttcaccatgttggtcaggctggtcttgaactcccgacctcaggtgatccacccacctcagcctcccaaactgctgggattacaggcatgagccaccacacccggccgagacagggttttcaggcgatctgcctgcctcgggctcccgaagtgctaggattacaggcgtgagccactgggcctggctttatttaattttttgagatgggatctcactctgtggcccaggatggagtgcagtggtgggatcccagctaactacagccttgaactcctggcctcaagggatcctcccgcctgggtttcccaaagggctgggaatgacaggtgtgagcccccacccccctggcctggatatttcatagaaatgggatcacacggggccaggcgcggtggctcacgcctgtcatcctagcactttgggaggccgaggcgggcggatcacctgaggtcaggagtttgagaccagcctggccaacatggtgaaaccccatctctactaaaaatacaaaaattagctgggcttggtggtgggtgcctgcaatctcagctccttgggactctgaggcaggagaattgattgaaccaggaggcagaggttgcagtgaactgagatcgtgccattgcactccagcctgggcagcaagagccaaactctgtctcgaaaaaataaaataaatgggatcacacgctgtgtgtccttctgtgtctggcgtctctcacggagcgtgacgtccttaaggtgcatccgcgctgtggcctgggtcagagcctggatccttttcacgctgagttgtgttccgcggtggacggccggcactgggttggtcttttcttccactaacgggaatttgggctgtttccacatgtggcctccgtgaataacactacgatgaacgttcatgtacgcgtttctgtgtggacttgtgtttccccttctctcaggggcatgaataggaggagaattgcggggttcctgagggccggcccccagtgctggcacatccccaagccaagccccacccctcttttttttttttgagacagagtcttgctccgtcacccatgctagagtgcaatggccccatctcggctcactgcaacctccgcctcctgagttcaagcaattctcctgcctcagtctcccgaggagctgaggttacaggcacccaccaccatgcccagataatttttgtttttttagtgggagacggggtttccccatgttggccaggctgatcttgaactcctgatctcagggatccacgcacctcagcaccctctttggaagttcctagcaagttctctgcctgagttcagacccacagggcctcttaggggacgggggagggtcagggcccagctctagctgaactcccccggggggaggggggaggggggaggctcaggacccagctctaggggggattgaggaggatcagggcccagctctagctgaactcccctgggggtagggaggagggtcagggcccagctccagctgaactcccctgggtggggtggggaaagagggtcaggctggggaggggagcacagaatggcggggtgccaggcctgggggagaggcggatggggtggggaaggatgggtctgggcagataacgctgtggccttttcctgttggcctgagggcccagggtgggggtggggagaggctggtctccctgaggtctgggcatagggaggtgtcctgggatgagaagactcttgagaagtgactttgataattcgggggcagatccttgggcccaccaccccttgcagggacaggggtccttcttggggtgggggatgaacagagactggagagggtgggggagaaaggagttgaggggctaatttacaggacctctcaggccgggtgtggcagctcacacctgtcatcccagcacactgggcagctgaggcaggaggaccccttgagcccaggagtttgagaccagcctgggtaacacggtgagattctgtgtctacaaaacattttttaaaatgagccaggcgtggtggaactacttgcttatagccccagctaccgagaggctgaggcgggaggatcacctgagctggggaggttggggctgtggggagccgagactgtgcctctgcactccagcctgggcaacagagtgagaccctgcctcaaaaaaataaataaacaaaaaataaataaagcccccattccctttaggatctctacttcctataccaacccactgtcccagcttggaggggcgggaccagcctcgagccgcagttgattcccagagcacagagcacaggacggaagtggttctgcatggggtatagtgaggccagggaatagcaatgcattcctgtccgtgagtcctggccatcaggccttggggtggcctcaccgaacccccactccaagctccgttcaacagaaatccaggaaatgggccggagaggctgggagaccacccaggagaccagcccgaggccgcgccctggatccctgagccctcacttttgtaattaagataataaacctgtgctggctgtgcgggcacacacctgtcatcccagcactttgggagaccaaggcgggcagatcacctgaggtcaggagttcgagaccagcctggccaacacagtgaaaccccatctctactaaaaatacaaaaattaggctgggtgtggtggctcacaggtggattacagggtggcctgtaatcccagcactttgggaggccaaggagggcagatcacaaggtcaagagatcgagaccatcctggccaacatgctgaaaccccgtctctattaaaagtataaaaattagctgggcatggtggtgggcgcctgtagtcccagctactcgggaggctgaggcaggagactcgcttgaacccaggaggcggaggttgcagtgagctgagatcacgccattgcactccagcctgggcgacagagcgagacgccgtctcagaaaaagaaaaaaataaatcaaataaaaaaataagaataaaaatacaaaaattagctaggcgtggtggcaggcacctgtaatcccaactactcaggaggctgacgcagaagaatcacttgaacccgggaggcagaggttgcagtgagccaagattgcgccactgtactccagcctgggcaatagagtgaggttccatcccccccaaaaaaaaaacaaaaaaaaaggaaaaggaaaaataaatctatggaactgctcatggggaggagggacggcctggccctgccactcatgttgacgaagaagtaaactgaggcacggcccttccctcccccatcagaactgaaaggtgtctgaggccccagcaggccctctgcatgagattcggtggctctgagggcctcagatgtcctcactcccccccccgtttctcctgccaggctcagagtatcattttcaaaatggtaaccagcaaaccaacgtgattctcgcacaaaggcaaggtgagcctgttcctcgctcaccctgaatcattcatgaaggaggcagctggcctgcgggctgggatgggagacaggagaggagaaaagacagaggctgggccctgctcgctaaataaatcaggtgcccacgggagcccctgggcgtcttcccgcgctggcgttctgcatatgacagctgacctgtaaattgctgggccctcagccatggttactgtcaggccagcccaggaaggacactggtttcaggtgacctgggtgaggtggaggcggtggggggggttcctgggaccaggccgccattgcaaaaacaaacggcctgcttgtacctgctatcgccctctaagcttcaggtggtgggtggggctgaggggctgagaggtggccccaaagaaagacaaccacatcctaaaccctggaacccgtgaacaaggcttcatttggaacaccagtctttgaaggtaccattaagtgtcttgagatgagatcatcctggagtctgcaggtagaccctaaattccgcgacatacattttattttttatttttacttttttttttgagatagcgtgtcactctgttgcccaggctggagtacagtggcgtaatctaggctcactgcaacctccgcctcccgcgttcaagtgattctcccgcctcagtctcccgagtagctgggattacaggagcaaaccaccacgcccggcaaatttttgtatttttagtggaaacgggctttcaccatgttggccaggatagtctcaggctcttcaccttgtgatccgcctgcctcggccttccaaagtgctgggatgacaggtgtttattttcgtttttgttttttagagacagagtttcactcctgttgcccaggctggagtgcaatggcgcaatctcggctcactgcaacctccgcctcccgggttcaagtgattctcttgcctcagcctcccaaggagctgggattatagggcatgcaccaccacgcctggctaatttttgtatttttggtggagaggaggtttctccatgttggccaggctggtctcgaactctgacctcaggtgatccactcacctcggcctgccagagtgctgggattacaggtgtgagccattgcacccggccagacactgtcttaaaaaaataaaaataaaaaaaggtactggacaggtggctggtcatgtggggcttgcggggtaagggatggccttgggtttatactttgagcaagacaggaggcctggcggggccacgatcagaagtgggttttaacacgattccgaagggttagactggtgcttggaacctggtggtctctactgctgccagctgccactcagacccccggccgcccctgcctgtctgctttcagggcggggcccatcccaggcactccgcgaacagacagaagcggctggttctggtggtgtgaggatgggggtctccaggggagcaaatccacagtaacacactgggcttctcccagatccaccggacattcctgatgagtgaccctggctgcagatggctcttggtgagtctccgttgaccgggtggttcgggccaaaggaccttgccgtgcgatgcctccatggagctcggcggccacccctaatccgggctggaatcctctggcaccagacgcccggcggggctccaaggctcctgggcccacgccaggccccggcctgaaacgcagcactgctggaataaaacacgccagagaagcagggcgctaggctcgcctggatttggggaaacgagaattgtcatgtcttctccctccgtaggttggtgttaatgaaaaacccccttttcagcatggactaaatcccgctaattctatttagggagcagtgtctactccgggccgggaactgctccggtttccaaccgcagcctcccgtgagggtcccagtgtggagggccggggtcatcccctcactctgggatggctcccaacccgctgacctggcctccccgtcaggcaccctcacagctctgtcagactcttcatgtgatcagcgctcctgggaacattagtttagggtgttttctgctgctgggatggtggcccgggagggaccctcctggtgaccctgctgggcctggccctcagtttccccagccgtaggctggcagcctcgaactgtacgagctccaggccacagtttccccagctgtaggtcagtgggccagggactgtagggggctcgggcctcagtttccccagctgtaggcgggtggcttgggcctcagtttccccacctgtaggcgggcggccttggattgtatggagcccgggcctcagtttctccagctgtaggcggatggccgtggactgtgtgtggcctgggcctcagtttcccccgctgtaggcagatggccgtggactgtgtgtggctttggcctcagtttccccagctgtaggcggatggccgtggactgtgtgtggcccggacctcagcttccccagctttaggcggttggccgcggactgtgcaaagtccaggcctcagtttccccagctgtaagcgggcggccgcccactgtacaaggtccaggcctcagtttccccagctgtaggtgagaggccgcggactgtacaaggtccaggcctcagtttccccagctgtaggcgggcggccaaggactgcaaggtccaggcctcagtttccccacctgtaggcgggcggccgcggactgtacaaggtccaggcctcagtttccccagctgtaggtgagaggccgcggactgtacaaggtccaggcctcagtttccccagctgtaggcgggcggccgcctactgtataaggtccaggcctcagtttccccagctgtaggcgggcggccgcggactgtacaaggtccaggcctcagttttcccagctgtaggcagccggccgcggactgtgcggggcccggacctcagtttccctatctccgcagtcgggattcgctgttccggggcgaacaaagaacggtcgggggtgaccccggatcatggcgcgcccgcagtatctgtggccactgtggaaacagccctggcgtgtccgggacgcgacgcggcctttccctccccgcgcgatcacccagatgtgagcgctcagtttgaatcggactttttggccatgtgcccacaaccaacatggagccctgagggtttcctgcccgactccaagatggcgatgcgactccctttgccctcacggcccaggcgggcgggtcctgcccacttgcaagatggcggcagcctgggcaaagcacgcttcccgccgcctgactcgccacgtacccactctcaagatggcgtctcccgcaaagccacgcgccagctgactggctcagacgccgtcacgtgatcccattttctccccctcccccgactacacaagccgtttccgccttcggccttgaggaataaccgcctcccccaataggcgcctgcgatttctctgggtcccgcccccgggcggccttctggccagtgggaggtgctggcgggggcccgcggggctctccccgccccctggctgcagcgggagccaatgggcagcgcgcgcgggggacgtgtgcgggcgtctccgccattttgtgagtctataactcggagccgttgggtcggttcctgctattccggcgcctccactccgtcccccgcgggtctgctctgtgtgccatggacgggtgagtcgcacgtcgccccgcgccccaccgccctccccgcgccgcagccctgcccccgccgccgcgccggcctccccggggccgatctcgccccctctcgggcgggagggggcggcgggctctccccttcctctccgcgtggcgggcgcgggtgcggggcgggtcaggggcttcccgggggtctggccgcgtccccatcccccgtccggcccgcttccggcccccgcgcgccccgtccctagcgcacgcggcctcccgcgcccctccccctccgcgcgcgtccccgcacttcgcctttgccccgcctcggcggcgcgcggcccttcccgcttcccgtccggccctcgcgcgcccggatggcccttcccgcctcccgtccgctcccctcgtgcgcctgcgtagcccgtcgcgcgtccccgttggccccagcgcgcgtgcgcggccgccatcgggggcgcgcgcctttcccgccgcccggactctgcccccggcgcagccccggaagcgcaggcggggctggggcggccgccgggagggaaagctggcgccggggcctcgccgcgggcccgagtctctgcgctccccgccctacccctgccccccgtgcgccccgggccgcggccaaggggtttcggtgatctcgggagagaagcggccgccccgagggtctgtcctccgccccggggccggaggggcctctccagggacccccgcgggcgccgtcatggggaggggccttcccggctctcgggccggggcagcctttccgggcggctttgctgggcgggcttcccttgggagaggtgggagccccctccagaaaggccgtgtcccgccgagcgcttcctgcgcgaggccctccctgggaataggaagcgggagaggctggagatgtttcgcattctttccgttttcctgagaagtttttcttgggttcagtcacttttaaaagtctgttaaacgtggtccgtgcagtctgtggtgtcagaagaggcgcagccctagagtgggtctggaccccttagcatgcgtgcgggcaggtgggtcctgcagacggcgagacgagggctccccgctctcggacccagcaccgcgggctcgggggccgcgcactcgcctcccggagtgaggcaggaggcccggaggctgcccttccgacggacgctccgagtcacttagggcctcgccgggagttgcagtggccgggagaagccgtggggagctcactgttgggtcaggacctggccggggctgaagggagggcctcggacagtccggctttctatccaccttccccccggggtgtcccgaggagggagagtcgggtcgggcggggctcgggttgatcagtaactgaggctgtgttctggtcggtctgttaatttttattgacggtttccacggccgcctcctgctctcctcggtggatcgggctccactctgctgagaggcaccctcttgggggcccacccctacccgggtggaagctctggcccaggcctgtgagtttgccagtttcagcctctccgaggcgtttccaacttactggaaagcacacagcagcccttgaaccctctcagcggcatctagcattcctcggggcttccgatgggggtgtctttgtcttggaacgtgtggggcctggtccagaggtggggcctggggtcctgctgggagggaggggcgccaaaggacaatggtggccccttttcaagttgcagtcaagtggacggctcacttccctgcccttctgagctttctctagcggggcctcgtgcagccagagggagccctgcggaggtggcagctgcagggacctacgggctctcctggcccggggacagctgggtgctcctgctgctgagtggccaccaggctaacgttgtctcctttctttctctctacagcattgtcccagatatagccgttggtacaaaggtaggcacttctcactttgcttctccgtgacgctcctctgaccttgtgccgaccccgggggccaccccccagcgctgttgcgttggctagagggcgcttttccattcctaaggggcactacccttggtctggaatctggagttgggcggtagggtttgaaccccgggctccagtgcccgtgagttttgggggcttgggtttgctggccgcccctcaggtctggaatctgagctgctcttcggttcttgctgtcagcagcgagggctctgtgtgccccaggcctgcctttggaacttctgcctctagaggctggaatcgtgccgttcagtgggaaacctcatgttgtggctgcctgggagactcttggttttgataggaaaagagccacctggctgtggaggggacctggatagaatccagcctatttgagtggctaggatgggcatttactggttgattttgacgttaagtttttttgtttttgtttttgttttttatttttgagatggagtcttgctttgtcaccaggctggagtgcagtggtgtgatcttggctcactgcaacctccacctctcaggttcaagcgattctcctgcctcaacctcctgagtagccgggattacaggtgcccaccaccatgcccagctaatttttgtattttttttttttttttttggtaaagatggggtttcgaacattgttggccaggctggtctggaacacaggtgatgcaccccccttggcctcccacagtgctgggattacagttgtgagccgccagacccggctgacattaagtatctttgatggcatctggttagaacagcagcaaactgtcaaaggtggtgtttggggcaagagaaaaatgaatgtgccacgtctctggggtgtgcgaatcttgcagccccatggagggtgaggccagggctcagcatgtgaggaaagggggtcagaacctggagaagaagaaggtcctggggaggcgattctcgagggagctgtagtcctcgcttagctggggtagttggttaatgattctgctggtcattgtgggttgagggggctcccgacttcagggcttgtgccccgagagcctcccgcagggcgagcccacagtggtggcgtcctgagccagcagccagttggtttctggtcagtcagcagtggtgcctgggccaggtttcggtttttcccaagtggactgctgtctttacgcgctgcctgccccgatcttcctggagataaaacctgtttgttcagtgtgggaggagggagaggtactttcatctgaagcatttgcaacaatccctagatgtgtctggcttgcaggcagtcgtctcttccctgcttctgtgggcctgctttccagctggagtggccctcagcttccatcgggtggtccttgagccctcctctgcagttcctagggggctcctgggctgggacgttgaagcccagccaggacttgaagcctgcgggagggattttgccacagggcagggttagggctcctgctgggtgcaggccctggtaggaggacggggtagtaccctgacccagatgataccccccctcccccccaccaccagggagccctcagctgacctgggcccacacctggctacgctgtcctttagcccaggacagagcaagctcttgttcagtgtggggttaaagacacctaggaactgtgctgtagggccccagctgcagactggaagtcctggggcgtttcctgtcaatctgtgtgcttcaggacaggtgccctgaagggaccctcctggggtacctggcagctgctgtgaaggcagtggaggcgctaggcccagctcgtgtctcctggttgctgccctgtggagcctcggagcctccaggtgtcccttccgttctgctggggcgccgttgagctgagccaagccggcctgtgccgcctgggcaggcatggagtttgctgccgcagacagttgtgggcaatgccaggccacttgcccatgggaatgagattagggcttcaggcaggcggccaagaggaccgctcagaggaagcggccccgcccaccactccagtcaaagacagggtccaagatgccctttttaaggtttgtgcagccagcacatgggagccgcatgggcgcttggccactctccagcttgggggaggaccagccctggtgtcctggacggggtcggctcctgggctcccccagcctctgagctggaggggagagcagacaggaagcgacttcctgtgggaggcgaaggttggaggccctgcgtctcaggtgcacccatcctcccttcctcccgtcctcccttcctccggtcctggcactgctgtgttttctgatcgcgtggtttccacctgaggcggctggctctgacccctttcccctgggcctgcgcagccccgccttgtgctcatagggggccccagactctgaaagcgagaggactcgagggtctgttttcagtatttggcttcatctgtgtccggccggaacctcagggccgccgtgacactggacactgttcattctctgaccctaaagtcttggggactgaacaggtgccatttgggtgggcgccgggcctgtggaccctgagtgattcctggttccggcccttgtggctgctcgattgcttgtttggtgacgccctgagtgcttgtgggattggtgggagactcagggctgcagttagaggtctcattggcaagggccagtccctgttccccatcctccttgagcaggtgccggagtctcccgaggctcttgccgtccgcgtcgggaggaggcagctgtggggctttggaggctcgggcagtcttccttccaggaagctcttgagccagggccagggcaggagtggagctgaacgtgggtggaggggaggcggccttaagagaagaccaagcgcaggctcggggaggccagcgttggtgggggctctttggccaggtgtgggggcagctccttgaccaggcatgggggtgtgtggagctgggggttgtctgaggggggacagggtgtgatatccactggttctttctgatgcgatggccctgggcccttcagcaggtgggggcaggctcttggcctcaatcctgatacgggagatggaggctcctttgttccctgggatggccctgtcctggggggcctgggcgttgctgccctcagcgcctgcagaggctcgctttgcagaccaagcgcctgtgctccaaggtcctcagacccgagctttgttttctgtgtaactaagggccgtaaccaacgtctcctccaatttcactctttgaataaacgtgtgtcttcaatccttgcagcgggggggatgtctgccgtcctgagcctaggatcagtctagtgcaattcttagaagttgatccaattacatagaaataaccagtgaatagattgtttctggagagaaaatggacaggtcagaagtgatggagccgctgtggagctcccccggccctagtcacggccgcgataccagcggatcactgggcgggaggccgtgtctctagtcctcagtctcgcgtgtgcagagacggaggtcgggtttcttttccgggctggaaaacaggagaggaggggctcctgcgagagtgagggaggcagcgctataatttggttctcttgcgaggccaccagaagtgaggacggctgcctgggccctgccgtgtgctgctgggggggctggctccatggagggggtcctctgccctgctggctggtggctgaggccccaggcctgtgcccagggccgctggcagcacagtgaggccacgtccacagcagagttggccgtggagatagtgtacgtggtgccctccgtagctgagagcctcccagccccacactggctgagtacccagggcttccagaatttggaaaaaggagcagtgttttggtcgtggagctgtggggtgccgtgcgcgtccatgggctgggtctgcgctcaggctgccctgccgtggaagtgtgggtgtgggtatgggttgggggtctgggaccccaggcagcccaagtgggagcagggccggccggtggggaagggaggctctggcctggtgggaagtgcagctccgcgttgtcccttctcttgcagcggggatctgacgagcttttctctacttgtgtcactaacggaccgtttatcatgagcagcaactcggcttctgcaggtaaggccgggactcggcccagggcaagacccgtgggtgtctttccctggaacaacgttacgttcttgttctgggactctactttccatctccaactgcaggggcccatggtccacgctacagacccaggtccaagttctcgctgcagagaatttccagggaggcgctggatggatggtccaggctggcacttggacctgtgggcgggttgtcaggagctgtcgggagcaggggtcctgactgtgcaggtcttggcctctcgcgctgctggttcacatgcaccctcctggggctcagggttggtctccgtagcaggcagggctctagggggatagcagggaccttcctctgtgggctcctgcgagttggtgcctgcatctcatggcacccccttttcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggtacctgagccgcgtttctccggggtgctcacaccgtgcaggcggggacgaggagggcccagcgctcactgcctccccaacaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcggtgcgtggccccgcggcggaccccagcagcccggggacctcgggggtgggcccagccgcaggggccggggactcacggctgtgcctcccacagcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccaggtgaggtggtcccatcaccgccagggcaggtcggctgctattgctgtgggcacaggcacacgggaggggcctggcagggctggtgggcaccgggcaggagctcatgctgtggcccgggacctgcagattttctccaagttcggcacagtgttgaagatcatcaccttcaccaagaacaaccagttccaggccctgctgcagtatgcggaccccgtgagcgcccagcacgccaagctggtgagtggggctcccgggacggcgcccgccctggccctggcccggcgacgtctcacggtccctctcccctcagtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtaagaggctgcccgacgcggcgccagtgtgcagagtggtctattagggccgctcagtccggagccccggcggcacgggcccggccctgcaccagggtgatgcacctgctgctctctgcacggccagcacagcacggtccagtgtcccccacgtcgggaccacggccccccctggagcagcggatctgcccgcgaaggctctgccggggccgcccgccggccgggttggggcccatcccgcagcacagcgcccgctcgcggtggaggttgtgggtgcgatgattagtgtctcatttatttctaggtgcacctggtataatctcagcctctccgtatgcaggagctggtttccctcccacctttgccattcctcaagctgcaggtattcaaacgcttggtcttggttccccagcgactgcatgcccacaccaccttcccaggcagctccgcatccacggcggcagcctgggcggactgggcactcgagtgccaggtcaggggcccttcccgggagaggggacgccacgtccacagagcaggcttggccagggcagtggtaggacagggctgtggaggcccacgtgtggacggcgccagccagaagccgctaatcgcacagtctttgtggtctggttcccttcaagcacctccgggcgagcgcgaggaccgccagtggttggagggatgtctctagtagttgaatttgagtggcctggtaagcgcgcggcccgaggctgagcagcatgaccggcggcgggacgtgtgtgcgtggccgtcctcccgcttcccttctgggaccggggcccggccgccccagtgctggccgtggacggagcagcgcgtgccgcccggcggccgcctcgtctgcatggaggcatgggcgcgcatgcgcggtggtcccgggacgggccctgcttgccgagggccccgtgtctgtgctggcggagccggagcttttctgtgctgtgggcggggcgcatgcagatgagcccaggcccggcccggcccgtgctgtgaggagaggcgggcgctggtgcaggagccggcgggtggctgtgcgggggtcggacgaccccacaggcacccagggtagggccagagccagggccgcctcccgcgcggctcggctcctcggtgcatgaggacggggagcgtcggcctctcccactctgcggtggagtcgggggcgccgccgctcatctcacctcctgcttttccaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagaggtacgtgggcttttcctccgcgccgccgttcctcccggaagagcgagcaggggatgttgtgctcgggctcgggtcccggagcagcgccgcccctcgctgtgtctgcgcctctgccctggcagcccctctgctgcagcgctgagaccctccttttccaagatggcttgagttttcctcttttcctgaattcacatcttggttcgcgttttctcttgcatgatacgcagaatgaattattttttggttacccaaaggcaatctaaaaattacttggagctgagcagggcgcgcagttcagagccccagcaggccgccctgctggtcagcgggacacacagggttagcgcggcggggtgtgggcagcccctgtggctcgagagcctgtcacttaactggtggatccgttatttcccagaatggttaaattcccctcggggagagcttgggtgaaacaagaggcccaaaatatgtaactcttgatggatgggatcctcctggaatcagcatttcaggctgttctgtttcccggcaactcctgtgacttcctcaaggcggtgcccagcctggccctccctcgcgggggcccaggacgcactccctgcctgtgcctcttaccacgagccgggtgctgtccctccagctcctcctgagcgaggccgtgcactaacagactcgatctcccttcacgcctgtaatcgtccttagagactgacttgtgccacagctgcgggagacagcgctgctgcagggcttggctgaggtggccgcgagcggagctgcacgcgcgctcctggggggcgtggttgggatcggcttctgggagcccctccagcagcgctgtctctgccggcatgtgagtgaaggtgcttctcttaccgtgtgcccgtcgaggtaaacctgtaactggaatgtgtgtggagtgtgactgatagaacactacctgattcttatgtatttactgacctgtgtttttttgctactttttttcttttctccccttcccctttccctattttttttcttgccctgatccggaatttctttgccaactgactgcacggtacttctgcttcctgttgttgcttgaaacaaaacaaaaacataaacaaataaaaaacaaaaattccccctcaaaccctgctctccggaaaccaacctgcccttgaatattaacatcctgacaacttcatcatccatcaaccactgcacgcctgcggggactgtcttcctcgtgtggacgattggcaactcgccccccttgacctctccctctcccctgtccctccgctgccttgctctgctgtctctaaagagagtcacaccccaaagcctctttattcttttcggtatgttatcgttcacacttttattaccttgttttcattaattgagatgattttgatgccctgagacgtattatgagtttgcggtttggcactctgatgctccgtggcatccgcctcgttttatggtttgctttcggtttgcgaattttatttggtcccgtagatacgtacgcatggtttatcgccctgcatgcttttcagagttagacctgtcggtggcatatgccaccgtggccacccgctggcagcttacctgtcctggatgctatgactttgctgaacggagctgctcctgttagcgcgccctgtggctgcgagacgcagctccgcagtggccgataaagcaaacccggccgggctgagccgggccttgtgggggtgcgcggggccggggctgacggggagatgggcggggcaggcagcaggagactcaggccccatccctgggcttttgaaggcgtctacggtgacgtgcagcgcgtgaagatcctgttcaataagaaggagaacgccctagtgcagatggcggacggcaaccaggcccagctgggtaagaggccggggcggccccggggtggagggggcaggggcgggggctgcgttccctctcgggcgcctggtcacgcgggtgctgctcccccagccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgtgagtgctgggccggggggctcatggggccgggggcgggcaagggctctgcttggctgtcctaccgcgtcggtgtgtggacttctggcgtttccagagtgcaggtcgggcacctcttaccccaaacctgaagtactgcaaggcctggagcttgagccgagggctgctcaagggagggggtcgttggacactttggaggttttggctcaggggatgctccctgtgagaatgtataatgcacacatttatttatttatattttttgaggcgaagtcttgctttgtcacccaggctggagtacagtggaacgatctcggttcactgcaacctccgcctcttgggttcaagtgattgtgccacctcagcttcccgagtagctgggactgtaggcacccacaaccacacctggctaatttttgtatttttagtagagacggggtttcaccatattggccaggctgatcttgatctcctgaccttgtgatccgcctgcttcggcctcccaaagtgctgggatacaggcgtgagccaccgcgcctagccacatttatttatttatttatttattttacttattttgagatggagtcacgctctgtcgcccaggctggagtgcagtggcgggatctctgcaagttctgcctcctgggttcatgccactctgctgcctcagcctcccgagtagctgggagggactataggtgcccgccagcacgcccggctaattttttgtatttttagtggaaacggggtttcactgtgttagccaggatggtgtcgatctcctgactttgtgatcaacccgcctcggcctcccaaagtgctgggataacaggtgggagccaccacgcctggcctaatgcacacctttataatcccagtactgtggggggccgggcaggggattgcttgaacccaagagttaagaccagcctgagcaataaagtgagacctctgtctctacaggaacaattggttaaaattagctaggagtggtggtgtgcacgtcaggtcccagctcttccggattgggaggttgaggtgggaggttcacttcgcgctcaggaggttgaggttgcagtgagctgtgattgcactgccagactccaggctgggcggcagagtaagaccctgtctgtaaaaattacataatgcaagtatttggaaatgcaggtacatctggccccaagcatgtcaaccagtagtaagccctttgatatttaacacgttacttgtgaaatgttatcagaaaatcaacaaggggcctggcagagtggctcacgcctatcatcccagcactttaggaggccgaggcaggcagatcacctgaggtcaggagttcaagaccaacctggccaacctggtgaaaccccgtctctactaaaaataaaaaaattagcctggcatggtgttgcgtgcctgtaatcccagctacttgggagactgaggcaggagaatcacttgaacctgcaggcggaggttgtggtgagctgagatcacgccactgtgctcccgcctgggcgacagagcaagattccatctggaaaaaaaaaagtggaggagcgtggtactctgtttctgcaaacttgtagatgcctggtttcgttagaagctgcttcagaccattgtggacatgatttgataccccatttctgggctcctaaaaggccctacgccttccccggctactctgaaaactagtctggggaaagcctcgcggacctgactgggcgcccccacccccacgcggccccaggctcacgcctttctcctcccacaggccctcagtctccgaggaggatctcaaggtcctgttttccagcaatgggggcgtcgtcaaaggattcaagttcttccagtgagtatgaggcgggctgtccctggctctccccaggctgccctgcggccggccctgaccccctgtcttgcaggaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgccttcgttgctggcttcctctttctgtgccgcgggcggccccgactcccgcccgggtgtccgccgaagcgccaggtggggccacgggcggggtgggcccggccctgagagtgggggtccctgcgtggggcgtgcgggccagagcgaatgaccaagagccggacctcggtttctgccgctttattgagcatccgcgcggccgcccgcgccctcggcccgccccccgcccgcccccggccccgccgcgctagtcggggaagcggcgcgcctgcatcttgcggaagtagccctcggcctccgcctccgcctcgcgctccgccagccccaggccgcccgcgtggcgccgcagcgtggactcccggctgcccgggcccagcgccccatcggccgcgcccagcgggggcagcccctcgcccgtggccaggttgacggtggccacggccccgaaccgcggctcctcctggtccacgtcgctgaccgacgagccgggggacacgcccgggggcttggccccgccgcggaagccgcgcgccaggtcccccagctcgtagccgccgtcggcctccgccttggccccgccgcccgccgccttccactcccagggcgcgccgccggccgacaggtgcaccacggggtggtgcggcgcgtgcgcgtcgatggtcacgatgctggcggagtcgcggtccgacggcgaccggtactgcgaggagtcggagctggcgctggacgacgacgccgtctcggccgccttggggcccggcgcgcccggagccttggacatggcgatgacctgcagcagccgcggagggttggccactgccgccccgctcttctcggccatcatgagccacttggcgcgcaccccggcgccgcttttgggggacaggccggcccccgtctgcgcgccctcctccgggatgtgcaccagcggcggcggccccgcgcgcggtgggaggatgacccgaggccccagccccggccgcgcctgcacggtggggtagagcgagggcggggccgggccctcgtcctcctcctcttcctcctcctcctcttcctcttcgtcctcctcctcttcctcctcctccgccatgggttcggcgggcgcgcgcaggtgcccggggctggcgtcgtcgggcagccccaggccgcggccctccaggctcttctgcttccactcgctgatgagctgcttggagcgcgaggcgtccagcggcacgtggatggtcatgtggcggcgcgcggggtcgtccagcgagggcgcgctggccctgggcagcgtgtggctgaaggtcaccatgttctccttggccatggggctgcgcggggccagcaggtccacgtccacgctggcgcgcttcaggctgcccagcgaggtcttctcgcgggccacgggccggggcgcgccctccagccgccctgggggccccagctcgtcggtgctcaccgacttattctgctgataaaccgagtcgtggccccgctgcgtcagggcccgcagcgcgtccttggcgggggccggggccgcgggcttctctgcaggtggggcctggaagttgcccaccgcgtggcaggcctgtcggggagaggggtctgggggtgaggcctggggctcagagggctcctcccctgtgatcgttggacttgccgcggggggctctggaccgggggtgggggctggcaagctcttgtccagtgggaccggttcccaccccaaggttgctgacccagcacatcgggcaggtctgagcccacgggattctgactccagcattccaagggcgagacacttcagcacccatgccttccccctaagaccccttcgggacccacgtctatcccctcagacaccctgggcacccgtgcctcccccctagagcccctgggcacccatgcctcccccctcagaccctctgggccagccccccgccagaacccctgggaaccatgcctcacccctcaggctaccagcctcccctgtcagaccccctgagcctgcctcccacctcagacccctgggccagcctccccactcaggccctgtgggcactcatgcctcccccctcagatcccctgggaacccatgccgacccccatcagaacctgccactcaccaggtaggcagcgatgcccgccccgatgaggaagccggcatacacgtccacagggtggctgcggtactgcgtgatctgcgtgagcccgcatacgcccgcggcgatggcaaaggcgaagaccaggatgggcttcagcagcttggtggtgtccgagatgaccgagttgaagtacatctggggcatgggggttggggtcagggagggctccccacgggtcagcaagagggcctgggaagggcagtgaggggccggactcaccgacacatagaccgcggcgaaggctgacagcgtggcgtgctgggacgggaaggtcttcctgtaagaggcgtccagcgtgagccccgcccacctggggaccccagctccagtggcctctctgtgtctctgtttccccgcatgttcaccggggcggaagaaggctcccagtcaggggagttgggggtccggctcaccgtgcagacaggatggcgtggatgtcgtggccggagcagatgtcctgcgtgatgtaggggttgacctcgcaggacgtgcccaggagagtgtagttgggcttgcagacggtgaggaagaagggagtgtggtaacccgtggccagctggatcacgtccgtcaccagggctgtggcacacaggccgaacacgtggacacctgcagggcggaaggctcggccaggcggggagctggggacccgggacagccccaccccctgcatgtggaggtagctcagggtcggggcgcgtcccgcaactcacccacaaaccgcaccgtacgccgcaggaaggagttgaagttgcagccgccggcgttgatgctgccctccgccccggcgggccccccggcacggccccacagccgggactgcagacagtacaacatgccctcggccaccatgatctgccaacagggagggggcgctcaggcctcggtgcccacagggagggggcgctcaggcgggctcccatctgcagtgcccacaggctggcacaggccccggtgtggatgttcaccgaggtggcgggggtgggctcccagccgtggtgcccacaggctggcacaggccccggtgtggatgttcaccgaggtggcagtggctgcggtgcccacaggctggcacaggccccggtgtggatgttcaccgacaggccccagtgtggatgttcaccgaggtggcgggggtgggctcccagccgtggtgcccacaggctggcacaggccccggtgcaggtgctcaccgaggcggcaggggccgcgaaggccaagctgagcagcatcagcagcgggatgagctcctcgttggtctccacgtagggcatggagagagtgcggtcatagcactggaagcccaccttggccggcttgaagaggtcggtcagctccaggaagtacaaggatacgatggaagaagccactatgggcagctgtggggacaaggtgggccaggttcaccctgctctccctcgcggaggcgtctgtccagccctccatgaattcagggccatccaccgtctcactcacctatccacagatccaacccgctcccagccactctttcccccatgagttattcatccatccacagatgctccatctgtaactcgaccatctacacatcacacacccactcactcatcctccatccacccaaacacctatgcccccaacatccacccactcaccgacccatcacccacccatccatccactgggaaccatccatccattcatccatccacccacccacccatcatctatccacccattctccacccatgcacccaacggtacccatccatccatccatccatcacctagccattcattcatctgtccatccatccatccatcatccacccatgcagccatccatctatccacccacccaactgtccatccatccacccacccacccatccatccgtccattcattacccagccattcatccatccatccacccacccatcatccatccacccattctccacccatgcacccacccacccatctacccacctacccatccatccaaccgtccatccatccattcattacccagccattcattcacccatccatccatccacccatcctccacccatgcccccagtggtacccatccatccatccatccattcatcacccagccattcattcatctatccatccatccatcatccacccattcatcatccagccattcattcatctatccatccatccatcatccactcatgcacccaatggtaccatccatctatccacccacccaaccgtccatccatccgtccattcattacccagccattcattcatccatccatccacccacccatcatccatccacccattctccacccatgcacccaacagtacccatccatccatccatccatcacctagccattcattcatctatccattcatccatccatcatccacccatgcagccatccatctatccacccacccaactgtccatccatccacccatccacccacccacccatccacctatccatccacccatccatccattgatcacccatccatccatccatctatccaccctcccacccacccatctaccaacctacccatctatccacctactcatccatctacccatctgtccatccacaacagtcttgctctgttgcccaggctgcagtgcagtggtgccatctcaactcactgcaacctctgcctcctgggtttttgtatttttagtagagacagggtatcgtcatgttgcccaggctggtctcgaactcctaggctcaagtgatacacccgccttggcctcccaaagtgctgggattagaggcgtgaggcaccgcacccagccatggcctcaagcctttttttttcccccactctgtcacgcagcctggagtgcagtggtgcaatctcggctcactgcaaactccgcctccaggttcaagagatcctcccacctcagccctccaagtagctggaattacaagcgtgcactaccacacctggctaattttttgtatttttagtagaggcggggtttcaccatgttccccaggctgccctcgaacttctgacctcaagtaatccacctgcctcggcctcctgaagtgctgggattacaggcatgagtgaccttgctcaggcatggccccagtcgtaatttctgccttgttatggcatcttagcaggggttcagccctcagtccagtcctggggagggcacaggtcagggctgggggctccaggaagggaaaagccatcactgaacatcccagggcagaattggatcgagggagctgagttcatgtccagtgagcattcattgagtgcctgttgcatgcaggcacgaggcccggggcagacgcggaaagtgggtagcagcgtttgtttgcacctgacacccggtttgaaaaccacccactttaacctgtgggcggccagcagaccccctgtgcctcagtctcaccagctgcaaaatgggaatgataaagtagccgcctccaagggctcaggtggagatgagtcaatgtgggaggtggcccctggcaactatctacttgttctctccactttcattatcagcatgattttgctggggcgggcagacagcatcaagcccggggagggtctgaggtggggcctgggcgcggccttaaaaatatctaaccatgggccgggtgcggtggctcacgcctgtcatcccagcactttgggaggccgggacgggcagatcacctgaggtcaggagtttgagaccagcctggccaacatggtgaaaccccatctctactaaaaatacaaaaattaacccagcgtggtggtgcgtgcctgtagtctcagctactccggaggctaaggtgggagaatcgtttgaggacgggaggtggaggttgcagtgagctgacattgttccactgcactccagcttgggcaagacagcaggactccatctcaaaaaataataataataaataaaataataataataaggccgaccgcagtggctcacacctgtaattccagtgctttgggaggctgaggcaggaagatcacttgaggcctggagttcaacgctagcctgagcaacacagtaagaccctgtctctactaaatacatacttttttttggagtctcgctctgtcgcccaggctggagtgcagtggcgcgatctcggctcactgcaagctccacatcccgggttcacgccattctcctgcctcagcctcccgagtagctgggactacaggcgcccgccaccgcgcccggctaattttttgtatttttagtagagacggggtttcaccgtgttagccaggatggtctcgatctcctgacctcatgatccgcccacctaggccttccaaagtgctgggatgacaggcgtgagccaccacgcacagcctactaaaaatgatttttaaaaattagctggggctcaggctagccttgaactccaggcctcaagtgatcttcctgcctcagcctcccaaagcactggaattacaggtgtgagccactgcgctcggccttattattattattttatttattattattattttttgagatggagtcttgctctcttgcccaagctggcgtgcagtggaacagtctcagctcactgcaacctccacctcccgtcctcaagcgattctcccacctcagcctccggagtagctgagactacaggcacacaccaccacgctgggctaatttttgtatttttagtagaggtgtggtttcaccacattggccagactggtctcaaactcctgacctcaggtgatctgcccgtcccggcctcccaaagtgctgggatgacaggcgtgagccactgcacccagcctactttttttttttttttttccgagatggagtctcactctgttgcccaggctggagtgcagtggcgcgatctcggctaactgcaacctccacctcctgggttcaagcgattctcctgcctcagcctcccgagtagatgggattacaggcgcccaccactacgaccaccatgcccagctaatttttgtatttttagtagagatggggtttcaccatattgaccaggctggtctcgaactcctgaccttaggtgatccgcccacctcggcctcccaaagtgctgggattataggtgtgagccaccatgcccgtcctgcaacaggaatttaagtgcaatttcgaaaaataaacagattttctatgaagtgatgtgggcaacttaatgatattgtgtttgggagggacccacttgcccgggtgtgaggtaacggattacaggccagccgctggccgtgtgacctgcacgggtcactgcttccttgagactagggtcccgtcttccatcgaggctctggaaggcccatcactagagccggttttcctggcctgacatgcaaggatggattaaagttattttattttttgagatggggtctggctctgtcatccaggctgaagtgcagtggtgtgatcttggctcactgcaacctccgccacctgggctcaagtcatcctccatctcaggctcctatgtaactgagacctcagctgcacaccaccacgcccagctattttttctgtttttaaaattttgtagagatgggtttttgccatgttgcccaggctagtcttgaactcttgggctcaagcaatccatctacctgggcctcccaatgtgttgagatcacaggcgtgagccaccaccccagccttaagttactctaccatcctgagccaggtgtgtgccaaaatggtagcttttttgttttagagacagagtctctgtcatccaggctggagtgcagtggtgtgatcacaactcactacagcctcaacctcctgggctcaagcaatcctcccacctcggcctcctaagtagctgagaataaaggcacgcagcacacgcccaactaatattttaattttttctgtagagatgggatcttgctgtgttgcccaggttggtctcaaactcctggcctcaagtgatcctcccacctcagtctcccaaagtgctgggattacaaacatgacaaacgtgagccaccgcacagggcagggggctccatttattacatttattgtcttctttttttttttctaagacagggccttgctctgttgcccaggctggagtgcagtggcatgatctctgctcactgcaacctccacctcctgggttcaagcgattctcctgccccagcctcccgagtagctgggctcacaggcataagccaacatacccggctaatttttttgtattttttagtagagatggggtttcaccatgttggccaggctggtcttgaactcctgccctcaggtgatctgcccacctcggcctcccaaagtgctgggattacaggcgtgagccacagtgcccagcctaatttttgtatttttaatggagaggggtttcaccatgttggctaggctggtcttgaactcctgacctaggtgatccacccgccttggcctcccaaagtgctgggattacaggcgtgagccaccgcacagggcaaggggttccatttatggtcataaactcctcactatgtgcctaacacgtttccgtattctgtagatattaattcctatcagctccaggagtggaaaagcggaggcccagagaggttaggggcagggcaccagcctcaccattagcagaggtgaactcagaccctgaggcttcggagcccacgcggcacctgcacccaaccccaccccctccggcctccccgccccctccaggcccccagcccccgacccccagcccctctgaccacaccttggtcagaagggctcccctcctagcacctgcccacagttcccacggcctggacccccctcggttcctctggagctcctactcgacccgcacagcccaagtcctctgccccaccccccatccgccggacaccccggtcctgccccgccccgaggccactgccggggcagctgcgccggctccggtcccccagcgcgggggtctctgcgggcgggcggaaccgaggcgtctcccccgggccccagcgcgacccccacccacctccacgaagtagaagcagggcagaagcgtcatgctgtccttcgggatcttgttcttctccttggtggagatcatggtgccgcgggcgccgcaggccgtggctggaggggagaaagcggcgctggaggggggcgcgcaggcggagcccgggggagacacggtggccggcgccggcgggggaggggcggtcggggaaactgaggctgcagagagcggcgtccgcgtggcctccccgcgccccggcccagcacgcggcttccgggcgcccctacacccgggatcggggggtcggggccgggatcgccgaggagggcggggggtctccgggcgggagccagtccccgcgtggtggtggggggcatccgggagaactggggttccgggcggcggaggagactgggtccgcgcccccagccccacagcccctcacctggcgcggccggcgcccagcacaaagcgcgtctcctccgtggggcggggccgggagccgggaaggggagggggacgggggaggggagggtccggcccggagacccccgcgcgcgcccagacgccgcagcccagacgccgcagccaggggcgggggctctttgtctgggcgcgtcctccgcaggccccgcgcaccgtccccgcctccctggcgccgcctcccaccgccgggggtctcgggggtctcaggtctgcgcgagcggctggcggggctcgggggtcgcgtcctcctcccttcgggcctgcggcggtgacggtcccgtcctcccctcccgggtggctgcggtcggcccggggggcgccatcgagacgggggcggaggcgggggcgggggttggggtttcggggtctctgactgtctccgtgtctctcacggtctctcgccggctccgactgcccccgccccgcgcctccgcccgcccctccgcggagcccgccgctcgctggtgcgcgtttccatggcgaggctcccagggcgcccggagcatcggagacaaaagagctgggggagggggactggggggtctcccggtgcctccctcccttccccccgcactcaccctcgccccctccgccgcgccggggtccaccctccgcctggccgcagccgctcggtgcgcacggcgggattgcggggcgcggggctgggggctgggggctgcgggatgcgggcagggccctcgggacccgcactcgggcagtgcctgctgtctgcgtgcatttcctcctccatatgcgcagccctgcggggtaggggctggttgacccccgttgtagggatggggaaactgaggcttgggcaccctgggtcgcaatccgaggtctccgggccccaaacggcaggatttacaaaaatcggtttttgggccgtgcgcggtggctcaggcctgtaatcccagcactttgggaggtcgaggcgggcggatcacgagggcaggagttcgagaccagcctggacaacatggtgaaaccccgtctctactaaaaatacaaaaatttttagggtgtggtggctcatgcctgtaatcccagctactcgggaggctgaggcaggagaatcgcttgaacctgggaagcggaggttgcagtgagccgagatcgtgccactgcactccagcctgggcaacaagagcgagactctgtctcaaaacaaacaaacaaacaaacaaacaaagagtgacttccaggctgggtgcagtggctcaggcctataatcccagcactttgggaggcagaggcgggaggatcccttgaggccaggagttccagaccagcctggccaacatggtgaaaccccatctctactaaaaatataaaaattagccggacatggtggcaggcgcctgtaatcccagccagatgggaggctgaggcaggagaattgcttgaacctgggaggcggaggttgcagtgagccgagatggcaccattgccctccagcctgggcgacagaaggagactctatctcaaaaaaaaaaaaaaaaacaaacaaacagtgactccagagggttggagccctgctagataccttagtttgctcataacaggcactgctgcccccgggaagagggtcgcctgccataaatgcggaaacagttaaatggcgatgggaataggatgggaactcaatggtgttgctacctttggatggactcggaggcagcccagcttcctgggacaggactgcacggactgcctggggaggggtctttggccccccggttcctgcaggggggctcggggaggccctgtgagcagttggtcacaggtgggtcccattcgatgcgatcctgttcctccccaacagccctggagaagggggacgttgcctgctgtggctgcggctgttttcctggcctgtgagaggcggggccagagtggccgttgggaatctgggtgttgcaaggtgaccacaaacagctctctgggggaggaggaggaaaatgcaattgattttcaggagccttctgaggtcaggagtgggagagtgtgcagggggaccctcctggcagcttgggggtccaacagaagatctgggggagtctcagggtcttctccccctaggatcaccagtggtggagatggggcaggcctggccatggagggcacgttgcttggctgaggggcctgggcttgagtgtggggcctgggcttgagtgatgggagagttccgagcaggccggaggggttgagcgtaccagacgctgctcaaaacttttatttaaaaatgattattattattattactattattttgagatggactcttgctctgtcgcccaggctggagtgcaatcgtgcgatttcagctcactgcaacctcccacctcctgggttcaagtgattctccctcctcagcctcccgagtagttgggattataggcgcctgccaccacgacgggctaatttttgtatttttagtagaaagaggatctccccatgttggtcaggctggtgttgatctcctgacctcagctgatctgctgcctcagcctcccaaagtactgggatgacaggggagccacggagcccagcctttttttttttttttgggagacggagttgcactctgtcgtctaggctggagtgcagtggcgcgatctcggctcactgcaagctccacctcccgggttcacgccattctcctgcctcagcctcccgagtagctgggaccgcaggcgcccaggactatgcccgggtaattcttttgtatttttagtagagacggtgtttcaccgtgttagccaggatggtcttgatctcctgacctcgtgatccgcccgtcttggcctcccaaagtgctgggattacaggcgtgagccaccgcgcccagctttttttttttttttttaatagagagagggtctcaccatgttgccaaggctggtctcaaactcctgggctcaagtgatcctcccacctcggcctcccaaggcactgggattacaggcgtgagccaccacgcccggcctcaaaaacttttcagaatatgaaccccactccatgctcagcactgttctgtctagaaggcagagtctatccctgtctcagggcacactgacgtgcagacagcgagctcgccctgaggtcatgcgactgggagggacagagcttccggctcccggcagaggggaaatggggcctggcccacgggagagctgaggcccacgtttggccaggacagggtggatggaggctggggcctccgcagggaagatggacaggtaggatccggggtgggcagagagggagagctggcttggacggaggcagggatctgggggctgtgccatggaccctgtgaggtggctgggctgtgaaactcagtggagaccggaattattattattattattatttttttgagatggagtctcactgtctcccgggctggagtgcagtggcacgatctcggctcactgcaagctccgcctcctgggttcacgccattctcctgcctcagcctcctgagtagctgggactacaggcgcccaccaccacgcccggctaattttttgtatctttagtagagatggggtttcaccgtgttagccaggaaggtcttgatctcctgacctcatgatccgcccgcctcggcctcccaaagtgctgagattacaggtgtgagccaccgctcccggcctggagaccagatttgagccctgggaccctacattcccgatgggcagcggacctcaaggcacaccggccccgcctccctggactctccccgtatccgccccttggaggggcaaactgccctcagagggctcccacaggcccagacacaaactggtgtccccaagggtgtgggggacacggtaagctccagacctcagtttcaccttggaaatgagcccctttgtaaaaaatggaggtgagtttggacgcagtagctcacacctgtgctcccagcactttgggaggccgaggcaggtggattgcttgagcttaggagtttcaaaccagcccgagcaacatagtgagactccacctctacaaaaaaatacaaaaattagccgggcatggtggcatgtgcctatggtcccagctacctgggaggctgaggcaggaggattgctggaacccgggaatcggaggctgcagcgagctgagatcgtgccactgcactccaccctgggcaacatagtgagatcccatctctacaaaatatacaaaaattagccgggcacggtggcgggtgcctgtggtcccagctactcgggaggctgaggcaggaggatcagttgaacccaggagattgaggctgcagtgagctgagatggtgccgctgccctccagcctgggcaacagcgagacctcaactctgaaaaaaacaaaagaaggagatgaaatttacataacttaaaattagccattttgaacggtacagtgaagtggttttcggtgcattcaccgacttgtgcaaccatcactgctgtccagtcccagaacattccatcaccccaaagaaggaagccccatctccatccatcagccatcaccccctgccctcccccggcccctggcaaccacagatccacttcctgcctctgcagatttgcttgttctggacatttcgtctatttatttttatatagtttttaatttgtttttatttattttttttgagacggagtctctctgtgtcacccaggctggagtgcagtggcgcaatctcggctcactgcaacctccacctcccaggttcaagcgattatcctgtctcagcttcccaagtagctgggactataggcgcccgccaccacgcccagctaatttcttttttttttttgaaatggagttttgctcttgtcgcccaggctggagtgcaatggtgcgatctcggctcgctgcaacctccgcctcccaggttcaagtgattctcctgcctcagcctcctgagtagctgggattacaggcatgtgccaccacgcccagttaattttgtatttttagtagagatggggtttctccatgttggtcaggctggtcttgaacgcccaacctcaggtgatctgcctgcctcggcctcccagagtgctaggattacaggtgtgagccaccgcacccagcttgtcaattatatctcaataaagctgttgaaaaagtttaaaaaaatcacccaatcgggcacagtgtttcacacctgtaatcccagcattttgggaggccgaggtgggtggatcacctgaggtcgggagtttgagaccagcctggccaatatagtgaaaccccatctctactaaaaatacaaaaaattagccaggcgtggtggtggacaactgtaatcctagctactcaggaggctgagacaggagaatcacttgagcctgggaggcggaggttgcagtgagtcgagatcacaccattgcactccagcctgggcaacaagagcgaaactccgtctcaaaataataataataataataataataataatcacccatacagacgcgcaggactcaacgcaggactgccagctccactgccctgagccccccggtgccaggcccagcgggcagtgctggagccccagtggcttgggatggggagactgggactctgagctggcaatgttcctgggtgctggctgcatgcccgccatgtgctgggctccgggatccactggttcctgacaccctcacctgcccctgggggtgtggccatcttctagagagggaaactgaggatcagtgcagaatgtagggggagcccaggctggcccagggagcagttggcggtggaggccttgggcaatttcccgtgttcccactgagtggggctgtccctgggcctgggcggggacgccaccaactgccaaggcctgtgtataagggcagccgccgccttagccacagacctgccccgccatgacccggctgacagtcctggccctgctggctggtctgctggcgtcctcgagggccggtgagtgcctctctgtgccggtggtcccccatctgtgctagggcccggctgccagggcagaactcagacttaaagcacagagaaggcaagcggcttggcctgggtcacacagccagcccggcctggacgatcccgcgaaaggcgtgagggcggacggtgtgcgggactcaggggccccctgtcctcttagggagtgggacgatgggggagggtgggtccccccgcagccccactgggtggatagagctgaggctgcagcttcacacgccctcccggccactgtgtggattcttggggatctcagagctgtctccccccgacccaggctccagcccccttttggacatcgttggcggccggaaggcgaggccccgccagttcccgttcctggcctccattcagaatcaaggcaggcacttctgcgggggtgccctgatccatgcccgcttcgtgatgaccgcggccagctgcttccaaagccagtgaggggtcctggggagggggcctagggggcattggggctcagagaaggggcttggggggcttaggcattcagtgggggtgcttggtaggtgaggaggggaggggattgcaaaaggaggggctcagggaaaggagggggcttggagagggaaatggggactgagttgaggagggacccaaggatattggggggctcagatggaggaggcccagagaagggaagggggtcagatggaggaggcccagagaaaggaagaggctcagatggaggaggtgcagtgaaggaaagggggtcagatgggggaggcccagagaagggaaggggctcagatggaggagggggcccagagaaaggaaggggctcagatggaggaggtgcagagaagggaagggggtcagatgggggaggcccagagaagggaaggggctcagatggaggaggtgcagagaagggaaggggctcagatggaggaggtgcagagaagagaagggcctcagatggaggaggtgcagagaagggaagggcctcagatggaggaggtgcggagaagggaagggggtcagatggaggaggtgcagagaagggaagggggtcagatgggggaggcccagggaagggaaggggctcagatggaggaggggcagagaagggaagggggtcagatgggggaggcccagggaagggaaggggctcagatgggggaggcgcagagaagggaagggggtcagatggaggaggtgcagagaagggaagggggtcagatgggggaggcccagataagggaatggggtcagatgggggaggtgcagagaagggaagggggtcagatgggggaggcccagataagggaaggggctcagatggaggaggtgcagagaaggggagggggtcagatggaggaggctcagagaagggaagggactcagatggaggagggggcgcagagaagagaaggggctcagatggaggaggaggcgcagagaagggaaggggctcaagatgggaagggggccctggaaagtctcggctctgcttctgtaaaagcgggggagttttcagggtgaaggattgcagtctgcaggctgggatcccccctaatttgcaagccggcttgctctgtgcccaggccccagcctggtgtcctccctctgccctttcctccgctactctcaggaaccccggggttagcaccgtggtgctgggtgcctatgacctgaggcggcgggagaggcagtcccgccagacgttttccatcagcagcatgagcgagaatggctacgacccccagcagaacctgaacgacctgatgctgcttcaggtgagaggatggtgccacctgtgatcccagcacctcgggaggccgacgttagccagggaaacaagtccaaacttggtctctacaaaaaaatacaaaaattagccgggagtggtggcgcgcacctgtggcccctgtgcttcaggaggccgaggcggaaggacggcttgaggtcaggagttcgagaccagcctgggcaacatggccaaactcagtctctacaaaaatatatatgtgtgtgtgtgtgtgtgtgtgtgtgtgtgtgtgtgtgtatcttgccgggtgaggtggctcatgcctgtaatcccagcattttgggaggccgaggtgggcggatcacgaggtcaggagattgagaccagcctggccaacatggtgaaaccccatctctactaaaaatacaaaaattagccaggcatggcagcgggcgcctctagtcccagctactcaggaggctgaggcaggagaatcgcttgaacccgggaggcggagcttgcagtgagccgagatcgcgcccctgcactccagcctgggtaacagagccagaccctatctcaaaaaaaacttccaaaaacaatacagcaacacatacagatgtaccacggttcgcgtatggagcctcctgttggtggagactgacgtcgttttcaaatgcttttgctatgacagaatcatgtgaatgtttttcatgtttggtttttttctttgagaaaatgataaaattatctcaaaaatatcattaaaaaatttaaaaaagtagagacgggggtttcaccttgttggccagtttggtctcgaactcctggcctcaagtgatccacccaccttggcctcgcaacgtgctgggaatacaggcgtgagccaccgcacccggcccctgccgggaattaaacgcaaaccacttacagactacagttaatgtcgctgacacttctgctcccaggggtccccatgaggctccagtccccagggccaccctcccctgactccatttccttccccagctggaccgtgaggccaacctcaccagcagcgtgacgatactgccactgcctctgcagaacgccacggtggaagccggcaccagatgccaggtggccggctgggggagccagcgcagtggggggcgtctctcccgttttcccaggtttgtcaacgtgactgtgacccccgaggaccagtgtcgccccaacaacgtgtgcaccggtgtgctcacccgccgcggtggcatctgcaatgtgagtgctccctgtggcgggaggaggggtcctgagaggtactgagctctccgtggcaggagaaagcaagtgcaggctgagggcggcacagcaggggggccccaggattgagcattttcacggtaggagaaacagtatctttttttttttttttgagacagagtctcgctctgtcgcccaggctggagtgtagtggcgtgatctcggcggctcactgcaacctccgcctcctgggttcaagcgattctcctgcctcagcctcctaagtagctgggattacaggcatgcgccaccacgcccggctaattttgtatttttagtagagacagggtttctccatgtgggtcaggctggtctcgaactcctgacctcatgatcgacccaccttggcctcccaaagtgttaggataacaggcatgagccaccgtgcctggctgagaaacagtagctatcaaacgccggctgtgagccacgtctgtgctgggggttggggacccagcaggcatggtagagccggtcactgagggactcaggcgtgtgattgccaggggaggggcacctggcccagcctggaggtgccaggaagctccagaaagcaactgatcccaaagtccactagcagttaaccagggcagagaaagagaagagccatgcaaaggccctggggctggatcaggacttgtaggttccaggggcagcaagaggcctctgcagttctggggtggcgtgggagccaggccctgggacgccctgacacagctgctgcctgcccagggggacgggggcacccccctcgtctgcgagggcctggcccacggcgtggcctccttttccctggggccctgtggccgaggccctgacttcttcacccgagtggcgctcttccgagactggatcgatggtgttctcaacaacccgggaccggggccagcctaggggggcctgtgacctcccatggagcccagccccgccctccacacctccggcgctccgcacccacctcccacggccccgcccctgcccccgctccggccagaggggccctggctgtaataaagaagccgatctctcctctgctcctggtttctgttcattggtgggggagggggctgtggggacgcgtgagtggcaccttcaccggccttaggggcacccaccgcaggtgcactgcctgtgcagatgtcagatgttcagagattccctcaaagcccgggaagcaggggctggtgttatctgcacccgacagcggggtgttggggggaggcccaggttcagagaggttgggtggctgcccagaggtcacacagtgaatgccgcccagcactttgggaggccgaggtgggcggatcacctgaggtcaggagttcaagaccagcccggccaacctggtgaaaccccatctctataaaaatacaaaaattagccgggcatgatggcgggcgcctgtaatcccagttacttgggaggctgaggcaggagaatcacctgaacccgggaggcggaggttgcagcgaaccgagatggcgccactgcactccagcctgggcgacagcgagactccagctcaaaaaaaaacaaaaaccacgggagaaaacggggaacattctcctcttggatccaatagaaacagtaaaacgtgaatatgaaataataaatataattgtatatataaataatacagaataaaatatgaatatgatggctggatgtggcagtcacatctgtaatctcagcactttgggaggccaaggtgggagcatcgtttgagcccaggagtttgagaccagcctgggcaacgtagtgaaaccatgtctctacaaaaataatttttaaaattattaaaattacacaggagaggccgggcacagtggctcatgcctgtaatcccagcactttaggaggccaaggcgggcggatcacgaggtcaggagatcgagaccatcctggctaacacggtgaaaccccgtttctactaaaaatacaaaaaattagccaggcgtggtggcgggcgcctgtagtcccagctactcgggaggctgaggcaggagaattgcttgaacccgggaggtggagattgcagtgagccgagatcacgccactgcactccagcctggtgacagagcaagactccgtctcaaaaaaaaaaaaaaaaagccgggtaagtggcacctgtcgtcccagctactctggaggctgaggtgggaagattgcttgagtccaggaggtggaggttgcagtgagccgtgatcgcaccactgcactccagcgtggtccacagagcaagacccagtctcttaaaatgataataataataataataataataataataataataagaagaagaagaagaagaagaagaagaagaagaagaagaaggaagaagaagaagaagaagaacctgtagtctcagctattgaggaggctaaagtgggaagatcactttagcccaagaggttgaggatgcagtgagctatttttatctcatttatttatttatttgagacagagtctccctctgtcacccaggctggagtgcagtggcgcgatctcggctcactgcaacctctgcgcccccagttcaagcaattctcctgcctcagcctcctgagtagctgggactacaggtgtgagccacaatgcctagccaatttatatatatatattttttagtagagatggggtttcattatgtcgaccaggctggtcttgaactcttgaattcaggtgatctacccatctcagcctcccaaagtgctgggattacaggcgtgagccaccgcgcctgaccttatttcatttatttttgagacacggtctttctctgatgcccaggctggagtgcagtggcgtgatcaaggctcactgtagcctcagcctcccaggcttcagcaaccgtgcccggccttagaattcactcttttaaagtgtgtacagccgggcgtggtggcccacacctataatcccagcactttgggaggccgaggctggcaaatcacctgaggtcaggagtttgagaccagcctgcccaacatggtgaaaccctgtctgtactaaaaatacaaaaaattagcctggcatggtggcatgcacctgtaatctcagctagtcgggaggctgaggcaggagagtggcatgaacccgggaggcggagcttgcagtgagccaagattgagccaccgcactgcaggctaggggatagagtgagactctgtctcaataaaataaaaaataaaataaaataaaatgaagtgtgcaattcaatggtcttcggtacactcacaatgttgtgtggtcatgacctctgttgagttccagaatatttcatcaccgccaaaggaatccctgtccccatcagccgtcactccctgtcccctccccagtccgcggcacccacgcgtcctcttcctgtctctgtggatgggcttgtcctggacatttcatagcaatgggatcacacactatgtggtctttcgtgtccggcgtctctcacggagcgtgacgtcctcacggtgcctccgcgccgtggtcgggtcacagctgggtccgtttcacggctgcgtcctgttgccacgcctggaggcctcactgtgctgctcgaggcccctgtggatggacgtctgagcctctccacttccggccactgtgaccctcactgctgtggacactcatgtgcaggtttgtgttggaactgctgcttttctttcttttgtgggtataacgggtccttttttttttttttttttgagacggagtctcgctctgtcgcccaggctggagtccagtggcgcgatctcggctcactgcaacctccacctcccgggttcacgccattctcctgcctcagcctcccgagtagctgggactacaggcacccgccaccgtgcccggctaattttttgtatttttagtagagacggggtttcaccgtgttagccaggatggtctcgatctcctgacctcgtgatccgcccgcctcagcctcccaaagtgctgggatgacaggcgtgagccaccgcgcccggccaacgggttctctttacagagggggaaactaagcctagagaggggtgccaatggctcaggagcccagccggtgggggccctgcctgggtttggagaggcaaagccactgcctgatcattgttcagatggggaaactgaggcccaaggcaggattggggttcaagggcttctggtgcccccggctcggggccacgttcggtcatgagggtccccctgctggggcgggattcctgccagaggcggtttctgccctcctccccccagcccctgctgctcccccttcctgggcccaagggtgctgttctcgggttcccctggtagcggtcagcccggctgcagggccctcagagcggggctgcgtgtgactgtgggcagcccgagtcctctccgcgcctcggatttcagggacatagaacggggtcccatccgtggacccacccgccaccccgcagccccgtccaggccccgacgcgtgcagcccccaccccgcagccccgtccaggccccgacgcgtgcgtgcagcccccaccccgcagccccgtccaggccccgacgcgtgcagcctcctggcagagccagctgtgctcaggctaaaaacagctgttctgtttcttctctgtgcccctctacccggccccactcactggtgtcttgagaaggtttttaaattttcggaattctcagaacagattgtgaaatgtctgggtttggcttagaaatcccgtgagagggggcatcaggggacaggtgggtggatgggcctggggggtgtggaaggcggccgggtgtcagggccccaagcacacgggaaggtcaacggtcggcacaaaacacacacaaaacacaaccactgcgaggctgagcctcgcgggcgaaccagcatcttcccgtcactcagggagagaaggttttcctttataaagaggagaggaaaggaggccgggcacagtggctcacgcctgtcatcccagcactttgggaggccgaggcgggtggatcacctgaggtcaggagttcgagaccagcctggccaacatggtgaaacctcgtctctactaaaaatacaaaaattagctgggtgtggtggtgggcgcctgtaatcccagctattcaggaggctgaggcaggagaatcgcttgtacccaggaggcggagcttgcagtgagccgagatcgcgccactgcactccagcctgggcaacagagcaagacttcatctcaaaaaaaaaaagaaagaaagaaagaaaaagaaagtagtagaggagagaaaaaagagagaacaagaaagatggagagacagagacggacagagacacagagacagagagagacggaaaaagagggacagagccagagagactgagagagatagttttaaaaaagggagacagcgatgacacagagagacacagacacagacacagagatgaagagacagacagatatagggagacagagacagactgagacagagagacagagacagagggagacagagacagagacagagaaggagacagaaagagggcggggagagagacagagacagagacacaggcctgagccccgcatgggtctcccctcggccccaggcggcgtcacctgcgatccctgaagccgttaccagttgcgccacctacggttggtacaggaaggggcccccactacctctgcccccaggccgacccctgcaaagcccccagcgtgttccacggaaccctccctgctacccgctcccagcgctcctgtcgccctggcctgtgcttttgagtccccccaggacgcacagggagcctggaggacccggggcccgcgggacggtgctgggaccctccggtcaggaccgggctgcatcagccttgcgtggaaacagatcctgacggggaagcccacgtacagtgaggacggggcagccccctgggcagctctcgcgtgtgctagatccagcagtgtgtgtgcaaggtctttcttttctttcttttcttttttttttggttgacagctttattgagatgtccttcacacacaccaagcaattcacccacttaacaattcggtagtggccagatggtgggggaggatcgctggagcccaggagttccagacgagcctgggcagcatagcaagacccctctctattaaaaaaaaaaaaaggcagggcgcggtggctcacgcctgtaatcccagcactttgggaggctgaggccggcggatcacctgaggtcaggagttcgagaccagcctggccaacatggtgaaatcccgtctctactacaaatacaaaaaacaaattattcaggcgtggtggcaggtgcctgtaatcccagctacttaggaggctgacgcaggagaatggcttgaacccaggaagccaaggtcacaccactgcactccagcctgggtgacaagaacaaaactccatgtaaaaacaaatcaagaaacctcaaatccgtcgacccccactgctgccctgcagaaggtcctattaccgtcctcacccgcctttacaggtggggaaactgaggactgcaagccaaacagcttgcctcagcatgagctgactcatggctgaaaccaacagcacttttgttgaatgagaataacccttttattttgagacggtgtctcgctctgttgcccaggctggagtgcagtgacgcgatctcagctcactgccccctccacctcccgggttcaagtaattctcctccctcagcctcccaagtagctgggattacaggcatctgccaccacacccagctaatttttgtatttttagtagagtcggggtttcaccatgttgcccaggctggtcttgaactcctgaccttgtgatccatctgcctcagcctcccaaagtgctgggattacaggcaacagccaccgcgcccggccacagctctagttctttttcttttttttttttttgagacggagtctcgctctgtcgcccaggctggagtgcagtggcacaatctctgctcactgcaagctccgcctcccgggttcacgccattctcctgcctcagcctcccgagtagctgggactacaggcgcccgctaccacgcccggctaattttttgtatttttagtagaaacggggtttcaccgtgttagccaggatggtctcgatctcctgacctcgtgatccgcccgcctcggcctcccaaagtgctgggattacaggcgtgagccaccgcgcccggcccacagctctagttctttaatacacatcaggtcggtcatggtggctcatgcctgtgatcccagcatttggggaggtcaaggcaggagcgtccctgaaggctggcagttcaagaccagccagggcaacatagcaagaccccatttctacaaaaaattaaacagccaaccaaaaaaaaaaaaaaaaagaaagaaaaactttagctggacatggtggagcatgcctgtggtcccagctacttggggggttgaggcaggagaattgcttgagcccaggaggtcgaggctgcagtgagccatgattacaccactgcactccagcctgggtgacacagccagaccctgtctcaaaaaatatatatgtatattttaaaatattatatattatataatgtaaataatatacatgctacatattttatgtatacatctatgttatatacattaatatagccaggtgcagtggctcacacctgtgttcccagcactttggcgggattacgggcgggtcacctgaggtcaggagttcgagaccagcctggccaatatagtgaaaccccgtctttactaaaaatacaaaaaaaaaaaaaaattagccaggcgtggtggtgggcgtctataatcccagctatacaggaggctgaggcaggagaattgtttgaacccgggaggcggagattgcagtgagctgagatcgcaccactgctctccagcctggtgacagagcgagactctgtctcaaaaaaaaaaaaaaatccaaaggggaaaacagtaactggacagtgcaggaaccggcagatgccctgaccacgtggtcaaggttattaccatcagcacgagacaggccgaagccatgggcttcgacgtggggggcctgagacagacacacgccacgcccgggactccctccattgagtcctgaggccacccaggaccatccccacggagggacgctctgcagagtgaccaccagctctcctcaatggtcccaagggctgagggagggcagagggactgcgcccgctggaggagaccctgacatctgaagatgggtggcttgtgtacccaggacccagcaaagggtggctggtgatactcagggggctggggcagagggggccatttggaatcaactttcgcgccctggcttcgatcacagcctggagggttgagcaagaggacagaatttagggaagctgggggagggaggccgggggagggagtttggggagcggggagggagtttggaccctttggacttctgtaagcgtgaaatcctttccaaatgaaacgttaaaaagctttttttctttttggcctccaagttcattcagtgcttctctccatttcactgtaggtttaaaccgttcagttataaataaataattttatcctctgtcctcggctttcccccgtttccggcactgcagacatgggggctggatttgtctctgcggcggggccatcctgggcactgcagggccctgccaggagctccctccaagtcgtgacaaccacggatgtctccaggcctcacacagggacccctgggggcagaatcaccccagggttagaggattccacagaccccaagagactctgagtcccatgatcctctgccctgctgaggtcccaggaggctgcacacattgaaatccacaccctgagtgggagggagagaggaggcgagtcccgggagctggggtcccccgggtttatgccgtacgccccatcgggagtttattctggtgtccggtgtgagcagggggcagactggattttttattttttatttttatttatttatgttttgagatggagtcttgctctgttgcccaggctggagtgcagtggcacgatcttggctccctgcaaccttcgcctcccaggctcaagtgattctcctgcctcagcctcctgagtagctgggactacaggcgcccgccaacacgcgcagctaatttttgtatttttagtagagatggggtttcactatgttggccaggctggtcttgaactcctgacctcaggcgatccacccgcctcggcctcccaaagtgctgggattacaggtgtgaggcaccgcacctggccatttttttccccaaataatgaacactggtctctcccctgggccctgtggacatcggggctggatccttctctggggcaggcccgtcctgggcactgcagggtgctaggcatcatccttggcctccacccactccatgccaggagctcccctttcgtgacagccacaggtgtcctcagacctcgcccagggtcccctgggggcagaatcacctcttgattgagaatcctggccttaaagggggaagaaaacccccagacaaaactggcaggaggatgttcgctggggcctcaggtgaggcactgagggcactcgtggtggggccctgccttcccgagctctgcatcctgtcccctgctacgtcctgctgtctgtccgtttccagctcacccacccacgggacacacctgccacggccggctttgctggggccacagggacctcgtcagggaggcgtctccttgtgggtggcacgtgggcatgtgttgctctgagggctgtggccatgttgcccacctggccagggacccccgacttgggtgggtgacagccagcctccccgcccccacaaaggttgggaccttgagcccaaagcccccacctcctccccggagtccgttctgactcccaggctcccaaggcaaaaggaggaagtggggacccagcctgggcattgggcaactcaacggcctctggcattgggctataagaggagcttgaccgtgggtgcaccctggaccccaccatggctcaccggccccccagccctgccctggcgtccgtgctgctggccttgctgctgagcggtgagtgagccacgtgcccatccatccagcctccaggccccggtggattgtggggaaatatccaccacgaggtccatccaaagcccttctggcacagctggggaaactgaggcagggtcaggggagactccactcactgctcgggaccaacgcttgcaggggtggggaggacaagggcaagggggagccctggccatttgactcagttgcctatctgtaaaacgggcaaaacccagcccttccctcctgaggagctgttttgggaattagctagtaacaggcgaattcctggacagcacccagccttcagcaaatgctcagtgaatatgcatgaatgaatgaatgagtgaatgaatgagtgagtgagtgaatgagtgaacaaatgaatgagtgaatgaatcaatgagtgagtgaatgaatgagtgaatgagtgaatgagtgaacgaatgaatgagtgaatgaatcaatgagtgagtgaatgaatgagtgaatgagtgaatgaatgagtgaatgagtgaatgagtgaacgaatgaatgagtgaatgaatgaatgagtgagtgagtgaaagggtcgaggagttagtgatgctggaatcaggggaagaagagagcatgggccccctcaggtccctatcctgagggtgattttctttttctttttcttttttttttttttgagacggagtctcgccctgtcgcccaggctggagtgcagtggcgcgatctcggctcactgcaagctcagcctcccgggttcacgcctttctcctgcctcagcctcccgagtagctgggactacaggcgcccaccaccatgcctggataattttttgtaatttttgtagagacggggtttcaaggtgttagccaggatggtctcgatctcctgacttcgtgatccgcctgcctcagcctcccaaagtgctgggattacaggcgtgagccaccgcgcctggccctttttttttcttttttgaaacggaatcttgctctgtcgcccaggctggagtgcagtggtgcaatctcagtttactgcagcctcagcctcctggggtcaaatgattctcctgcctccgcctcttgagtagctgggattacaagcacacaccaccacacctggctagtttttgtatttttagtagagatggggtttcaccacgttggtcaggctggtctcgaactcctgacctgagggggattttcaatgcctcagtttgttcatctgcaaaatgggtctctttgttggctgatttttttttttttttttgcttctttttttttattttgttttgttttgtttttttgagatggggtctcactcaggcatgagccactgcgcccaggattttttttttttttttttttttttgagacagaatctcactctgttgcccaggctggagtgcagtggtgtgatctcggctcactgcaacctgtgcctcctgggttcaagcgattctcctgcctcagcctcccaggcagctgagattacaggtgcgaaccaccacacctggctaattttttttttttttttttttgagacggagtgtcattctgttgccaggctggagtgcagtggggcgatcttggctcaccacaacctccgcttcctgggttcaagcgattctcctgcgtcaacctccggagtagctgggactacaggcacgtgccaccacgcccagctaatgtttgtatttttagtagagacagggtttcaccatgttggccaggatggtctccatctcttgacctcaggtgatccacccacctcggcctcccaaagtattgggattacaggcgtgggccaaccgcacccgaccaatttttctgcttctttaaaaacatttttttaaattttgttttagagacagggtcttgctctgttgcccaggctggagtgcagtggtgtgatctcagttcactgcagccttgacctcctgggctcaagcgatcctccctcctcagcctcccaagtagctgggacgacaggtgcacaccaccatgcctggctaattttaaaattttttgtagagatggggtcctcacaattttgcccaggctggtcttgaactcctgagctcaagggagcctcctgcctcggcctcccaaagtgttgggattacaggcgtgagccactgcacccagccacctggtctgcgtcttaaaagccttcctgactctcaggactgaaagctgccaccagggcgcctttggaaatcgtcgtaattataacccccccggcctgggcgctgagtccttcccaccagccagcaggcactgaccgggttgcagatcgggagacggaggctcggagaggcccaggggctgctctgccatcccccctttccctgcagcctgggggctccctgacgcctggactccccccctgcaggtgctgcccgagctgcggagatcgtgggcgggcacgaggcgcagccacactcccggccctacatggcctccctgcagatgcgggggaacccgggcagccacttctgcggaggcaccttgatccaccccagcttcgtgctgacggccgcgcactgcctgcgggacatgtgagcggccgcctccacacccctgtccgcccgccccgccctcttcctccagccctggcccggccactgtccctctgcccggggaggacccagctaagccccgtctgcagaccccaggccccgcgcgcgtgggcagttctggggggaggcccggggcagggtcgccgagggaggggtctggggctgcaccgcggcctcgggaagggccggctgtgggcggcggcgagtgtccagggcgccgaggagtgaccaccccacccccgcagaccccagcgcctggtgaacgtggtgctcggagcccacaacgtgcggacgcaggagcccacccagcagcacttctcggtggctcaggtgtttctgaacaactacgacgcggagaacaaactgaacgacgttctcctcatccaggtgggcgggcagggccgcgagggctcggaggggcacggccagagggctccgggacccccattcctgcagccagcattcattgagcacccactgtataccgggccacgaccgaggccgctgcagcctgggtccagtggcactggccgggggagaccgctccttggacaccaggccactcctcctccccgcctctcccccgcccgcgcctctcccccgcccgcgcctctcccctgcgcgcctctcccccgcccgcgcctctcccccgcccgcgcctctcccccgcccgcgcctctcccttgcccgcccctctcccctgcccgcgcctctcccctgcatgcctctcccttgcccgcccctctcccctgcccgcgcctctcccctgcgcgcctctcccctgcccgcgcctctcccccggccgctcctctcccccgcccgcgcctctcccccgcccgcgcctctcccctgcgcgcctctcccctgcctgcccctctcccctgcctgcgcctccgcccggtgtgctgttcccccagaaagccaggtgccctcgcctcctccggcgcctcccctgacctcactggaagtggcgaggacagccacagccctccccgattcactgttctccactgaaccgcgtgctcctctcattcatggggccctcctagcctcctcccacccagaaagatcagctccccagggcagaggatttttgtctgtgttgttcgttattggactcatgtggcttagaacgggactgggcatacaggtggtgctcagtaagtgcttggggttgggcactgtggctcacgcctgtactcccagtactttgggaggctgggatgggaggatcacttgaggccaggagtttgggagcagcctgaccaacctagtgagaccccatctctataaaagacattttttttttttttttttttagacagagtctcactcagtcatccaggctggagtgcagtggtgcaatctcggctcactgccacctctgccttccaggttcaagtaattctcctgcctcagcctcctgagtagctgggattacaggcatgcaccaacacgcttggctaatttttgtatttttagtagagacggtgttttgccacgttggccaggctggtctcgaactcctgacctcaagtgatctgctctcctcagcctcccaaagtgctgggattataggagagagccaccgcgtccagcctacaaaagaaaaatttaaaaatcaaccgggcatggtagcacacgccaagccactcatgagctgagatgggaggatcacttgagcccaggaggttgaggctgcagtgagctgtgatcatgccaccacactccagcctcggcgacagagcaagaccccatctcaaaaaaaaagtgctttgaagatgaatgaatgggccaggggcggtggctgtaatcccagcactttgggaggccgaggcgggcggatcgcctgaggtcaggagtttgagaccagcctgatcgatatggcaaaccccgtgtctactaaaaatacaaaaattagctgggcgtgacggcaggtgtctgtagtcccagctacttgggaggctgaggcagcagaattgcttgaacccaggaggcagaggttgcagtgagccgagattgtgccactgcactctagcctgggcaacaagagcgaaactccatctcaaaaaaaaaaaaaagaaaagaaagaaagaaagaaaacatgaatgaatggccgggcactatggctcacacttgtaatcccagcactttcggaggctgaggaaggcagatcacttgaggttgggagtttgagaccaggctggccacctcacccaatgggatggctccgggaggttccagtgagccgagatcacgccactgcattccagcctgggtggcagagcaagactccatctcaaaagaaagaaagaaggaaagaaaatgaatgaatacaatagtgacaaatgggacaaagggggtcgtggggcccaggcggagggagcggcatccgcggcgttttgaggtggtgggtgtggtgggtgtggtgggagggcggcccgggcggccaccgtgacctggaagcagcgtctcaccgccgcctgccttctgccccagctgagcagcccagccaacctcagtgcctccgtcgccacagtccagctgccacagcaggaccagccagtgccccacggcacccagtgcctggccatgggctggggccgcgtgggtgcccacgaccccccagcccaggtcctgcaggagctcaatgtcaccgtggtcaccttcttctgccggccacataacatttgcactttcgtccctcgccgcaaggccggcatctgcttcgtaagtaaccgtgcccccaccccgggcaccgggctgccatgaggggaggagggcggcggccagggttccacgccacctcttagctgtgtggcttcatgctgtgcctcagtctccccacctggaaggtgggcacacccaacacccaacgggcaggctcagcggggtgggggcgctcacattgcacctggctgcttgggtgggtctgggggttccctgccccccactcccctctaggaccacaggaaggtgtgggagacccatccgccctcaccggcggccccttccagaatccaggactccaggtatccagcgggaggcccataaatgcccagttcctacgaaagacctcagcccctccctgctcacactttttgtttgtttttgagacggagtgtcgctctgttgtccaggctggagtgcagtggtgagatctcagctcactgcaacctccacctcccaggttcaaggtattctcctgcctcagcctcctgagtaactaggtgcacaggtacctgccaccgtgcctggctaatttttttggtatttttagtagagatgaggtttctccatgttgaccaggctggtcttgaactcctggcatcaagtgatgcctggctggtgctcacacattttaaagaaaattccaggccagcagtggtggctcacgcctgtaatctcagcactttgggaggccaaagcggaaggatcttttgagtccaggagttcaagaccagcctgggcaacatagcagggtggcatctctacaaataatttaaatattagctgggcatggtgatgtgagcctgtaggcccagctactcaggaggctaaggcaggaggatcacttgagcctggggagttcgaggttgcagtgagctatgattgtgccactgcactccagcctggagaacagagcgagaccctgtctcgagagaaagacagccagctactcgggaggccgaggcaggagaatcacttgaacccgggaggcagaggttgcagtgagccgagatcacggcactgcactccagcctgggtgacagagcgagactctgtcgcaaacaaaacaaaaacaaaacaaaacaaaacaaaaggagaaagaaagaaagagatagagagagaaagaaagaagaaagaaagaaaaagagagaaagaaagaaagaaagaaagaaaaagaaagagagagagagagagagagagagagaaagaaagaaagaaagttccatattggaagcattttattctgaaacagctgtggctaccccagcccccttcctggctgcctggggccagcccgggtgactggctgtccccatcctcccgggagactcaggtggcccctgatgggtgactggccgtccccatcctccagggagactcaggtggcccctgatgggtgactggccgtccctgtcctccagggagactcaggtggccccctgatctgtgatggcatcatccaaggaatagactccttcgtgatctggggatgtgccacccgccttttccctgacttcttcacgcgggtagccctctacgtggactggatccgttccacgctgcgccgtgtggaggccaagggccgcccctgaaccgcccctcccacagcgctggccgggaccccgagcctggctccaaaccctcgaggcggatctttggacagaagcagctcttccccgaacactgtggcgtccgggacggccccacccgtccccccacactccctcccacggggctccgggagacaggccggccctgcacctcaccccaccgtgacctcaataaacgttgaaactccccctggctcctgtctgtccttcccatatagggaggggagggggaactgcccaccgtgacctcaataaacgttgaaactccccctggctcctgtctgtccttcccatatagggagggaaccagggagaggtcccctgggttcaagtccccgagccccaaactcaggatggggggagtcggagcgggggatgggggcccaggttgcagggggtctctctcctggatgctcgtggctgtgggttctaacccggccccatcagggtggccctgggcaggttgttattcatctccgtgcctcagtttcctcatctggaaaatggactcgccccagacgtttcctagaactgtccctgctggctcagggactccttgaggaaggggatggggatggggaagcagcctggggggcttcctggaggaggtggcagtgccagagctgcatatcaaggtgtgaacagaaacatccgaagggctgccaggcagggggcacagtccaggcagagacctgagggctagaggccaggggacggggaggagggcaggcaggggagggatgtgggtgcaggggaggggtaatggggttggagcgctatttctcgtaggaggggtaggcagggcaggagttccctggtagaagcatgagcaatgaactgggtgggggggtggccagaggggaggtccgaggcggggaagaggtgggactcacagtccagctcaaagacgggcaagtggccactagaaggaggcattagccacagagaggggacgacctgctccaggacacgtgtagagaagaaatgaagctcattgctggtgttttttttttctttttaatatttttttgagacagagtctcgctctgtcacccaggctggagtgcagtggtgtgatctcggctcactgcaagctccgccacccgggttgaagcgattctcctgcctcagcctccggagtagctgggactacaggcacagaccaccacgcccagttaatttttatatttttagtacagacagggtttcaccacgttgtccaggctggtctcgaactcctgacctcaggtggtccacccgcctcagcttcccaaagtgctgggtttacaggcgtgagcctacttacttatttacagctggcctacttatttatttttgagacagggtctcactctgtcgcccagtctgtagtgcagtggtgcaatcttggcttaccgcagcctcaacctcctgggctcaagtgatcctcccacctcagcctcccgagtagctgggactacaggtgccaccacacccagctattttcttagtttttgtagagacggggtctggctgtgttgcccaggtgggtcctcagtgactctttacatatgaacacctccaggtcactgtaatcttagcaatctcctggcctcccagaagaccccacgtccccctcggagtctacacccgctgtgaccataacacccctaccttccctgccacagttaatggtgaaccagctctcaaagcaacactttctttttttttttttttttttttttttttttgagacggagtctcgctctgtcgcccaggctggagtgcagtggcatgatctcggctcactgcaacctccgcctcctaggttcaagcaattctcctgcctcagtctcccgagtagccgggattacaggcaggtaccaccacgccaggctaattttgtatttttggtagagacggggtttgtccatgttggtcaggctggaattcccaacctcaggtgatacacccgcctcagcctcccaaagtgttgggattacaggcctgagccaccgcgcccggccagacaacactttcttagctaagaactttatgaacgtgaatttatttcatcctcttgacaggtttatgtgatggatcctacgattataattttacagaggaggaaactgagtcacggagagtttatttcaggggcctgaagttacacagtggccaaatggccacaccagaaccaggatatgaacccagcgtcggcacacttaataatgactgcacgtgagaatgtagtatacagctggtgctcaataaatgcagctgacgccaagtctgatctccgtgctggaggccaagccccttccaaagatacggcgtcccccacccctgaaatccccccacccccgacttgaaacagggctgtgtagacagtaggcgcttactaagtgcactgtggtgatgttaaggcagcaaggtgggaaccctgccaaaaggggaggggagaaggcagggtagtgtgtgtctgattaagctgaggacagggcagacatggactgagcgcctgctgtgtgccaggctctgggagggcagggccattgtctccctaacccgagagccatgggggtccacttgcctgtggtcacgtcaggactccagcctggcccaggctctgcgtgtccccgggtgccctcgccccgcctattcctggagacaggcccgttggttcccttcccctccccttgtcctggagccaggaggacgttggttcttgcgacagccttggcccggccgttgcagctggaacatcgtgggggagatgggaagaggaacggggcccggagcccggggctgggtcctgggaatccctttcccgcagctgggactccagctcccctgccagttcctccaggcggaagccctcaggcttggtcctcactccagcctcccggcctggacaggaattctctctccagcagccctgccagatgcccgcccagcccctgcctcaggcggggagggcttcagggaagctcaccaaggcagaagggcgggagagattgtcagagccccagctggtgtccagggactgaccgtgagcctgggtgaaagtgagttccccgttggaggcaacagacgaggagaggatggaaggcctggcccccaagaatgagccctgaggttcagggagcggctggagtgagccggccccagatctccgtccagctgcgggtcccagaggcctgggttacactcgcagctcctgggggaggcccttgacgtgcctcagttcccaaacaggaaccctgggaaggaccagagaagtgcctattgcgcagtgagtgcccgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccgtatcacagggccctgggtaaactgaggcaggtgacacagctgcatgtggccggtatcacggggccctggataaacagaggcaggcgacacagctgcatgtggccggtatcacggggccctgggtaaactgaggcaggcgaggccacccccatcaagtccctcaggtctaggtttggcaggtttggcaaaaacacagcaacgctcggttaaatctgaatttcgggtaagtatatcctgggcctcatttggaagagacttagattaaaaaaaaaacgtcgagaccagcccggccaacacggtgaaaccccgtctctactaaaaatacaaaaaattagccaggcgcagtggctcacgcctgtgatcccagcactctgggaggctgaggcaggcggatcacccgaggtcagatgttcaagaccagcctggccgacagggcgaaacactgtctctactacaaatacaaaaattagccgggagtggtggcaggtgcctgtaatctcagctattcaggaggctgaggcaggagaatcacttgaacctgggaggcggaggttgccgtgagccgggatcacgccaccgcactccagcctgggcgatagagcaagactctgtctccaaaaaaataaattaaaaaacccacattgattatctgacatttgaatgcgattgtgcatcctgaattttgtctggaggccccacccgagccaatccagcgtcttgtcccccttctcccccttttcatcaacgccctgtgccaggggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggggtcgcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatcccgtgggttcccggtgggggatcccgtgggttcctggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctccccggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcggggcggggggcgcaggggcggaggccagaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagaagggaggccccgatctgttgtcaatcaacaaacttactgagaagggaggccccgatctgctgtcaatcaacaaacttactgagattctttgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacaaaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacagcctccatctcctgggctcaagccaccctctcagcttggaatggggggtagctggaaccacaggtgccaccacgtgggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaaataataaaaatatatatatacacacatatatatatattttttgagacaagtctcgctctgtcgcccaggctggagcgcagtggcacaatctcagctcactgcaacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagccaccgcacctggcaatttttttttattatttttgtagacatggggctttgccacattgcccaggctggtcttgaatgcctggcctcaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggactgcagcaacaggcaccgtggctagaccctaggagggacttcccaaccctgacaggcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaatgtgtttgatgctccttggctgtgtgattgggtgttgaaaatggtcagtaggtcgggcgtggtggctcacacctgtaatcccagcactttgggaggttgaggcaggcggatcacttgagctcaggagttcaagaccagcctgggcaacatggcaaaacccccgctccattaaaaaaaaataaataaataaaataaaataaaataaaatggtccaagcctggcccagtggcttacgcctgcaatcccagcactttgggaggccgaggctggcagatcacctgaggtcgggagttcaagactagtctgccaacgtggtgaaaccccatctctactataaatacaaaaaaaattagcttggcgtcgtggcgcgtgggaggctgaggcaggagaatcgcttgaacctgcgaggcgaaggctgtagtgagccgagattacgccactgcactccagcctgggcaacacagagagactccgtctcaaaaaaaaaaaaaaaaaaaaaaaataccggtgcggtggctcgtgcctgtaatcccagctctttgggaggcccaggcaggcggatcatctgaggtctaaagttcgagaccagcctgaccaacatggagaaaccccatatctactaaaaatacaaaattagccgggcgtggtggtgcatgcctgtaatcccagctactcgggaagcctgaggcaggagaatcacctgaattctggaaggtggaggttgcagtgagccaagatcgctccattgcactccagcctgggcaacaagagcgaaactccatctcaaaaataaataaataaataaataaataaataaataaataaataaataaatataaataataatgataataataataataaacaacaaactagaatccagagtctcttgggcatctctggagtaagccaccaccagggggcagcacagccagggcaatggagcagaagtgacttccccacattgtgtttttttcttttttgtttttagatggagtctcgctctgtcgcccaggctggagtgcagtggcgcgatctcggctcactgcaagctccgcctcccgggttcacgccattctcctgcctcagcctcccgagtagctgggactacaggcgcccgccaccacgcccggctcattttttgtatttttagtagagacggggtttcaccgtgttagccaggatggtctcgatctcctgaactcgtgatccgcccgccttgacctcccaaagtgctgggattacaggcgtagccaccacgcccagccctgttgttatatcattttctattctctgtgcgtatgaaataatccacagggggccaggcatggtggctcatgcctgtaatcccagcactttgggaggccgaggtgggcggatcacctgaggtcagaggttcgagaccagcctggccaacatggcaaaaccctgtctctactaaaaatacaaaaagttagcccagtgtggttgctcatgcgtgtaatcccagctactcgggaagctgaggcagtagaatcgcttgaacccgggaggtggaggtcgcagtgagccgagattgtgccactgcactccagcctggacgacagagcaagactctgtcgcaaaaaaaaaaaaaaagcaagaaagaaagaaaaaaagaaggaaagagaaagaaagaaagaaaaagaaagggaaagaaagagaaaaacagagaaaggaaggaaggaaatgaggctaggcgtggtggctcacacctgtaatctcagcactttgggaggccgaggcaggcggatcacgaggtcgggagatcgagaccatcctggctaacacggtgaaacccatctctactaaaaatacaaaaaattatccgggcgtggtggcggacgcctgtagtcccagctactccggaggctgaggcaggagaatggtgtgaacccgggaggcggagcttgcagtgagctgagatcgcgccactgcactccagcctgggcgacagagcgagactccgtctcaaaaaaaaaaaaaaaaaggaaagaaaagaaagaaatgatccatggtgaagagaaaagccgggggaacctcgtgtgctgctccccctggggacaatgtctgaggtcctccccacaaggtatccccatccttctggtccccgcaccatggattaatgcaacgtgaatcccgctggcccctgtggggcagatgtgaaaaatggagctacaccatgagcaggcctgcagtcccagcacttctggaggctgaggtgggaggatcacttgagccccggaggtcgaggaggctgcagtgagctatgattgcaccgctgcactcgagcctggatgaaagagcaagaccctgtctgtaataaaacaaaaacaacacacacaaatccccacctcacaaaaggccctatggcccagattctgagaagtattttattttaatttttttgtagagatggggtctcgccgtcttccccaagctggccttgaattcctgggctcaagagatgctcctatctgggtctctcaatgtgccgggatggtaggtgggagccactgtgcccggccagccctgactctgttcatcagaacctgccctcagtgaacagtttgggagggggcgtgtgatccaggctccaccaacccaaggcacccttgagacttggctggagtgaggaagaattttaggaggggcccactgagccactgggttgagtgtggggtccctggaaacacaccaggggaggctggtgaggaaagaagccatcagagaagaaaggagaagccagaagcagacactggacattgttcaggcacctggatcaagccacacctgaaggcggacatccctgaactttccatataactttcatgattcaggctccacccagtttgtctgggttttcctgtcccttgtagccagtcttcccagctgcctctgccttggcctttccaactttctattcgtcagggtgtcaagccccagaggccacagggacagagacaaaggtgtcaagtgaccttcctacccccaacagaccttctctctaatatagaggaggaaaagaagggagggtagcaggacaagaaagtgggttgtttacacgctgtggcctccagctaggattgtgaaacaccctgggggactctgggtgtggtgaagttggggccggggtgggtgcagcccccctctctgcctcctgcccatctgagggactgccccccaccagggccagcaggctgtcaggctcacagaggcccgagggtctcccagcgacttgtcgactctggtgtgagtctggcaggaggtaacccagtcccggggagggcggaggctgggcgggcgagttcccctttccccagctgggccgctgcccacccggggagcggcccgccccctccaccctcataaaagcacccccagggccctgcctgggtcagtgtctcagccacagcggcttcaccatgcacagctgggagcgcctggcagttctggtcctcctaggagcggccgcctgcggtgaggaggcctgggcctggggtgagggacagggctgtgtaggggcgtggtgctcccttccgtcacacggacggtcctccagcccctccaggtgggcaggaagggggtgtctctcctcactaatggaaggctctgaacgctgaaaaattctagaaaattcagattggaaatcggaactttctggagtcagcttttcttgcagacagagtctgaacgtctgcgtggaaaacttcatctgcgtggctgactgggctggcccaggcactggctgggtcagccccatttctcttatgtccaactggaaggcactgcgcccagggtagggcgctgggatctgcccccggtccccagcccactgtgggttctgtactctggggcattcccgcccgagggtatctgagtttgcaacgctgaggggccccaagacggaaacgggattcttttttttctttctttttttttttgatagggagtctcgctctgtcgtccaggctggagtgcagtggtgcgatctcggctcactgcaaactccgactcccgggttcaagcgattctcctgcctcagccttccgaatagctgagattataggccacgccgactaaattttgtatttttttttaaagtagagacggggtttcaccatattggccaggctggtcttgaactcctgacctcatgatctgcacccccccctccccccccgcccccgcgcggcttcacaaagtgctgggattacaggcgtgagccaccgcgcccagagatgggattcttgcggggagcggcctggggggtgagagctgggatcccgtcaggcagcctcgcccgggggaggagtccaccccgcggccctcacgcgcccgcccacccacagcggcgccgccccgtggtcggatcctgggcggcagagaggccgaggcgcacgcgcggccctacatggcgtcggtgcagctgaacggcgcgcacctgtgcggcggcgtcctggtggcggagcagtgggtgctgagcgcggcgcactgcctggaggacgcgtgagtgcccgcgccgcgcgggggaagagcccgggtgcggtggggggagtcggctggcaccgaccgcggactccgtccggtccccagggccgacgggaaggtgcaggttctcctgggcgcgcactccctgtcgcagccggagccctccaagcgcctgtacgacgtgctccgcgcagtgccccacccggacagccagcccgacaccatcgaccacgacctcctgctgctacaggtcggccccgtgtagcgcagtccctcctgcggcgctgggatccccggcccaccctcactccaccccgcctacaccgcgccccgggtccagcctcgacctctcctgctgcatggggaccccgccccacaacccccacaccctcaccccgggtctagcctcgacctctcttgctgcgctcggagcccccccaccctctgcaccctcaccccgggtccagcctcgaactctcctgctgcatggggaccccgccccacaacccccacaccctcaccccgggtctagcctcgacctctcttgctgcgctcggagcccccccaccccctgcaccctcaccccgggtccagcctcgacctctcctgctgcatggggaccccgccctacaacccccgcaccctcaccccgggtctagcctcgacctctgcggctgcactgggagccccccaccccccgctccccctgcatccccatcccggttccagcctcgacctttgcagctgcactggtgagcctcgcacccaccccatccccacctgcacccccacccagggtctagcctaaatctctcctgctgcactgagacccacgcccctgccctgatgcccacctcccccgtcccgtctccccgagcctagcggcattctccccagcctcgcacccccgcaccccaaccctgacgtccgcctccaccctcagctgtcggagaaggccacactgggccctgctgtgcgccccctgccctggcagcgcgtggaccgcgacgtggcaccgggaactctctgcgacgtggccggctggggcatagtcaaccacgcgggccgccgcccggacagcctgcagcacgtgctcttgccagtgctggaccgcgccacctgcaaccggcgcacgcaccacgacggcgccatcaccgagcgcttgatgtgcgcggagagcaatcgccgggacagctgcaaggtgagccttcaggcctgggaggagacgcggggcctgcaggccccgggaagggcctgcagagggagcgcgaagcggggggcaagtaggaacagggcccagggaaggggcggggcgcgtagggggcgggaactggaagatgggcggagcatgagggtggcccgtgggcggggcctgtatgagggggcggggcatgtgggtagggtggggccttgggggcgaggcctggagaaggtacggggcctctggagagggtggggctgaagaagggtcagggcgggcagaaagggcaggaacgggtgggatgtggaaggacctgtgggttagggtgggaatagggggcggggctcgaggagggggcggagtccagtaatagcgggactgcaagggggcgaggccaggaagagggttggggcatgaggggcagggcatggaggaaggggcggtacctgtggggagggtggggctggagaagggtcagggcgggcaaaagggcaggtggcagagaaagggtgggaggtatagggggcgggcacgtggaggaaggggcggggcatggggacggggcggggcaggtggaaggggcgggaacctctgaaggggcagggctggtgcggagcgggatccctgctgtggcagggaagagaaggggtcctgagcagggcagaggtttaagaccagccgaggcttgcatggtagccggggccaagattgggtggggcttaagggaggggcgtggcctgaggtgagtggggactgagcagagcaggtggccactgagacgcgttagggcagaagtgggatccacggcaagtcaaagcttggaagagcaggaatgaggtgtgggacccccatactggaaagggcttggagcggggtggggtcgggggaacacgtggtgaggttgaggccagagggggtgtggccaggagctgggggcgggcctagaggggcgtggcttgtggttgtggcctaggcgataggcgtggcgcggggctattgactagtgaagaccaaattaacacgggagggatgagcgagcattgtggggcgggagcggcagccaggtgagggggtctaacacgtgaggccggggtgggcgcgggccgcccctcacggccccgtcctgttccggcagggtgactccgggggcccgctggtgtgcgggggcgtgctcgagggcgtggtcacctcgggctcgcgcgtttgcggcaaccgcaagaagcccgggatctacacccgcgtggcgagctatgcggcctggatcgacagcgtcctggcctagggtgccggggcctgaaggtcagggtcacccaagcaacaaagtcccgagcaatgaagtcatccactcctgcatctggttggtctttattgagcacctactatatgcagaaggggaggccgaggtgggaggatcattggatctcaggagttcgagatcagcatgggccacgtagcgcgactccatctctacaaataaataaaaaattagctgggcaattggcgggcatggaggtgggtgcttgtagttccagctactcaggaggctgaggtgggaggatgacttgaacgcaggaggctgaggctgcagtgagttgtgattgcaccactgccctccagcctgggcaacagagtgaaaccttgtctctctctacaaaaaaaaaaaaaaaattctgcgtggtggctcacgcctgtaatcccagcactttgggaggccgaggcgggcggatcatttgaggtcaggagttcctgatcagcctgaccaacatggtgaaaccccgtgtctactaaaaatacaaaaaaaaattagctgagcgtggtggtgggcacctgtagccccagctactcaggaggctgaggcaggaggatagcttgaacccgggaggcggaggttgcagtgagctgagatcgcaccactgtactccgacctgggtgacagagcgagactctgtctcaaaacaaaaacagaaacattaaaaaaagaggaacgcgggaagctacagataaaagcgcaagaacggagaatacagcgaagttccgggtccagcgcttccgtggggctgacgcggccacacggcggcgcccttgccacacacacacacacacacgcgcgaaggcccgccaggcatgggtgtcccctcctggtctggctcataccgtttccctttgcttaccaaggggaatgtgagcgtcttctgtgtgcaaggctgtgggctgagactcaggtgcacagaaacccttcgaggccgtgttcctatgacccatatcccataaggggaaactgaggctcacagggactgtgcgactctcctgaccttacacagaagctccaggacacagcctggactggagcccagagccacggagcctgccttcacaaaccaccctgggtgcggccagacccacaccaggacgacgagcagcggcacctgcttgctggaggccctggacctcaggtcacccttcttggcaaggccagggaggacacctgaggccctgtgccctttctcccacctggtggaggggcagccaggcgctatcgtagaaaaagactgatgggccaggcgcggtggctcatgcctgtaatcccagcactttgggaggccgaggcgggcagatcacaaggtcaggagattgagaccatcctggccaacacggtgaaatcccatctccactaaaaatacaaaaaaattagccgggcgtggtggcggatgcctgtagtcccagctacttgggaggctgaggcaggagaatagcttgaatccaggaggtgaagcttgcagtgagccgagatagcaccactgcatttcaacctgggcaacagaaggagactccatctcaaaaagaaagaaaaaaaaaaaaaagagaaaagaaaaagtgactgatgggccgggtgccggtggctcacgcctgtcatcccagcactttgggaggctgaggcgggcagatcatgaggtcaggagatcgagaccatcctggctaacacggtgaaaccccgtctctactaaaaatacaaaaaattagccgggcgtggtggcaggcacctgtagtcccagctgctcgggacgctgaggcagaatggcgtgaacccgggaggtggaggttgcagtgagtggagatcacaccactacactgcagcctgggtgacagagcgagattccatctcaaaaaaaaaaaaaagactgatgatctgagaggcaggtccgctgggaaaaggggggatggattgatgaacactgtgcttgggtgtttttggggctatggaacactcacctaggaatcacactgacgtgcaagcacgtattgagcacttactgtgtgcagagccctgggccgggcacggtaagacacatctaagccccagccctgctcttaggaatttggtaaatactgcactgcacggaagggggcccattcagccgtctggtgaccaccacgaagttggagctcactgtgtgaatttcacgtttttgtttttgttgtttttgagacggagtctctctcgtcgcccaggctggagtgcaatggcacgatctcggctcactgcaacctctgcctgatggttcaagcgattctcctgcctcagcctcccgagtagctgggattacaggcatgcgccaccacgcccggctaattttgcatttttagtagagacggggtttctccatgttggtcaggctggtctcgaacttccgacctcaggtgatccgccccccctcggcctcccaaagtgctggagttacaggcatgagccacctcgcctggccacccagctaatttttaagatttttgtagagatgaggtctcgccatgttgccccaggttggtcttgaactcccaggctcaagtgatcctcctgcctgggtctcttatggtgctggtgcgtgagctgctgcatccggcctgcctgggcatctttgcatcctttggtccgcaggagctacggagggttccggaggaggagacggtttaggaggcggtggaacaggagtggtggggaggatgcaggacgggaacatctgggcaccacatagtcctctgagttgagacgcggtccagtctccgcactgccatatatatggcctctgtttcctcatctgtatctcggggccccaacgtccctggctcttagggagattttgaggacccctgggggaaccgcgaggcgacgaggaccttgggaagccgggggcggggacagcagagcttcagggccacaggccgcctctcagcacccccatgccctgcctgcctcgcccaccccactgtacctgagtgaggtagaagctcatgacagccagcttgtgacagtggtctgacagaccccccccccacctagtgacgcaaagcccaccccggctcaagtggtcaggaactgatgggaccagggggcatcctgtccccactccacgcgtccagacctcagccaggtcaccagaaccacggggggctggggtcagctagaggcattttcacttctgagtcgggcactgggtgactctgatctcccggcccctgaagctgcccacgagcctgcgtcccacaacgcatgggcaccctcaccagtgctcccatctcctccccgtccacccgccgcaggcctgcacccctcgccagcgctcccatctcctccccgtccacccgccgcgggcctgcacccctcgccagcgctcccatgtcctccccgtccacccgccgcgggcctgcacccctcgccagcgctcccatgtcctccccgtccacccgccgcgggcctgcacccctcgccagcgctcccatctcctccccgtccacccgccgcgggcctgcacccctcaccagcgctcccatgtcctccccgtccacccgccgcgggcccgcacccctcaccagcgctcccatctcctctccgtccgcccactgcgggcccgcacccctcgccagcgctcccatctcctctccgtccacccactgcgggcccgcacccctcgccagcgctcccatctcct

SEQ ID NO: 36748 - DNA, 808603 bp, Homo sapiens
gaagaagtaggggcggggggaagtttaggagttgaggaaagaagattaaagagcgcgaggaggtaatgccacaaactctaatttgttgtgggacgggcgggagagagggaggagtgtgtgcgtgccgagggggatgaggcgtctgcgaggcgcctggagtggggggcggcgggactgggaaggaggggagcggggtggggttgggggagcgagttacagagcggcgagccagcgggccctgagctggatgagcgcgcgcgcccccgcgccccgccccgccccgccccgcccgcgccccctcccccggcgcccttcttagcgcccggcggctgcctcgcccgacccggcggggaggtgggagggaggcgcgggagggtcgaagggtggcggggcgggcgggacgtcccgcagctggaaacgtgtcttctgccttcttctctctactccctgcgcctggagccgctgcttccaagaagaggagctgagggggactagccggggctcaggagctgctagaggcgcccgcttgtcttctgccccctccctcctcgccctcccccgcttgccgtggctctcgcggtctctggagcgtcttcagagaactggggggcaggaggtgtcctggccccacagccgctggatgtctctccagacgccggagctcccggcccccgcctgcttcgcttctacgactagagaggagggggcttgggaagggaagacacacctttccttctttctcttctttgggccacttcggaaacattaaaacatgttaacactttttgattcctgatataaaaatggttggaaggttcttgaaagtttaaaacaaatgccgtctctcgtacactgtttaatgtattcctgtctgtgtggcttttgggtcctccccccaccccccgcccccagctgttatcctttttaaggatgctgaagaggcaggaggcagggattttctaaaagttctattgataaacacacttgcacaaacatatgctaggcacacacacaaactaaacattagcgaaaaacacaatatggcgtacagctacggtacctagcgcggtaatccgctgatctctcactccgaactgggttgaatgaggtcagtagcaggatgacagctctccaatgaaaatctgaatgaatcaggaagtagtttggaagcttgcgggtgtagtactgtcctcagaatcagcattggccaaacctaagttgaacatgttacctttctagacatgtgaaaatcttctccactgttttttctattaaaaataccaaaagggtgctaaagtcaagtttcctcactgcgtggcggtgtatacatttcagctaaaaaaattatagaggccattcacccaatgttttcaagtgaacgctattctgaagttactgttgtaacttgttgccattgaaagttttaaaacacaattaccattttataaataaatagctgtagacactaaatttaagtgataaccagtcatctttaaatttataatggtttgttttcatttctgttcatgctcccaatcccaagtaccctttgctattttgtggaaatatttatatagatccccctccactcccggtcacatacagtcagcccttcctgtgcctgggttctgcatctgtggatttaaccagctgcagatcaaaaatattttgggtgtgggggaatagatggaatagaatatatatagtttttttcttgccacaattccctaaacaatacagtgtaacaacgatttattaatacatggcatttacttgtattaggtgttataagtaacctagagatgatttaaagtatgtgggagaatgtgattaggttaaatgcaaatactacactattttatgtaagggacttgagcatctgtggattttggtttcctagagaggtcccagaaccaatctcccatggatactgagggtcaactgtaagtttgtccagtcaagatgtggctactttttgcttttttgctttaaaatgaagaatctgtatttttctagtgaaagaaaaaaaattacattgattttcatgcctttgttctttgtgattcttagaatatatcaaagttgttgcacacatagtgcatggtgatatccctgtgccatctttccagtagtctcccaggaaagcttttgaaattgcccttgaggaattgctgatgtaactgttcagtactcaaggcttaattttcaagattggggttttgatttttatggagctcaattttggagggccttaggtttggggacacatggtgttgaagtaaacaggtgagaagaagaaaagtgagatttctagaactatattagctgctcagtgagttgggcaattggatatttttggttttatgatttcagattttatagaccagtggaatacaggccttgtgcatatgaagatcaggtgacaagtttgctgcctaccagcctccacagcaatatgccctttcacggtgaggtcctaattttaacaagctaaagaaagtatcaggttaaaaattgtcaaattttatccatttccaggaagaagtctttatgcttacccatctaggcccgtgttttaagattactacaaaaccaagaaaatgcacatataggtcatgtgtacattgactagctactaaaagaaaatacgagattaaatggaatactagaggaaagagaaactttcatgtgagggctataattggggaagggggtgtttagaactaccagttgatgtgatgccagtttcttctataattggatcagaaagtttttgaggcccgcaaacatctaattcctcttgttgtcctgttaataagaatttgactacttggtataggaagaaaatctaaggaaaaaatattttaagcgaatcatttttgttgcattagtgaaagttttcagaagactttttagacaaattggactttctagtaaaaaggctagtctgaataattaggtaaattggactttctagaaaaaaaggccagtctgaataattaggttgttttagaagggcaataaaagctacagctaagttcctgcgatctataatttataaaataattacatattattttgaataacttcacagaatcagtggcaagcagagacttcttcaaaaacatttggaatacggaagtagagattgatgggctttgctttagtctctgaaataatcatatttttctgaaatggatggttaaatttatcatattgttctagacacttggagtgtaataatgaacaagagagaaaattgcctgcccttgtggagcttacattctaatgtcacacacactttgtgcattttagattgttaggggaggagattttttaatgaaactttaaaacctagctgctttcttgtcttaggaactacagtttgaaagagcctacagaagtttgagaaggaggaaggtgtttaccagttggcagtgataggaaagaaagatcttagtttatttcttatttgtaccttttgttattgtcatgaaactttctccatatatttcagttggtaattttaacagatagggatttttttcatgattttaataatgtctttgaaattaataaaacgttgctttatattaaaaaaatcttgtgtcttgaaagttactataaaattcctacatagtattatcccgttagcaaagtatggtaaaacaaaagctagaatatctgttaatttttggttgggatttgtttttaggaacatatctgaaaaatcaagtacctaaatctttttcagttctgggtttctttttcgttttttgagatgggaatctccttttattgcccaggctgtactttaactcctgggctcaagtgatccgccctcctgcctcagcctcctagtagctgggactaaggtgcatgccaccatgcctagtttcagttgtgattttatcaagagaaggtgaaaatttattgtaattagtttataggcgacattaaagaggagagacctgcaaaaaatgctttgttatttaaaccattttttcaaaagcatttgattggcacttttctgctttaatagacttatttgtaatgcaagaggaacattacagaagattttagcaatactttaatcatttagtctgtaggtgtaaaaatcctgggtttctaatagaaggaaagttggtacctggttaaatgagtatatgatttaatgctgagattgtgacttcaagtagtgggtgtctcacctttccaaaacctagttcatagttctcaaataacagtttttcctttttaattttttttcccatctgtcatggtgagtcttactttgttagccaaatacaagtttagttcttaagtggaataactttttttaatacaatcctccctcctccagccctcccatcctgtgccgtggagggtttgtcacgcttatacctacattagatctctatttatgctaatttggaacataatcagcctcttccaggaagggtacatattaatgcactttagagcagtttgtgattgcctctggctatttgtatacggacttgccagcatctgaaaactataaataggaagatttaggaggaaacagactttataactaatggaatacattgtttcagttgaattttttttttttttttttgatggagtcttgctctgtcgccaggctggagtgtagtggcacaatcttggcccgctgcagcctcccctcccagattcaagcaattctcctgcctcagtctcctgagtagctgggactacaggcgcgcacagccacgtcctactaatttttttgttatttttagtagagacagggtttcaccatgttggccacgatggtcttgatctcctgacctcgtgatctgcctgccttggcctcccaaagagctaggattacaggtgtgagccaccgtgcccagcctcagttgaattttttttaaagagcaaaatggaagaatggctaattgaatgttaaaaagtaagaccatttcctgttttctggtaaggatggttgatcgatgtgtgtttgcatgtgtgtgtgagtatatatttataaatgagcagtttttgaataaagacatatcaatactggataaataattccagtcctgcctgtggtccttgacatggagtgtattcagggttccctggtgattttgtttaagccactttgttaccaaaactttcctatggatagcatagaaacacaagctaattaaatttctataaattttatatttttgggatgaagtgttattttggaagtatttttttaagcatgattaccagccaacctgtgaaatgaatgaaatctgaagtgcagagttcatggaaccttatatccacctaagatagttgagtttcaagaaggtatttttaacggcagaagatgaaatcttgacatctatcaagtttttatagtaataaagtaagcatgactaagtttattaatattcatatttgtaaggtaagtctaagcatgtgtacagtgcattttaagtcaaaatttggggtgttattggctagacacagtcatttctttgccagagatactaggctgtgtgaaggctaaccatctgtcaagtgatagagacaaagaaaggttttaatatactagtctaaaatttccacaaacttgttttgaatggtattgtcattttcttttggccttcatactctgtgttgaatatgcactgggtcagtcaccctactttgttttatgaacaaactattcaaggtccagatgaggttattgtcacagctgatgtgatctagaggcaagataaaatatgttttgattttgctttcatataatcaaaaactcacagtgggccacccactagtagttacacaaatggtttcaagtgtacttgttttcacccacccattctgaattttgggtgtcttaattattttgctttatgtattcaagccttgtatttcaaacccattcctgagctgtttgggggaagaaaaagtagcaacaggaatccagattgcctgttttaggtacaatatggtgtgatgtgaaattgaaacagcagattggtgagaaactttagtttcaaacaaatataaactagtttgtttagtgaagtcatacacaaaacagtagtctctattgacagggcaatgtttttttcagtgattcccatatcatgaggtcacttttgttctttgggccaacagtctgttttcaaggtgtcatataagaaaagcactaaatactgctgattgtaatgatatacttacatatggcagcacaagaaattatttatagcagtgctaattatatcaataaaaatagcaatattaatactgtgtcaaaatccattcttgacagtatgaggtaaacagaactatagtcaaacaaagcagccagcctgtctttactgtcagctcacagatatgcactttaagaaaaatatacacacagtttagagagttgagtgtaccaatttaatctcttttcaattacttttggcttttaaaaagatgttctaattcaacataatattaaaaagattttgatttttaattttgaaactcttggtacccattttcttactgtcattagtaagtttctagaaatgtatttgtatttcactgctttataaattatcagaaattcattttagtgtgccctcattttggagcacagattaccattacaaaaggaaactattaatagaacaatctctaacaatttacaaaacaaaacaaaacaaagacccctaccaccaccacacacacatacacactctctcgcactcacacacattttcagtaaatctcaggcttcctttagacaaaagaaaatggccttttccatggttttgatttaagataaagcataaattttgtttgtagttttcattacttctaacgagtttttacagttttatgctattttaaatgtgtcgtcttaggaatataaaattaagtaagtagaagtaattacatccaaagatttttaacttggggacaatatctaccttttcaatctctcatatattaaattcaactctttgttatacattgtcaaaaatctcagatgtgaagttagtagaggttgttctagttctactgcggccattaattagttacatgatctatggcatgttgcataatctatgcggatctccaccttagcaccttagatttttcatttttagggtcattttcagttctaatcatctgagtttgtttccttcaacaattgaattgttattttagcttctggtagtgttactgaaactgatgcttaggacacctagaaacagtatatgtaaaatacttgactttgctttccacttttagtcttttataaaagtttaattttaatgatacatgctttctaacatagcacactagtaaagtatagatatatgatattaagtacttataatctttcatagtgggtaagtataataaatctattagtttacataaatactttgccaactcatcttaactcaggaaggtgtattgctaatagaatttgtaaacttgactctgcatttcatgcagcataaagttgttaaaattgaggatgcaggtaacaacagaatgaatcaactcacatttttctatttctataaaatctatagatagatacatttattcaaagataaaagataaatttggttttgtgattctcttctctaagcaaaacataggtatacattgagtaatcaggaaccacctccatgcagatcttataaaattggtaatttttaactactgcatttagtttttgatcttatattatatccatgcacagatagatttacataggaaggaagataaggtaggcaaagaaatctgactaggaaagaatctgttagaaaagactttgcaaatattgtcctgttatatattgaaagaaacaactatatacaatttctatatacctacttgatatatctttaatgataacctcaaagttctaatttaaaattttactctcagtttctgtttaattgactcatcctttttgctagtatgaatggtagtgaaaggcttaaagctatctaacattaccttagatggaaacagcaatctgcaggaagctatactatcctgaatcctctcatttcctcacatccacccacagctccagatgttcctggtactgatcatataatattttataaatcacctcgtagccaaaatatactgtctgttagatgatggtaagctattttagcttaccaaacatctagctaatcaggagaaattgtaagaataattttagatcaattgttggacccaaaaggtggtatgaatgcttcaatgcatgcaaataatggaaaagatattctaaatgtgcttaagggaagctggttttagtgttaactgaaacccagtatacatattgaagaatcactgtaactcttctaaagccatgagtaccaaaaagactagcaaaattattagtgggaagcacagtgaaaagtaaatgcattctatccttgtattaaacaggaatactaatcacaccaccaacaccaatagtagccaacatttactgagatcttactttgttgcagtcattggttatatctgcattttttcagttaattccacaatcccgtgagacaggtacctttattatcccaattttaaagatatgcgaaggctcagaaagggtaagtatcttgttcaaagtcacacagctaagtataaaacacatgggaaattaaactcaagtacagctctggagaacctaagctcttaatcaccaccccatcagaccactattctgggacgattttaactcagtgcttgcccagattaataatggcaattttatttcagaaaggcatagatttggagaaggttctagagaagggtacaaggtgaaagagttgtaagtaggaacaatggttgctgtgatagaatctttttaaaatataactcttcagtctagaattaaaaatgatgatagagaatttgtctaaaggttgtacaatgaatagactctaactgctgcctgatttagttctatttgcaacagtggagctgggtaccatgttaaagcaggccttggaaatcatgggtaggagcaggacaaaggaagtattactgaaagttctgggaaggtagaggtcaaaaaggaaaactaaatcaaacccgactgaataaccaagaaccaggtatcatgcagaaataggggtgagggagactagaaacagtatattcaaagggtagcaaatcctatgactttggaaggcttttgtgtttgtttgttctttgtgcccttaacatttgtttcagaaaccaatagctggcttaaatatgggtcactgagagtttcgaaaacaaagactgctatgcttttggcacaaaaacatgatcatcagtcctaacctagagttaggcagtaagtttaagtgcatgacaaagatatgcaatgtagcacaatctgtgtggtaagccatttattgaatgcctactgtgtgccacccaatttggaaatcactgttctaggaacatttataatctacattgttgtttgctgtccaattttcaaaaacaggaaaacatctgttaactttcttgaggatgtgatggatatgaggggtaaaatattatataccttaattttgttttatttattatggaatttagcttttgtctcctccttcccatattcatggaattttaaaacagcctctactatgctttgagtggaatacagtctagacttttattatgtactttaacttttccttgatttgtcactatactgaaagaaagatttaattttatctgatagtgtaaatgcatttctatcagagtagtagtctcaaatcagttcaggtaaagtcagtgtacatgactttggattatatttagtatagtcagcatgcatgaattaaaaggaattatagtaacctttaaagtgaatttttattgcagataatttaaatgacctccaaccaagtacttctgtcatgtatacatacatactcatataccctttgtatacaaggtactaaaaacttaaaaagttttcaaaagataatgtttactgttaagctatattacaaatataagctgtatcatctgaatgcagtcaaagaataatgaaattgctataccatcccttatgtgtctttactgttccttatgagaatatctgatattttctttattctcttatttttaatgcattaagaagtatagtataataatcattttatataattcaaatggatacatcactgaaaaatgtattttaaagttagaaaaattatcaacattcagttagtgcatggcacctttctcctcaagttcatcatcggtggtactctgttgttcttgtaattttgatagcctgtgggacctagtgttcttaacagctatgttgtttgtatctcactgtcctttatacatctgaccctcagagaaatacctttgaacactcatgtttttaataatctttcttgttttagaaagggattgagagcaaggcaatactgtgttaaaggggtcatttgagctgaaaagcagtatgggaaaaatgaacaaaattctaggttcttctgattcaaatattctacattacagtctcaacatttgttgttaagcgaattaccaaagtgtataagagccaaaaataaatggttgtttctgtcatttggggtatgcattactctgtttctgtcttatatgtgtaatgatgagttttataatgcacaaatgggtgcatctggtgtaaagtgagtttgattcagtgtgatgttttatatgcagtttaacttataacttaaattctttgacattcatcacttaggaaaggtaacatttagaattatagtacacttaactgcagttccttaacaacaggtaccatgctttatttatctttatagctttagtccttagcctaatatctggcacacaggaggaattcaatgttgatcaggcttttttgtacttatcctgggaaaattatttttccttactaggctatccgtttacttattggagttcaaatttagcattgttaaaattattacctattatagactttccctgtacttttccaagacccaacgtgtttgtacatgctcacagttttctatccttttaggtacttaatgaaattctatcatggcaaaaattccaataaaattacatttaccatgattcagaaaagaaatgtgtcaggtatctcccatcagtggtaaagcaaatctactacaatcaattcaggatattgtgttgaatagagtacacagaattatattatctgctgatttaaggatgaaacccatatttcatatcctatatgattcctatctggatagagggacaaacaaagcacactatgctttgtaattcatagattgcaattgagattttgaactttttatatgagctttctaattcttaaggaatgttcataaaatttcacacaattaaaaaataggtttaattattttacctaattatctgagtttttagaagtcttatccagttaaacactgtaatattagtgataatataatataattacttagctcttctagaaagcaaaaaaggtagttgggttgtgaacaatatagagggtaacatcgtgtaaaccacatgtgggacacatgtaattcctatataaatagctgacatactttttcatatttataaaacttgttagacattggcagacttgattggctaaagtcataatttgtctttctaactgaaactacagcaaattgatttgaagttgttttcaaaacaaaagataattaagtcctggaataattaaaactgggattgcattaaagcttacttaaagtgattaatagctggagtgtatttcacgatttcaatctaaagagcatgcagaagaacatattgtcattttatatattcaggaatatgctttctgaggaaactattgattcttaggaataagtataatgaagtccagacatacctcacacccacataccccactccaccccaggcttttttaaaattaaagactttgaaaacaaagtagctatatatggttatcttcttcacttccaattccaagctgcctggctttctgaagcaaatggctgctgtgacctataaacaactgtcatgacaccttgggcagagaaacactgctttgaaacttctgccttctgttgggcaagcaactggagaatggtgctggagtccatgggtaaatatgagaaagcaatagacattgggacgaagagcttgggctttagaggtttgtgaactcctgtaggaggagatcaatatttatccattttaagtaccgaagtgtcgctagctgctaaaaagctaaagtagctgaatgtcctggtggagtcctctctgtctttggaggctaaaaagaaatagagataggacaacagagctctttgtccatgtgcctttgcagggaactgacaggctgtttacctttgcttttcaccacctgtgatatttctgccatttaggataatctggcaaccagacctgagctccagtgagttagcgaaaaatagcaattcatttaaggagacccatagcaagtgagagaggaaaatcagagtacacactccaggtaactaggactactggcgaaaacatgaaaactgaatttgaaaacaaaaattgggagcacttaaggaaattcaaagaacagaaaataatttcagatattaaatatatctcatttgaacaactcaggatttgtgggagagcatagtcactgtcgaaatatgaattagtgaatgaaaagaccaaatgcaagaaatgtatccaagcatataaaaaaacccatgatgaaatattgaaaaaaaaaagatgagatttggaggatagatctagaaatcaaaacgtgaataataggaattacagtgggacattctttaaatatttttgagcatctctgcacttggctgctaagaaaactgagttttagagagcagagattttgcaggcactttctctgactgtaagctaacatatatcaaattttaacagtttttctaaaaggttaaaaaaatctacatagaaattaaaacattcccagatatcttttggatgaagaggaaatcacctagaaagcaatgaaaaggaaatattttttgtaaaagccaatgaaaattagctaaaatagttgtcagaggaaaattgatggccttaaaggcctttgttattaaggaagagggaagataaagataacctaatgttaagaagttagtataaagaataatacaagatagaagatgaggagattgttagaaagatgaaagtaatgaaatagaaaaaccatatagtaaaacccgaaataaatctaaaggctggttctttggaaagatcaatgtgatacataaactccttgtgaagatgataaagcaaaaaagaaaatgagcctgtcaattccactctgaggtatatactcaagagaagtgatagcatatgttcacataaaatttatactcaaatattcatggcagcattattcatagtagccaaaaagtggaagcaactcatatccatcaactgctgaatgaaggaataaaaattattcatctatgatatatctatacaatataatagccataaaaaataatgaagtactgatacatactataacatggatgaaccttgaaaacatactcagtgaaagaggccacactcaaaaggctacatactgtgtgatttcatttatatgaagtgtccagagtaggcatataggtggaaacagaaaggagattagtggttgccaggggctgggagaaggaaaaatggggagtgactgcttaatgggtatagggtttccttttggagtgatgagaatgttctggaggtagttggtgatatttatacaaccttgcgaatgtcactgaattatatactttaatacagttaaaatggtgagtttatgttatatgaattttaattcactaataaagctttaggaaaaagaatgacaaaagtacacaattagaaatgaaaaagaagaaaaaactggaagatgaaaagaatgttaaataagaatgtagctgtgtgacaaatttaaaacccttgagaaataaaaggacttttagtcaaatacaaatgataaaaattgacctaagaagaagtagaaagcagatgctacttagcatagaaaagattagaaatttgaccagatgttgtcacttaaacgtaaggaatacataattttgatgtaatttaaatcattctaggccatggaaaaatatcaaaatattccataatttaatatctaattctgttaaagattatatagtaaaaaatgtataatttcacttacgaagtatattaaaaaattctaaggaaaatgttagaaaatattaacagtgaatcaaaataataactcactagtagctattttaaaatatatttttaagtgggaatgtaagcatgattcaataataggaaatataccaatttaatttattacatcatcaaattaaaggagaaaaatcatgtttatctcaataaatggcaaaaggtattctaaattttgggggtttttttttgtcttttattttgagacaggatctcactttgtcacccaggctggagtgcagtggcatgatcagggatcactgcagcctcaacctcctgggttcaagtgatcctgccacctcagcctccacccaaagtgctgggattacaggcgtgagccactgcacatggcctaaattgttaaatcctaaaaacattttaattaacaacagaaactaaacaaggaaccatcacaattatttaacattattttagaggctttatcatatacagttggtaaatgatataacattaacatttgtagagaagaatgtcaggtgtctcttgctgatgatatatggtctaaaaattatagaaacttgaattttaaaatctagaaaaatgagtaagaaaaattgataaggtagttggataaaagataagatgaaaacaactctgctctggaggaatttgggcatctatgagactttttttcccaatgggaaaatattattccattttccatagaaacacaaattacaaaatgcctattaataagtttttcaagaaaggtacaggaactatatgaaaacaaagatattaaaatgcataaaacaggatctgattaagagaaggacaaactggtttaggatgggaaaacaataaaaatattatttcaaagttaataaattatataatgcaattccaattagaatcttgggagatttttttttcttttttgaagtcaacagtgttattttaaaactacttggaagattaaatggtaacgaaaggcaagcaaatatgaaaaagcaatgaggagggacttgtattacacataccagaacatattacaaagtcagctcatctaaacaacatggtcatggcctaggcatacataatagatcagtggaaatgattggcaaattctgaaaaagatgacaacttagttggaaaatgatggattttttaaattaatgggactggcataactgatgatctccatgtaaaaaaatgaaagtatattcccattttgcaccttaacagtatttgttactggtggaaatgtgatatattctacctgttataaaatgcagtcttgtaagactaccaaaaacctattaaaattataatttgcatatgatttgcaaatactttaacctggcagtctcatttttgggaatatattccatagaaatataggtagcaatatttaagaacatgtgtattttttggtttccaggttgttgtaactttattgtagtggtaaaactgcagaaaatagtaatcccattaacaaggtaatgctagtaaataatggaaactcaaccatgggctattatgctgtcattaaatgatgtgaaataaagctatctcagatcttctgaaagaatttccaggagtttcttatgagtgagaagagcaaggtatagaaaagtgtgtataatattcagcctttaaaaaataattacaaagatccttgaatatgtatatttataagtaatatctgcatatgtatatatctaccttatagtagggttatttttaaaggaagaagaatgtagcaggatgcatactaagttataaaaatggataactatttatgagaggaaatatgaaaggagaggagcagatacccaagaaataaaggaaaagaaaagttgtgctaaaaacatgttcaaaaccccacttatgtattttattaaaattaggtatatttgaatataaatgcataaataaaaataattggccgggcacggtgtctcactcctgtaatcccagaactttgggaggccgaggcagctggatcacctgaggtcgggagttcaagaccagcctgagcaacatggagaaaccctgtctctactaaaaattcaaaattatctgggcatggtggtgcatgcctgtaatcccagctacttgggaggctgaggcagtagaatcacttgaacctgggaggtgcaggttgtggtgagccgagatggtgccattgcactccagcctgggcaacaagagcgaaactccatctcaaaaaacaaacaaaaaaagaaattaaaataatttaaaatattatggctagttttggtagtaatgagttcatatttctgaatcttggcacccaagcagattgtttttttcctttatatttgcattttctttaagttaattttggaccacgtgctaccagaattttctacatgttctcttaaatcttcagatgttcttctagcatttcaggccaaataaacatctacaaatgatttgtagtttgtgattaaatcagactctattggtcatgcccacatcagagctgacatgcagttgatatcccttgataaaacttagagcgtatgtttcactttgttcagtgttcagtttctttagttggtaccttttgtgtcagttgttaaataattttaatattatccctgttgatgtcacaaataagttaattatgccaattacacattaattgagtccttgcacatagaagttgattgataaatatttgctgatttgacctaatagattacaggtacaataatgatttcaacaaagtaacagaatgcagaaatgaaagaatttaaagatattagatgaaaaaaaccctagaagtcagcatagaatatgattataggcaaatcacttgacttttgtatctcaggatctttatctttaaaatagagatattttcctcagttacacaatctttgtgagagtcaagtaaaataatgttgaagtgcttgaaaaagcatgatgtggatacagtgatgataatgaaaatctgaaggcattttttacacttaatggacatttatatatatatttgaagctgtgtgtgtgatattaagccttttgatatgtcagcaatagaacatattactgatgaagctatataaacctccaacagatagaagagtggaatgcatggaaggtgtgagtacatttaatcgctgaaagtctaagataggtctctaaaatttcttcgtttatttttctggtcattgaggggagattttattcaggtacttctgatgatgtcttattctagtatagagacaggaatattttgtgggaagtctgggcctttgtcacatcttgacgtaatgataatgctgcattatgttttgacttattaaatggccacagacagctaaatacagctttgtaatctgttttatatttcattggaaattatctccttgtaatttatagctgtacttaaaagtgactctagcataaatgctttgaaatagtaaaatctttatgatctttcagttaccagacacctaatttgccattggccatttttttggttgtgagagtattaggaaatacctacattagttggttgataacaccactataaaagtctaaaaacttagacgttcttttataataagaaacgtaagtatcatcttaatacactatagtctgtaccgtatggtactattaaagatacctagattctggtttggagaaaattgaatggatgaatgtgtctaagtctaaatatattataccggactctttttccaaagtatgtctccattttaaaattttctttccctaatcatttgacttttacttttttcataaatattcttaaaaaatatgtttaactagtttaatcttcttcagattctctattcttccagtagtagacatgatgttataagaaagctgaaaagagagatctttttttttttgagacggagtctcgctttgtcgcccaggctggagtgcagtggtgcaatctcggctcactgcaagctctgcctcccgggttcacgccattctcctgcctcagcctcccaaatagctgggactacaggcgcccgacaccacgccagactaattttttgtatttttagtagagacggggtttcactgtgttagccaggatggtctcgatctcctgacctcgtgatctgcctgcctgggcttcccaaagtgctgggattacaggcgtgagccaccgtgccctgccaaaggtagatcttaaaaggaacaacagtctttgctctttctcccttcccatcccttccctcccctcccctccccttccctcccctccactgccctcccctcccctccactgccctccccttcccttcccttttcttttcttttcttttttttttgagtcagaatcttgcactgttgcccaggatggagtgcagtggcgtcatcttggttcactgcaacctccgcctcctgggttcaagcgattctcatgcttcagcctcccgagtagctaggattacaggcatgtgccgccacacccagctaatttttgtgtttttagtagagacgagctttcaccatgttggccaggctgatcttgaactcctgacctcagaagatccacctgcttcagcctcccaaagtgttgggattacaggtgtgagtcactacatgcaggcaatctttgcttttcatttctgtaaatggactttaggcaaggctagtagaaacaactacctcaactgattctctttgatattatatctttcacgtaatgaatccattgtaataaatcaaacccgttttcaccttctacttgtgtattgattatctttattaaatgtgaaattaatagcaattgagatagacatatttttaaatatatttcttcactgtttctcaataatactaatgttactcgagtagtaggacctattaatatatgttgcgtgcattcttggatgcatatgtcattgccagtcatctcttaattttgtttttttctttctctattcaagaaaatttctaaccaccagtgatcactgtcccaattgctagttgcagttttgtagagaacaccaaggaaatgggaaattaaagcgatctgtttattttaatcctcaagaaaccaaagcgatcttctcttaattcttattatttcagtttcttataatttaggaaagaagtgtctttcatttcaacataaactctgaattctggtgtcttctatcaagacctgcttctctttggaatagacagaaatcaaataattatttcttagcattgtaataaacattccaaaatatgacacctgttatcttattcagcggtcagttgagtttatttgatttctccttcaagtctctgaatttcttgaatcactgatgctcagtcttaaaacaatggaggtggttttgcttttttcttttcctttttaaaatttatttatttttattttcttattttttgagacagagttttgatttattgcccaggctggagtgcatggcatgatctcagcttactgcaatccccaccttccaggttcaagtgatttttgtgcctcagcctccccagtagctgggatggattataggtgtatgccatcgtgcctggctaatttgtgtatttttagtacagacatggtttcgtcatgttggtcaggatgttcttgaactcttaacctcaagtgatctgcctgccttagcctcccaaagtgctgggattacaaatgtgagctaccacacctgaactgttcctttttttaaagactaagatttaagttgtctgaataaaaatgcttacttgtttaaacttttgcattaacaaggcttgacgtttattgttgccttgaatagtctcaatcaatctttttagcttccccagcacctcatatttggaaatgactagatagataacatagatttttttggactggcagcattcataccacctacaagcttaaaatgcagaatctcaaactccacttcagacctaaagaataattatattcattttaacaagactccaagtcattcatatgtacagaaagtgtgagaagtactactaaatcatttgtcatttaaaagaattggactttaagcacacagaattggtgaatcataacatagttcatagtcatttttccatgtgttctccttttttctttcattcattcattcgtttgttattttaaatcaaaagaaataacctgtgagtccaagacctaaccaaagtattagaacatcaaaactcacatttccttacacctatattcccttaaccagaagtaaccactatcttaaactttgtgcttattgttccattttttcataaataatacagctttaccacttataaacttttaatattactcctgcagatggtcacaaataataccaattattaacttattagctgtagctcaataactcattaatagcctgctgtatttatctgctagaatttgcttttttttcaacattaagatattaagattcacccatgttgtgtgtaattgtaacttacaggttccttttcacttctatataatatttgtgactataccacagtataatctatcctttcttctaccaatggacatttgagttgtttcccttttattgtggctgtgaatggtgctagaataaacattcttgcacatgtttcttggtgacatttggaggacattcttttaggtatattctgagattggaatcgctgtgtcataagatgtataaatggtctactttgcaggagattgtcaaattgttttcctaaaatgatattagccatttacactcccaccagcattgtataaaatatccctgttgacccatattctctttaacatatggtattgtcagacttcttaatttttgccacctgagtaaataaaaaataccttacagtagtcttgatgtgaactttcttgcttctcaagaaacaaggctgtgaacatgtatatgtgtgttttcctacatgtgtcttttccttctgtgaaatggtggttcttatacctatttttcttctttttaaaaatttgtatgattctttttctattgtttgcatgagttctttatattatagatactaattctatctcttctcccttgtagcttgtcttttcacttcttttagggcattctttttgtatgtatgtgtgtattattttaaaaaatgattattagctttattttctacatgtaaaaatttaacttatttttaattgacaacaattatgtgcattaatgtacaacattattttagaatacatttacattatgaaatggctaaatcaagtttattaacatgcaattaccttacatttttgtgatgaaaacacttaaaatctattctcttagcaattttcaagcaaacaatacattgttattaactatagtcaccatactgtacatctcttgaacttattcattctgtataactgaaattttatatccttaaaccaacatctctcccatctccccacccaccatctcctggtagtcaccattctctctgcttctatgagtttcattgttttagctcccacatgagtgagaacatgctgtatttgtctttccgtgcctggattatttcacttggtatagtgtctttcaggttcattgatgtcacaatgacagaattttcttctttttaatgcagaatagtattccattgtgtatgtatgtcacattttcttttttttttttttatttgaggcagggtcttgctctgttgcccaggctgcagtgcagtgacacaatcatggttcactcctgtcttgacctcctgggctcaggggatcatcctgtctcaacctcctgcgtagctgggactacaggcgcatgccaccatgctcagttaattttttaatttttttggagaggtggggtcttactgtgttgcccacgctggtctcagactcttacctcaagcagtccttctgccttggttttccaaagtgctgggattagaggcataagccagcatgcctggcctgtatatcacattttccttttttttttaaaaaaaactttaagttcaggggtacatgtgcaggtttgtttataggtaaactcgtgtcacagggtttgtttataggtaaactcgtgtttacctatgtttattagggtattctaataaacataaaaatcttaatttttatgttctcatacagattttctttaatggttcatgctttttaattttcttaaatcattcacttgagttgatttttgtatattatttagacataaaagtttaaattattttctatagagaaacatgttttccagttatgtttactgtatgttcttgtgtttcctcagtgatttgccgtgccagctcttgtctgtcaggggtctgtatctgcaagggcctgtttataggctctgttttctgtttcttggttgattggactatctctataccagtaacacattttactaattagtacagctttacagtaagtccttatatgtggttgggcaagtatcctacaatttgtttcttgagttttatctttttcttaaaggtcggacactcctccccaagctaaattttaatttagaaagaacatgcttcattttttatatatacaacctagttatcaatgcatatgtattttttaaaatgtctttaggtttatttaaagcatttcttacagtaactgctttgtttggcttacatttgttgatgatgtcaacctgtgggataaaaaggaaaaaagccccaacaaaatgtaatggcaaccttataatattcaaactaattcaattggaatactactacaagttcagtatatttaagactctaagttgatatcataatttcttaatttaacaaagcataaaacatatactattcacttacattactttttagcaactttgtataaatctaaattactcaatgaaataacatccattcaggtattattaataccatttttagctctttaatatcgctacatgccagacaacatttaagtgcttaacatattttaactcattggttcttttcaacactatgaggtagttaacattattatcctaattttattgatgaggaaacaaaggccaagagtggtcaggtggcttggtagcttgtttatgtggggtttattcgggtagtgctaaggaatgctgccttgtgaaatctttactgagttatccttaaacagaactaactttttgatagtttagaaaccccagcctctcctcagtcctgtactagtgccacgtatttttattcaggagaatgaagtcaaacattagcatcaaagccagtcttggaataaagaatataaggtacataaccgttgagaaatatgtacaagtgccttagaaatgatggattggatgtgtgtttactggttttgagcagtaagttgattgtgtatgtgacatatgtcaggtcttaggtcatatttagctttggctggaggaacttccctcagtcattgccattttctcttctcaggtgtccagagcttataaagtggtatatttgtcagagaattgacaagcattctgcttagtgtttctagtaaagaaacactttttgacagtttaatctgcctccattcttaattcttttgtgtttctagaatgcttacttcttttgttttctattctctgtgtctattttgatttctaaaataaattatatgatcagataggtaaataattgttttagtaataattcatacattagaacatcttcaactattaatgtgctattctagatattgttaaattatgtgaagggaaaatggtatagggaaagaagtttttctgggatggaatgaaaataggtgcccacaaaaatattaagagataatggcaaagtgctaatgtttaatgagagtcctaatatttctcatctttgctgaccaaatatcttaggggaatgtaaatttgagaaaatagaagaatcttcactgagctcaagtggatgccatagaaagaagtgtattgtagcatggcacacagaactagcctgtgacagatcatttgaaaaaaagagcaataattagacctttatgaaaaatcatgcatgtttttcacagtgattggagtttccaggtaatttactgggttctgaccttttgattaatacgtgtttgcctcaagaatgggtgtttgactctgaaaattagtctgtagacaaggcagaacttggaggagtgagcagtagttggtaaatgatatagctatgtcaatgtaggcttgtggaaaggtgattgccagtaggtgatgaagattggtggacactgaggttcttaaaatgggtaatctataatgcatagaaatgtattaatcaggatgtgtagccattttaggaatgtatggtcagaaagatgaagaataggattaatatatagaaagtcttcatagacaaatgttcaatgggaaggcagagcttagattttatggagaggcaggacaaataaaggcactgagggactgtgacacattttgactgaattaaaatccatggagaaccaaggatctcctcagagatataggattgtatggagacataatttgacttgatttatatgaaatgtaggaagtaattttttggttgaggaacttttttacatttaagggagaatgggaagcaagagacagctatatgctaacattttgctaaggaagataagagaagagaattagacggtcgctgtccattggtcttgcaatcaaaagtcaatagggaggaaccaaatatgaaaaaaaaatcttggtatttagattcatgctttaaaaccttagttgggcctcactagttatttcagttttaactcctcttcccccattagaaattcatctctcatctttacttgccaagttttcccctttgtttcatgacagaaattaagacggttcagcataacattatccacattttcttttcgatcaagataatttcgatatgcttgtatttgcctcattgcctgcttctcatagtctctggctaaagtgtttagtctggaaactgcagtatgattctaaatgctcagaagaatccttcgaggtccagaaatatgtaattttattaatattacttaaaaaagaccactgaacttgaccaaagtcactttaaattctaatttaaaatttccaaatttaaaaatgaggagatctttctcaagtacagaaaaacacagacttcaagggaaataaaaatgaactttgagctttaagaataaactaagacttggttatattgaaattttatgaatagtgcaaacttttcttcctataggtgcttactggaatatggtaagttagcgattatatgaatttaaacatgatgtgattaatcattatgttccttgaagataagcccatctctataaactataatatcaataaagctttacaacattctctgccatttttctttggtcaaacttaaattattggaaaatagtttgttaaaatctcctcccccatagacaatagttccatttattttgaagtaatgcatctagaccatctcactagtagacttcaacttcattattcttgacttcttgactcttgtcttttttttctttttgcctcataatctggaatctttttggctagagtatcaatgaataacagattgaaaatattcctttcatcctttatttttcctccttcatcttaaatcagttcagctactccagaaaaaaaaaggatgttagtggcaataggtaaaatttgaaaggcaaaatgtgacttattgaaattgaatgatgggtacaagggaatcatttattatgtactctttttgtatgtttgaaagtttccacaataaaaaagattttaaatgcacccagaaaataaagtaaatcagcccaatgaacagatgaatttattgcccatttataatcagatttgaactcaggaaattttaggcacagtttataaaactgaccgtagctcaacgggttataattttgttatttagtgtggtcagtccaggcattaaagcactttgaattattaccttaatgacaaaagttcaggcctgaaactaccaaatagggaaggctgtcatcacttcctgttgattcttgaaatttaattccttttcaaatctcatctctttctttttttcctggttaaagtcacttagaaattgtggctattttttgccatagcagctgtaatacttgggtctgaatcaaagactttacattttatcacttttttcttatctttttcttcagtgtacttaatttactgccttgagtcaaacatgttctatggtgccaatctgttacagtggaaagaacactggattgagaggcatgagtttctagttccagctttctcgtgaactagtttggtgactttggacaattatttcactttttacaaccttctaacctgaaattctcttcaattcctcatttagtgatttttaaccatttggtatcatttttagaaatttacctttcctaggttaaggcaattgacattctgcaatttgcccccgtctggcttacattcatcctgatggtttcaatcccctcaagtctttactttgtgttttgttcccaaaataactcctattgactcaaaaaatttttttctgttaattttttacttaagttgcttgtgcttagagagtttgtatgatgttaattctttgatatttgttgagactttatacaagatctactacatgataaattttttaatagacttgatttttttttagagcaattgtaggttcacagcaaatttgagcataagatacggagattttctaaacacatcttaccgccacatacatagcctccaccattagtaacgttttccagcatagcggtacatttgttacaattgatgaactacgtttctacatctttgtcacccagagtcatagtttatgttaggattcacttttggcgttatacattttatgggtttgaataaatgcataatattatgtacccaccattataagactcatacagagtaatttctctgccttaaaaattatctgtccaccacctattcatccctctctcccccagcccctggcaaccactgattttttttttaagctgtctccatagttttgccttttccagaatatcatattgttgtaatcatacagtatgtagccttttagattggcttctttcatttagtaatatgcattaaagactcctccatctattgacttttattagctaagtgtcatataagtaattcacagtattacactcttgcttgtgtgctttctctctctctgttttagaacagtggggttggatacggtaaaagcaaggaatcggaatcgtgaaattgaatatttgagaactactttattcaatttagaactttcaaataaattggtatttagataaaatagaaataaacacaagctaaaatttattgaatgctttctatgtgccaggcattgagcttcccatgtacctagcactaagtgtttgtactgtaggattagtgtgctttaatcatggttctggtgtatgagttgtggcaccttggatctcacatttctcatctataagatatattatacagggttttgtgaatattagatgagataatatgtataaaatatttagcacagtgtctgaatatggtaaaatgcctgataaattttagcaacttttattaccagtacttgaattatcttatttaatcatcagaaaaactctataatataggtccttttatttccctcattttagtgatgagtacaaaagggttaataatgttaaggaattcatttaaaagtaaagccaagatttgaacttaagcaatctgaatcagaacccacatacctttaacttttatactctgtttctttctaattagtaagaaacatattcaagagaaggtaaaggatcaataaatgatttttaaattgtggtcttgagaggtggccctaggataatctaagtgattaaccaactattctctcagagttggttaggttaagtggggatcttgttttgatggaccacccagtattttagacattatctattttttcaatatcgttttcaaagaaataaattatactgaggaaatttaatgtgttactaaagaatagaaaatatactaaattttatttgagggtcattctctttctaaaataatcataatagctattaaaagttttcatgtgagcatattttctttaatttgtttcataagctgttttgtaggaaagtgttacaaaaacatttgtacttggcgtgagcccgggaggcggagcttgcagtgagtggagatcgcgccactgcactccatccagcctgggcgacagagcgagactccgtctcaaaaaaaaaaaaaaaaaaaaaaaaaaaaaaatttgtaccaggtaaagttttaggtcctagaaccactagtgatatttatgtgaatatgctcttatttagacctagccaaatagtttaataatatttattatcattagatgtcactttcttagtgtaaaacggttagttctggtgaggactttttttttaaaataggggagcaggcttgatggaatgttaagtgcgctggttgacctaggttaaagtatgattacagagtgacagtgaggatttaattcaacagtttatgtgaagaaattttataacttatgtgatagagaagtatcaattattgatgtgaatcattagtagttagaagagatctataatacaaaccaggaacagtagcacacacatgtagttccagccactctgcagaggctgaggtgggaggattgcttgagcacaggagtttgagtctgcagttaagttattaccacacaactgcactctagcctgggcaacagagtgagactccatctctaaaaaataaaaattaaaaaagagatctacaatacaacaaaatttgagaatttctggtttgggaagaaaggtagaaattggattactatgtaatgaatatttcctaagggttaaacactttatatatgttctcatttaatacttttgccttctctttgctatgaggaaactgaaattctggaaaaatagtaacttgtttaaggtcacaggtagtgaatgtggaagcttctttcaaatccaggctttgactttaaaagccacgttctttctaccgaagcactctgcttcccatacacctagagatagagtgtatggcccatgaataattaagagtaagatgaaaagctaatctttcagtttctcattgagacacagtgatgccttgcatttattattcctccttttactatatttaaacatttcacaataatttatttatcttttaaaaaaataagagcactatgaatttgacaggaaaacttgtgagatatcagatggattacataactaaatattgtatatcacaagctagtttttctctacctctggtttcttaactgaaaaaaaaaagagttgtggagaacgttaatggattgtaatacacaaaggaataaaataatttattaaaaataaaaattcctaattttgaagcagatgacatattttatatttctgttgattgttttttaataatacctaggcaaacttgatttcagatttattgatgagaattccctgctttatacagaaaatattcctgtagaaaccaacatttagataatctgataaggtctgggaaaaggtgagttctatgtagctggagtaatcaaagtggtataggttacacagaagtgttaaggaaaaagataagagaaactaatttgtgttaaaattaaacttttttctaagtcagcttttcatactctagttttgttgttcaaagtacattcattcttatagaatattaggtatgccaatgcttagatataaatataaaaacacatttcaaaatccaaacaaattatttttggattatccataccttatgtcccatctgttagtataaataatcaaagagtactgtattttcaaaagctctggagagtgttaccctttctgcactttctgcaacagtataatagaatttggcaaaaacaatagcatgttttgcaatggttgtgcagttaattgaacatcctgtcaatgctggatttgctgtaatttttacagataataaacagcaagctatggtgtcaccctatgtatattcacttaacaatatttatttaattgttgagcacataacatattcagatctttgtactttgaatacagatacatgatgactacagcatgattaggagccttgagtttttgtggaagagataggcatgtaaacaaccaactttatttgccctaataaatattgcttattttgaacagttaatctctttctcttgctctctttttctttctctctgtctctgtctctctctttctttctctttctctctttcctggggaagaaaactaatatttatcaaatgctcattgtgtgtagacgccatactcaagaattaataaattttgtgtgctttgactagagccttgcactttgtatgttcacaaaaatgttatctcttattatcaatctaatgtagttatcaaacagttctgtgatatagttattcttattttatagataagctatatgagactcatggataagtaacctgcttcaatatacatatccaataaatatttttaaaatctgagtccaaagcccatactgtagaatagtggcctcaaaaataaagtccatgcattccaagaaatatgcaagatgatgcgttagggtttgagaggaaataaaaattgttatttgtgttttttatttaaaaaatctaagaagttaaagttaccagcagttaatatgcccagatagagctgggcaatatcagagcattatttacatgcattgctacttaaacagaacatcctgatgggagagagtggagtttgttaaagagttggagctactaaatgttatctgtgccttgttatgtggagtcacagattagtgacagattagtttaactaaaactaactcttacaaaacagacaactgactgaaaaaaagcatagaaaagatgatactaataatccaagcccatttgaaaaagaacatccctgaaacatattatgaacactttgtaaactacattataaagtaagaacaatgatgatttagcaatatttgaacattgatcaaaaataataatcaagaagtctatttgaaatgatttatattcactgtcattgaaaaagaatgtcaccctcagtgtatggtgtgcgatggtggaagaccatttcattggtaaggcattaaaatctaactacctagatcatgaatcaagcagtgtttaatgtcacgtgagactcagtacagactttacaaaatcattaaattaatatttagaagacttttggggatttaaaaaacaatattaaaatacaaacatatttaccattggaaacactgttcttcaagagcaataatggctgaaataatgtgtgaaaaataatatggcaacaaactatcacatttgtcagcaaatactgctagaatatgtatagaaaacattgctgaagatttgcaaaaacaagtattgaacaaattatgcagtgtggaatgtttactatatagttaaatgaaagtaccaatatttctaacatttcatccaatgatatttgctaggctcaattgaaataattcgaagaactatgttgttataaatcaccaaaataatcactggagaagattgtggctaaacagcaaaatactgccctacagtaaaacagtgtgttcttgaaaatctatgttatctatagttacatagttttagaatattggagtggtcgatttgaatggaatagaaaaaagcttgccgaggcaggttacagaactacttctacacatgaaatcccttcagtcttttacagacaagctattttaacaaataaattgaagtcacaagtacacacaagtgctgtaggacatcattgatgtggtcactttgttttcgttttttaagttaaagctttaaaatgtagtcaaaaatatgttaccaaatgtgaaagaatcttaaaattttagtggaatctttatgatactttgtaataagatggagaatgggccatgaatatcatttgcaccacttgaggttcactggttatccagtggtagagtattgagaagtaataagaaatttatggcagttatgcatttttcttttacagaatgacaaggttctaattttactcaccttttctgttatgacaggtgactgtccatactatgcgctctaatgtatatttttgaaaaataacatattcgatctgtctttttaaagtagtagtactaataatgagtgagaaggtaactgctttttgaaggacctgtggttatggagaaaacatttcatattgaatgtttgtaattcttttcattacaatgtgattttcttgccaaaaaccaatgtatttgtaaaactagtttctatatacattgaaaattgtacaaaaatatattggcatattttgtaaaacttggaacataatgttataacttactttaagatctttcaaatgtaatctttaaattgattttaaaatccttttgttaaaaaataaaacgctacacctcttagtttataggaatgacttattcatctgaagatggaaatttactagctaaatttcaacaaagtattttacataattggccattaatattgaaaattgattattttgatgtagtaagcacagccattgatactcttcttccatttgaatttactattttgtgaggctttctccctcaacttaccaccacccctcctctgcacccatgacaaccattatatctaagtaacctgaaaatagtactgtattttcagatgactgttttacaaagtgtaaaaccaagccaagacgtagagaatgacacatatttactcaaatttttgttttaatgtttttcagtaagagcatcaagagcagtttgctcttcagtaagagcaaaatgttttaaaattgttgataaacagagccccaaatttagaatgtttacttcttgtttacctcagtcttttaaaatatctattgctgcatgttctgtaatgtatgtattgtagtaatgtatgtatattataaataattatgcatatattggagtatgggcttatattaatcaatgccaagacaaacagaaatgactcagaaaagaggaacttcaatccagggaattgattacaaaagtgttggaaagtctggttgagcaaatagaaggtggcaatattatttagtaacaaattccttcagaaagcaagggaaagttttgttatccagagcctataagtattatgctgccgctgctgctgctgcttccacattttgctgtggctgttggaatcaccaatctcactgcactgtaggaagccaggtgtccgcactcctatggacacttcaagaatccaggataatatgtaatttcttgaattctgttgtgcttgtaacagctgctggagcttccagtcacttgtggtggctgctgttgttctgcacttgcattgttctgcacttgcataaccagtgttgcaatcagcagtccagagcctagataccaagacttctgtgctgcagaccctgttggagcaccattgctgagattttcagtgccaaaagcaggaggcaggaagaagtctgtctttgcctttgatcttataccaatgcttcatattctggcaaagccatctaagaattgtagtttttaacttctaccatagaaagagtgcctggaagaggaattcacccatcaattatatgcaaactattttagtgaataaatcgaagtcaagagacacataactgctgtaggatgtcattgttactgttttttaaaattaaaccttttaaacacagcagaaaatacttgcaaactattcatctgacaagggactaataaccagaatatataaggaactcaaacaactcaacagtaaaaacaattaattgcattaaaaagtgggcaaaggacatgagtagacatttctcaaaagaagacgtacaaatggccaataggtataggaaaaatgctcaacatcactaatcatcagagaaatgcaaatcaaaacccacaatgagataacatcttacactggtcagaatggctattattaaaaagacagaaaataacagatgctggtaaggatgtagagaaaagggaactcttatacactgttgatgggaatgtatataagtacagcccctatgaaaaacagtatggacatttttcataaaatgaaaaacagatctctctattgcaatctctctattgagtatccccctcaaaaagaaatcagtatatcaaaggaacacccgcactcccatgtttattgcagcactattcatagtagcaaagatatgaaattaaacctaagtgtccatcagtggacaaatggataaaaaaatgtggcatatatacacacaatgaaatactatttggccgtaagacagaaggaatgtcatttgcagcaatgtgaatggagctggaggtcattatgttaagtgaaataagccaagcacagaaatacagatatctcgtgttctcactcatgtgggagctaaaatgttgatctcatggaggcagaaagtagaatgatagataatagaggctgggaggattgagtgggttgggagaggatgaagagaggttggttaatgggtacaaacgtcagacaaaagaagttctaatgttcaatagcagagtagggtgactgtagttaataaaaatattctatattgcaaaatagctagaagagagtactcaaaaaaaaagaaaaccacatagaaattataaatactcagggtgatggataacctaaataccctgactttgtcattacacattttatgcatgtaacaaaatatcacatataccccataaatatgtataaatactttatgtcatttaaaaaataaaaggtaaatctaagcacaaaaatgtaatagaaaatacacacccaaacatggaagagccttaaaattttagtaataatctaaaatttagataggaatggagttgagaactaacagtgatctgtgcaaagttttaaatgtttttactgagggagcatacactttttaataatcggagaatcaatttcttgagagtaggggaaggaactcagtggtaaaactacatattacttcacttttcttgattagctttaagagatggattttgatttgacacctaaagctagggttgatattcagggaatacacactgtatttacagccagcatctgttttgattagtcatggtaacatttcttctgtgcccattccttatgagctataaatattttgactgccactgagcactacctaaaacttctctaatttattatttatttctatacacttattaaggtaacttaaaataatagtaatagtaaaaatgtagtgcctggaaaacttcagaatttaattattgaattattttatgttatcaaatattctataatatctattgttttattgtaaatatgtatttttaaacatctgattaaactgctaaagtgcaaattaattattgagtgggtattaagtgcatttattggtggaaaaatactagggagagaattttaattactttagacaaaagttacatgaattttattaagatattagcttacagtggtttgcagtttatttccgtttgtgaccttcagataaaacatcataagaggtatgtattggagtcccaaaccatttaatttttaaaataaaattcataataatgatttatttctttcataactctttttgtaattaatacagatttcattatgggcagtgttcttttgttgattactaataaaattttctcaactggtgagatactgtttgatattcaaatttcacataggtttaagtgatgttgggagtattatttgtgttatggaagatccagttattacattttcagtggtaaagtgccatcggtttgaaatagagtagtacatcatatttagtgataagtaaattcaatccattcaaatgtgtggacatttaacatgaaggaggatttgttttatttttatttatttatttatttatttatttatttatttatttatttttatttttatttttttgagatggagtctcactctgttgccgaagctggagtgtagtggcgcaagctcggctcactgcagcctctgcctcccaggttcaagtaatttttcctgtctcagcctcttgggtaggtgggattacaggcacatgccacctagcccggataatttttgtatttttagtagagatggcattttaccatgttggccaggctggtctcacactcccaaccttaggtgatccacctgccttggcctcccaaagtgctgggattacaggcgtgagccaccacacctggccggatttgttttatatacaattctcttcattgagatataaactgataaactagtcaaaattaagtaaatgacaattttgaaatacccaatataagtgtaaaataaaatttaatgtaattcatttcaaatttttatttttcaagaatcctaccaaacatatcggacatacattctgaatgtatatactgtaaagtaattttttgtatttaatacaaatgaagaagatagatattttatgtagattatgttataaaaacttttgatctgaccttatacattttttaaaaagttatggctataagcctacagcttattggggctaagtgatttttcttaaaaataaaagataccatttctacctattttgaatcatccctatggcctgttgcctcagagggcttagcaggctgctatcatgctgactccgttattaataactcgcttcaaaattgctggacagattgctattaatatttccaactctttttttttttttttctaagacagagtccctatcgcccaggctggagtgcagtggcgtgatctctgctcactgcaacctccgcctcccgggttcaagtgattctcttgcctcagcctcccgagtagctgggattacaggtatgtgccactatgcccagctaatttttttgtatttttagtagagacggagtttcgccatgttggccaggctggttgcgaactcttgacctcaggtgatctgcccacctcggcctcccaaagtgctgggattacaggcgtgagccacagtgccccgcctaatgtttccaactctttaatcaaactggttcatggtatgtttctttcatcgcttttgaaagctattttttaatatactagtcttttccattatcctttctttaaattttactttgagatacttaatatacttttcctcaaacaaatataaaattttaagttctgaaattatctagggaacatatatcctttcaaatctgttccccatcattagtcttctttttctacctaatatcaccagtctgttattctagataatttttggagtaattttataaagcccctccttctattccttacacattctatttggatagatgttaggcccgacgtttactacttattaggtctgtgtctttgggcctctttttgtttatgtataatctgaaaatgagatttcttttaatgctgttgggggattaaatgagaaagtgtatgttgggctgtttctgacacatgtagtagagataacttttaataaagcattcttattaatagtagcaacttttgtattttggaaagatatgaagactattgagtttttgagtatagccgcaccaggtcaaacagtaaggatctcaccaacctgcttgacaaacatctatggcaattaagatgtaccttttatatcttctctgtgacttttatttttcctatagaatgcactctgtagtttctctttcctttccttttgtattaaatataaactgtacatataagtaaattatgtagatgtggaaacttttaagatagttgctggcattgttgtagattgtttagtagagaggattgaccaggcagcagaagagttcatatagtatatgtgtctaatacgttgttctggagccagggagatattacaaataacatttttatattttgtaatccattgatttagcatttattgattgtgtcacaaaagtaccctcttctaaatttctaaagataatcatatcatttaagatcagcttataggagtagtaacaacagctataatagcataataatcttatcattcagatactaaactccgtgccacttttccccatggtcatatttctcctttacaattgtggaaaatgactcatatatagatatgagtcattctatattaaagatacttttgattttctactctttgctatttactattcactggccactgttcactctaccactggtcactccgaggaactccggtaatattttctgtcttattaggaaactgccgtgattataaaggctacagtatatgggtgaatgtgaggcaataacttcattttttcattatttgattcttcgttctactactatataagactgtagaatatacattatcctttcctgaaagtttggagagaaggagaatatttgcatcacaaaacataaacttcatagaatttattattaggcattactttaaaaaatctggccacgtttacattgggaaattcccactactcctcttcttcctccctctcatctctgtgctcccctaacttcaaattgttactcattttttatgtagtacagtttaaccccacaagaaatattcatgcctcactctctgactccagcagcttatcaagatgttttcctcaaagaggacaattccattcccatgaagtactctgaagccaacttcagccttttacaaacacttatgttatagatttgaaagaaataatagataaatgaaatgtgaaggcaagctgaattttcttttcagaaatgatgtttattgaaattctgatagttgtatgggaatatctttttttttttttaagttccaggatacatgcacagaacctctacatttgttacataggtatacgtgtgccatcatggtttgctgcatctatcaacccgtcatctaggttttaagccccacatgcattagctatttgtcctgatgctctccctcctctcaccccccacccgccgacaggccctggtgtgtgtcgttcctctccctgtgtccatgtgttctcattgttcagctcccacatatgagtgagaacatgcagtgttttctattcctgtgttagtttgctgaggattatgtcttccagattcatctatgtccatgcaaaggacatgatctcattcctttttatggctgcatagtattccatggtgtatatgtacaacattttctttacccagtctattattgatgggcattttggttggttccatgtctgctattgtaaatagtgctacagtaaacatacctgtgcatgtatctttatagtagaatgatttatattcctttgggtatatacccagtaatgggattgtggggtcagatggcatttctggttctagatccttgaggaatcgccacactgtcttccacaatggttgaacattcccaccaatggtgtaaaagcgttcatatttctttgcagcctcgccagcatctgttgtttcttgactttttaataatccccattctgactggtgtgagatatgaatactttttttaacaaacttttttttttttttttgacacagtctcactctgtcacccaggttgcagtgcagtggtgcaaccatagctcactgctgctttgacctcctgggctcaagaaatcctctcacctcagcctcccaagtagctaggactacaggtgcatgccatcatacaaggctgatttttttatagacatgcggtctcagtatattgtccaggctggtctctaactcctagattcaagtgaccctcctaccttggcctcccaaagtgctgagattacaggcatgagccactgcatgcagccttatccaactttttattgtgaaattctttcaaacatacagcaaagttgaagattactttttctatttttgtttgtcacaagatcttaagataaggatgtgtttaatatgtgacaatacattttttgaaatgctatttacttgtttatatcatccttatatctcaaatttatttaagtttttaattaaccaaggtttataaaccctatgtactgttgtttgtttagtcattcattctttcaggaaaacttttttgagcttcagatatattacaggtgtactgccagatgctagaccaacaaagcttaataagtagggtctctgctctggggggcagaggggaagaaggtggcgatggtggggagggagtctcttagtcttgtagggagagaggcatataaaatcctctggccataataaatgtacttccaatgacttagtttacatgtaatactttattttagttttaaatttaaacatttgttgattagaatttaaattagatgtgcaactcttcccatttaaggatggtactcctggcctactattgtccttgggcccgatgggatacaattttaaaatagatgactagggttaagaattattgcctaattggccgggcacagtggctcatgcttgtaattccattactttgggaggctgaggcaggcggaacacaaggtcaggagatcgagaccatcctggctaacatggtgaaaccccgtttctgctaaaaatacaaaaaattagctgggcgtggtggcgggcacctgtagtcccagctactcgggaggctgaggcaggagagtggtgtgaacccgggaggcagagcttgcagtgagctaagatcgggccactgcactacagcctgggcgacagagtgagactctgtctcaaaaaaaaaaaaaaaaaaagaattattgtgtaattacgccacttacaattaactttatggtggtgtcctcaatggcaaagtcatttacttagcgtagcaattactcattttgacccactaatcccagacttttcttgtctgggcacggtggctcacgcctgtaatcccagcactttgggaggctgaggtgggcggatcacaaggtcgggaatttgagaccagcctgaccaacatggtgaaatcctgtctctactaaaaatacaaaaattagacaggcatggtggcacgcgcctgtaatcccagctagtcaggaggctgaggcaggagaatcgcttgaactggggaggcgaagattgcagtgagccgagattgcaccactgcactccagcctgggcgacggagctgtctcaaaaaacaaacaaacaaacaaaacccccaaaatacacaaatcctttacaattgaattcttgcttttttaattcctttctcaggctatagaaaataggaaatattttattgtgtttattatttagttctttaaacaattatttgcattactattagatatttgaatcttgaactatgcaacctttaagaatgcatgatagagtatgtactttagatggagttgctgggtaccattaaattgaacgtattgagagctatgggtattaaacagcaaattttcactattctgtgttagtaagcaagatagggtaagaaatcatcaggacttactagatttgactcacaaccacagagtcatggctggatggggccttaactatctttaggtattgggtaaaacagtatagtgtagggattaaacacataaactctaagctagacaggctgggttcaaatcctatcattattattatgctatgtgatctcaggcaagtcacttaatctctcttttttcttcatctggaaaatgagactaaaaataattcctacattatagggtaattgttaggctttaaagagttaagaaataaaaagtacttagaacagttcttgacacatagtaagcacttaagcattggctttaataactattattatgatacgctgttcaattccgtccttttaaatttgttatttttagcataggaagaaactgaaactcaggatggttgcatgacttgacgagggtacgcaagctatttgtggcaatgctgggaccagaaccaattttcttttaatttattgtttaatagacttttttttgagtaattttagtttcatagtaaaatcgatggggaggtacagagatttctcatataccccctgccttcacacatgcacagcctccccatcatcaatatcccccaccagagtcatatatttgttacatatgataagccaactttgacatattattattactccaggcccatagtttacattaaggttcactcttggtgttgtgccttctgtgggtctgaacaaatgtatgacatctatctgtcactattgtattatacaaagtagtttcactgccttgaaaatcctgtgttcttcctgttcatccctctctctaccctaaactcttgcaaacaatgagtttttgctgtctccatggttttgccttttcagaatgtcatatagttggaatcatacagtgtatagatacgtacagtggatagaaggcaatcttttcagattggcttcttttgcttagtaatatgcatttaagtttcctacatgtcttttcatggcttgatatctcatttcgttttagcactaaataatatttcactgcctggatgtaccataatttatccattcatctactaatgggcatattaatttcttccaaatattggcaattatgaataaaattactgtaaacatctgtgtgtaggtttttgtgtgggcataagttttcaattcctttgcataaataccaaccactgcaattgctggattgtatatgtgtttagttttgtaagaaactgccaaactgtcttccaaagtggctgtaccatttttcattcctaccaacaatgaatgagagttcctgttgctccacatccgcatcatcatttggtgttgtcagtgctgtgagtttgggccattctattacatgtgtggtggtatgtcattgttatttttaatgtgcatttccccaatgacatataatatggagcccctttcatacgcttatttgccatctgtatatcttctttggtgaggtcactgttaaagtcttctgcccatttttaatcaggttataatattttcttactgttgagttttaagaattctttgcatgttttagataacagtcctttatgagatgcatcttttgcaaatattttcttccagtctgtggcttgtcttttcattacctttacagtgtcttttgcagagtagaactttttaatttgaattaaatccagcttatcaattatttctttcatggattatgtctttggtgttgtatctaaaatagtcattgtgaaacccagaattatccagattttttcctatttaggagtcttagaattttgcattttacatttaggtttatgatccatccattttgagttaatttatgtgaagagtgtaaagtctgcgtctggatttatttttttgcatgtagacgtccagtcgttccgtcaccacttgttggaaatactgtctttgctccattgtattgcttttccttttaagtcaaagatcagttgactatacatatgtgggccttctcctgggctgtctattttgttgcactgatctgctgtgtctattctttgccagcatcatgcattcttgattactgtagctttatagtaagtcctgaagtctggtagtttcatttgtccaactttgttcttctctttcaatattatgttggttattttcagtcttttgcctctccatataaattttagaatcatttagttcatatccacaaaataactttctgggattttgattgggattgaattgaatctatagatcaatttgggacagaaccagtttttaacttccactttaggatctttctacagaaccaaattgccccatgacatatcaacacatgaagcaatttaattaaataactttataacttccatagtatggtagtcaattacaatgatttcttcagaccttattgtctccagtcccaactagggaaagtatatcttgaattccagtaagtactaacaatgtactacttattgtgctttgaatctagtaaaatgtacagatatgggaaaagttttgagatgttgtacattcttcttcttcttcttcaccttttttttttttaatttgagatggagtcttgctctgttgccaaggctagagtgcagtggtgtgatcttggttcactgcagcctccacctcctgggttcaagcgattctcctgcctcagcctcctgagcagctgggactagaggcatgcaccaccacccccagctaatttttgtatttttagtagagggggtttccctatgttggccagtctggtctcgaactcctgaccttgtgatctgcctgcctcggcctcccaaagtgctgggattacggtgtgagccactgtgcccggtctcatttttcacttaagccaaaagatttgttttccttttaaatttagctctcaggttgttttttagaaaagagccttcatggtcctttatattccttttgattcctgctggtagaaaccaaatacgtcttctccttgaataaaaacaaaatgaaacaaaataaaatacctagaaccttattttaaaaattcagaaaatacaaatatctaattcaaatccatctgtcaaactctaagttttatgtgtttttttaattgacatttttcttaatacattttaataaagcttcggagaaacaatagggcaatagtagaaaagcagagctgccaggccaaatagtgaggaggagatacatgctggtaccttgggcacactaaatatattttggaaaagtttctctacagacaagtgacctgaagtaggagactgttaaatcatttttagtgtgtgtctgtctccttttaatcatccacccttgggagggtgatatactactgcagcactagagaggttgaattggtggattacgatgagactagagtggtctggactcttggtttcttactagaaattttcccaggatagcttgtataatgtataggtagatattacattctaatgtctgtgctgtaggttagccaccctgaaaatagctaaagcaatattgatctgtattctaaacatgacccaaaatttatttgacattcttaaagatttttgtgaataaggtgaagaatcggttgatctataagttatatattgaaagttatttaatttttaattgaaaactgattttttttaaacaaaagaattgaagctgttgtttcaaggtagttttgtttatgcagagggacatattctaatttttgaagcatgttaatacacaaaaccacataaaaaggatgatttttacaattcatatacttaggattattgttgcccaaacgcagggtttgaataagtcaaatgcacttatattttttatttgtgtgtaaatattttttagaaaattttacctctattataatgttcttaagtcccatctaaatgacacatagccaaactgtatagaaatatattaaggaaggtgggtgtctagatagataatagtgctagaaggagatatgactcgtcaagcagagtctagtttttaaaaattcggggacgaggagagtggcttaaaactatttctgttttctgatgtttgtaattctatagctgcaaatatatcacttacaggagaaagggcacctaggagtggggaaagtgggtgggaagcatgtgatggggtgaggagtataataacatcataattttggaactagaatatagaaaaaatctggttagaagtatcagacaaagaaaaactgttttttttctcttttaaggcaagtttatttagaagcattgattatttttatttttccctcctaataaaagattaagggtaactgctgtagtttcagtcccatattctatgaaatatcatcctgattgtgatggtagcttcttatgggatttatttctgttgttgtaccactatgtactatacgcattgcacctgttcacacagagtacattgcattgtgatgtttgtacagctagatgctttaaatgagaagccaatctcccttcttctaggttcctagcctattagttacttaattaagcttaattctgttttggtctgtaattttgtaagtctgcaattttgtatatggtctcgatttattaactgagcaatgatttcttctttgcagttatcagttttgtctgagatcagttttcctattgtatggagtctgtttcttacagagcctcctttaagactgctctgactttaaaatcattactaggcttttgtcagagctgatttgttcacattcttctcacattaaaaataaatttaaaagattgcacaaataagctatgcatttcactatttcctgcttatatgcaaaaaatgtatttatgataattacatgtactgccagaactgaaacaatacattcctcataatggagcataaataaagaaggtggagccagctgctcttaaactgtttatttgcaagcaataatgatatagagaatatacctttttcactctgttagtctggcaatactgaacctgttgctgcattagacgagttgcattttgctggataggggaaggagagctgtctgctgtctggtaggagggctttgtctgtgcctttctctctgtttctttctgtttttctttctctctctctctctctcctcttctctctctcttactcgcttgctctgtctctgtctctctctccctctcttcccccctccctcctctctcttgctctctctctctcttcccgtctctgtggtttgtaaggtaggttgcagtgtgtgtatatacacaacatcaagagcaggaaaatggactcattagggaggcaggcagtcattaccactcacactgtacttccagggagacaccgattataagaagagaaactcagcgctggggaagaaggtagggcagacaactttcttaaaaaaaaaaaaatcctgcttcctcaatgccccctctgtcatctcctttagcccccaatgcctttattctttcctgcttgaattttaatttccagatttaagtttgacagagctagtgctagcttaaaatttagaacatctgtaggaggcctaccctttactaattttcttcctacttacttaggggtgtgcccttgtgattcagttttgttactttaaaaataattacaaacaaatctatttttctcactaaagtaccaaataaatcagaatctttcactcttttaaaacagacccttccgtatgtttgtctctttgcttttcttgtctgtttatgcaattccatctgtctgtctatatatcatgttgtccttatttattgctaactcggttttgttagttatttgccaatgagttttagctgcagtgccagtgtgggtattactaaagtgagactcttgttctttgttttatgttgaagtttaaagtccatatttacagtttaaatccttgaagcaggttgaatactttttgccagcatgtttatttaatgccattggacataaggtgaggggtagttgctgagggtgggtaagaatggagtaattatttttgtcatcacacacatagaaacattgcatctgggggatgtatttttaaacaaataaggtattctgttttctaacttttattttgcagatgggcttttacatttataggaatatcactttggttagtaagaatgcgaactttcttaacaagcagtttttatcctaggacagtttccttttagtatgttactgtttatttatgcttggggagggtggagtgaggggctggccatctttttacaaagtggaagctatgaagtgtatcaggccatcttgcacaacaactgtaagtattcatttaacattttggggagcataaataatataatttttatttcaaattcagttttgtggtgctttcttttcctttatttctttttttcttttttatagtgggaaaagttacatttcaaactagcagacattgttgaagagttttcccagaatagtgttcttcaaaattgaaaggattattttaataagggccatttgaaatggacttcttaatggaattttatttcagatttgtcaaagtaaaactgctcttcatttgataaaatttaagtcacatagatacacaaatgtttcggcatatacagagcaatgttagaaaatggatgctgatctgtagagatctttgataataacagtcatctttttgtaataaattatttatttaacagaagtggcagacttttttcccccttaattccattaggcttctctgacaacacaaagaagtccataaagcaatattcttaacccacctgggacactagagcagattcccaaacacattctcaaggttcaaacctagtaaaatgtttattaaaaatccattatttcaggaaggtgatgaacttttgctgctgaaagacttttttacctcttcttttaaaaaattaattctgagactttcaatttgcttatcttgcctgaacagtttttttaaactggataggctggctttgaccaagagtagtacaaatactaagtacgctcaatcaggtcccgtcggagatttttttccgtaaggtctaaggggaactttaggagagtattttatgttaatatggtacacgataattttgtttttcatatacaattttatatatactttatgccatttctgacggtgacccaaaaatttgtttcaaaactgatactgtatgtcaaaagtgtacatgtctcatgcacctgtcattttctgtgttagccttgtgaggaccatctaaaattctactgtttttatcaatagaaatctttcatctatgtcttgattagtcattctctttttctgtacacacatacagtggcgatatctgtgcatacatgtgcatgtatgacacgaagtcatacatgtatggataaatacatcacagcttcttttcagatacaatatttttaaaaatttcactttatgtgtgtttatgttaaccacaagcaaacaaaaaatggagagaatttcaagagaaaaatgaaaatttcctttaaccttttagcaagaataaaagcaagtaataatgtagccatttttatgtttggtttaatttttagaatgtgtatatgttttcttttgcattataattcttaaccttcagtagatctaaaatatttttagtatgaaaaataatcttggccttttctgggagggactgtcacaatctaaatacagaaggacattataaaatgtgcataaataaacttcaaaccactgtactctgctgtatagggatttggaaagctgaaaggcttgcgttacaggagcgctatagaatgccagaaaaattcattaatcagccttattggttatagtgggctcttcctatcagcacatgatatctgcctgtttagatccccaaagtcttggtcaggtcacagtgtgtttcattttaatgttggagcagacagttacctaacacacccacatgaggaagtgctctaagaagttacttcatgctttgccatgccctgtagctaaaacaatttggtactgagtgacgtgtgtgtgctttttaacgtgtgtgtgctgataaaaatcagctttggctctttgaaaaggaccaaacagtagattttttttaaaaaaaatagggcactttgggaggccgaggcgggcagatcacgaggtcgggagatcgagactatcctggccaacatggtgaaaccccatctctactaaaaaaaaaatacaaaaactacctgggcgtggtggtgcatgcctgtagtcccagctactcgggaggctgaggcaggagaatcccttgaacccgggaggtggaggttgtagtgagccgagatcgtgccactgcactgcagcctggtgacagagcgagactacgtctcaaaacaaataaataaataaaatcaaataaaatggaatgccagaccatataattcaaatgctaagcatatgccagtttaaactttttcttcttttttaacttaagaggagaatcactatgattatttttaatataaagactatatagtgatttattggattttactcattagggtttcaaaaattgcagatactttttattctgcacatttttatctccagaagcctatattcatcaaaaggatagcagctgcatactttccccatgaaatgttaacaaataaatggcattcctgtttatttatctatttttgaattttaatgattagtccttgtgctaattaacaaattctcgtattcataaaatctggcactacataaatatctaattgtgtgattatctacacatgttctggctttctataaatatagaaattatcagtggatgtgttcatggacttgcccaactctaagcagtggccggtcatgccgccacataggaagccaaattcaggccctgagcaaacgtgttaccccaacatctggcaaggtatgttgaagcagcagcacctggctaatattgctaactagtgatcttttctggcaaaagaatgactggtgttgatattctttgaatgctgctagctcctgggttcttcagcctcaagggtggcctctgaagtctaaatgttgaaaatggacattaaagctggtttatcttggaggtcactttataaatatattttaacaaactacatttttggtgggagacatgttttactgtaaaacataagtaaaatagtatccttatccctcactttcttaaccagtgaagatctaagttaccatgagaagtcacaaagcactgaaaagaacctctaaatattttcatttgcatggctgtgtaactatttcagggacattatagaaatcaggtattacctacatagaaacagtttaccctccatcaaggacaataaacactagcaatcggacaggtgtgtacctgccagagttatcattaaattagaaaccaaatctttaaaataatttgtttcatactgtgtaagacatttttgttattttatacaattactatggattatttacagtgctaatacagtcagcatttacatttgatactttacaccaagctttcaagtcatgtataggtgtgtaggtattttacaaaacttgaaacttgtaattttcttgaaaaacccatttcatacatttccattgcttaaataaattctagcattttgcataatctccaggaactatagctaatgtcaaataaactagcaagatcaattttattctttaccaaaagcctgaaggcaatatacatatcttagatattctagagaatacctgaattcatgttttcctattacatagatattatacattaatcatcaaataatgttgatgacaattatgtttaatatatcaaaatatccttgagctcccctagttctaattcagcataggcaagctgatgaggctatgggaagaaatatgctatctatgattactatcatgtatgtagtaaccactacagccggtgttagaaacagcattcaagggcttataagaaaaagggcttttttttgttttgttttttgtttttgccactctagctgttcaactgtaataatgaataagtggcatgctatttctgtactaaactgtggaaaaattatgcttgactttggcttcataacctctcttatactccaggatcaagccttttggtaattctatagttcatttgaaagtaatcagcttgaggacatggagcttgcctttctggaatcttttgacactcagctgaaactctagccttggtgttttgtagttcagttaaccaatgcaacctttgtaattgtcttaacttggggaaagctggctactgactttcaagtgagaatactgagacaaggaacaaggactatgagttcattgattcatctagtttccagagggaagaagaacatattttttattaattctgaatattcagtcttacctttgaaactctgatagaaaatgtggtaattacagcataatatgtttaccttcttgatattggaagtaattttgtcactgaatacttctgtgtcttgagatatgatgaatttaatgttcatattatgcatttaaaaggtcaatctatttgaaagtttttatattacattactaatgtaaggatttacattcaacaaatataaaattatggtatgaggttggggttatgggatatcaaaaagatagatgcccaattggttgtaactaaaaatgtagaaatggtaataattacgaatcttatacatagtagtactatttttgttattgggaaaattcttaatttaaactttttaaaatgaaacatttaaaattatttaaattttaattttctctaatttttagaaggctttacatttttgttttttactgaattagcttagatatttgccatttttaccttttcaaaaattttctgtgaattactgttgtaattaaattgtgatttgttgttgcaattccttttatagtatgaacttctttcctgtaaatggaatgtaattgagagaaaattaatgttgtcagtttgttcaggtagcaacttaaaacttagttaaaaaaaaaaaaaagctattactagcagaaaactagaaatgttccaggctatgtaatttttctagttgatatatatgtgtatgtgaaaactatgtggcttcattttaaataaacaaaaatatcttatttaggcaccaagacatttaaacagtgagaaaatgttcctctcttttattatttaaatagactaggcaaatactttgtaatggtgactttataaattttttgtttttttttcttcttaaatactggacacattaaaattcttcttggcccaataaatatactctggttctgaccatatttactaatttctccacttcttggttacttgtacctattaccttagctttaggtaaggcaaaaataacttactttttatattagcccttactttctctagttctccaaatcaacagtgatctttatcccctcacctcatttctagaagggagacgactagagatgattaagaaacaagtagagagaagttgagataatgtgaagggataaagctgagggtacaggggtaaagctgagggtagctgaggggttggtgcttttgaagcttctaaacttagaagtataatgaaataaaaagacttcttccctaactcccgttaaaaagcatttgacttatctgtacagcattagtttttgcatctctctaaagcagatctatataaattccctctgcactccaagacagattccagtggtaccaccaaagaagatcatagaagaaaaagtcaaaacatctcacatttctagaacatccactgccaggtttccttcataccttttgccctttaattcttgggttcggagttgtgagcagatttttatagttggtggacagatttcatttgttttgataagaagctttaccaacaacacattcccaaaacatgcccccaaacagcatcacatgctgaattaaaatagatgaagtgattagctggataagtgtgcgtgtgtttcctttttaaaaacaaagtcaaataatttgtatgaaacaaaacaaaaagaacttttctagcagtctgaatgaattcaggttgtttcacataatggctttctgaaaccattttttgtatagtaattttgaccaacacatccacctattccctaccccacttgctttttcgctttctaaatgttggatgaatgtaattccttaatataaaaataattgtgttcttataacacattcaaaatatacctatggatatgaagatgtggtacggcctatacacagtagtttcacttatatcaccttagtctgaaaatatatgaataaaaaacatttttagaaattatttttctggtatgttgaaagaaactttatggtgtgatacaaaaagcatttcctggggaatcaggaggtattaatcaatatcaaaaaggatttaaagtggttaaatctggaggtctggttttttgttctgactttgtgactttgagtacatcatgatctctctgtccctcagtttccttcctgtaaaatgaggagaaagctttttaaaatattttttcatcttaaagactgtgattttaagtagctatatatgtagataatcttgcttgcattttctatctaaaagtcacaaataaatggagaaaagttagggtgggtaataaaggaagaataacggacatttatgtggcttgagagagcacaggcactttaattttgtgatgatttttcttagcttaactacatatcataatgtattattgagtctgtttaatgattgaacgaatgccataaaccaaaaatagtcatttgtcagacaaactgacttaattgcctatgggtgatttggtaaaagggctgtttttaatggaatgaagtgcagcatggttactatggctccactcctctccactggccactagatggagaggcgatccgtgtccactgccttgccaatagcaagcagttcacttctgacttcctaatggcaaagctgcactctatgcctttggacatttctatgaatacacacatgacattttggagaagtcatcagagaatatgtcctatttctatataggcatgatataatattcatgaaatgcaaaatactcctctttaggccagtgttaatgttggtagacccagtcggccagtattacaactgtggtgttagttgtcacaatagggtctattctgtctcttacaaatttgtccatttagaaaggaccctgaaatgaatgtcagcacgacagtgccaccttgtgtccctgttgctgtgcaagtaactgatgcatgagttagtgaaaaaaacaaacaacaacaaaaaaacaggacatttgcaaaaaattggcaaattgtttcaggccctgatttcgtagtagctgtaccaaaattctataatatgttttagtctttgaaatttcttattacccaagaaaaagttaggatgtgtgcactttactacttttctcctatcagggtatataaaaaattctttaacaattctaggcataaacagggaagtatttaatttagaattggaaatggagaagacagggattgtcagagatactcacttaagctcggtcatttcaggcattgaggtgctccttctttcacattcccacagcaattttatatgcataacttggcaatatcacctctcacattgtattgccattgtttgtaagcacatcttccaactaaaccttgagcttcttgaggatagtgtctgtgtcttattcatcctccagaaccttctattggcattcagcacagagctatgcaaatatttgaggtctaaacaaatgattatgtctagctggtttataacattctcgtgtatatatatatatatatgtatgtattatatatatgtgtgtgttatatatatatatataaaatacacatttctttgttgtaaataagtttggagcctttttactttggaaaaacagcttctgataccacttcctgcctaaacatccctttataaattaccttcttccttttatcttaaaatgaccattttctctttttgattatgaaaacaaggcattgcctattcacaagtgtgtattgtaattgactttgatgtaaagataatttttaattctagctttacaacaaatttgctattatttggggtaacatacttaagtttttttaggtctacttcctatgtataaaatgagtggactggactagttgatttgacaggatttttgtagggattgggcaaatgttagtattattctagctgtatatttagttgtactttttaaagtaccatcatagttgaaaatgaaattgctagcctttgaaagtgctatttgatatttcatgttttagaagaggaaactgaggcaaaggggcttataggggaatgaattgcaagtaggcagagtaaatagtattataatggatgaatattccatttttttatttgtttttcacttttttgttcatttgtttttggttaattgagctccactctccttctattctttaaccatataataaataaagtacaatgaacttatatagtaagatgaacccacaggttggtagaggactatggactacttgcagttcagagactctcatgctattttgagtttgattcatagcacttaaaaatgaatcctaagttttaaatttcacacagttttgcatgaaatttacatctagaggtttcagtccacgtattaccataaataccagcaaacttatgactgggcaaattgcacaaactttttaagagttttcttattggcagaaatgtgataatatatattacctttcctatctacctcacaaggttattgtaaggattaattaagttaatatatatgaagtttttttataaatagtaaagtagtatacaaatattatttattggcattactgctctaattaaagaaggaatggataataaaaaactaagtcaaagcaaaacacacaaatttaagaaacagtgaaacgcatggtgtttcctaggtgatatacttttctgtgctggtggaccctctgtagatgacttaaaatgttatctctatttcccattttgattttgaaacctgtaataataatgataatacttaccctaaaactaatattttctttagataaaatttttacccatcattcataaattttgacagtaatgtttatttaaaaatagagggaaaaaagtttaaataaccaaatatgaaaaaaattcttttcaatattatcttactatattctagtccagtggttctcaaactttagtttacataagatattcttcggatttttgttaaaattcaaatttctgagctccattattaatgggtatggaatggaactcaggcatcctgagttgtagctggcccacatacttcagaaaactcgactttagttgattattatatgtcggaatcagccaagggcttttaaaatacacagattcctaggttctactcccacatatctaaaattggagtctctagactggtatttgggcttccatattttgcaaaaactacaccaaagatcctagtaatattgcaaggtttgagaatcattactcttgtttctagggtatattgttaaaatatatttactgtcacacctgaatttatcctcatctctcacattattccttaactaaacataatcttactttatgtaggaggccagagttgatactgctatataagaaaagtttaggcttgaaaaccgattagaactcttgtcctataatgctaaaattaaggaagcgagatattgctaagcacctttcacacaaactgtttaatttaatctttgcatacaacaactttgttgcatacactggttttctgcctatgttttagatgaaaaaactgaagcttacagaaaaaattgccaaattcacacagctgctaagagtcaaagccaagatttagtctctgttctttctattacatcctattatattttttcctcattcagtaaatctttaccaggttcccattgtgttaaatgataatgtctaacttttggcaccacattagcccctgacatgctatcataattgttgcttagaccatgtaaattgagttttgaaaaaatttttctattgcaaaatggtttttagctggatgtagaattcatgggttctcaatggtcagaaggggtctaaattgtagtgataattatagttaatgaattgttaaggaacttcgcctatgggatctcttaaccaccatgcctttgctatgaagtatttcttaaccctatttaaagatgaggaaagaaagatttagaatggttaagtggtttaccgaagattgcagatctagtaagtggcagaactgggattgaattctggttcactctaattttcacagcaaagttaaccagtagtatatacaatttctgactctgctttgcagttattcagaatcaggctgttcctccatttgttgagccactaaatgctaattaaactttgtgggatttaagtttgtttcctttgtagggaacaaaccagtttgccacacttaatcagtccagtaatttcttaaatcttgtaaagtttggaattgataatgcataatcctctagggaaatcagttgaagtgaataatcttttgtttatatttatatttgagagttaaaactcttggatgggacagattatttgaaggaaaattccaattttacctattatgacacgctgtgaaacacaacaatttcatggcatatccattgttattggtcttaaaatatttggtttgcatttaaatttcaatgaaagtgttaacagcatcaatgcctcagtgcttcataacatctaaaaactgactcttgagcattcctgatgttcttgtctgaaaaaaacaatgcctcatagtataaaatgacagcacatgtatgcaaacttgtacaatttctcacttatcctgtatggatagctaaaaatgtaatttttatattttttaaatatttaataatatgcaaattattgatatgcagtaaaatgcagtaagggcagtcacaatttaaaagagctctaaaatatatcctttagttgtgaaaataatcatgattttgtaaatttagatatgtgtacacttttgggatattcttaacacctctctatgtattaaaaggttcattttttttaaaggaagacccacaaaatctctaaccagggttatggtcttgtctttagcagacttacaagtttattggaaatttggggttatatttcaattttcttctctaagagtggtcttttctcaaatggcattcttttagaatactgtcagagaagagagaagaatgaaaacccaaagtgaagaactttacctatactcctttttcagatgtagaaattaaaacatgattttgtagaacgtcccctttagcagcagagcatgaattggaaaatttggtcagtgatttatttaggctccacaggaaaaatcctgtagggcattttttgaatatcctaaatttattttgatttgagaccagcttacagggcatgtctatcttaaaacagttctccattttcctgagaaaaattccagtggagctagttgtgggaggtggtatcccaacaatgaaccatttggggccaaataagcactttaacacaacttactccatccctttccttaaaccaaagtctgtcttgcccactgggcatgtttaactttgactgctaattttatttccctgcagaggcaaaggaggcaggaaaaaggagggaaaataactgatggcatgtgggtgaggttttgtccaggaaataatttttaaaagatcctagccagtatagggatgcaggaagcagttggtgcctgaaactatattacccttgcatcacagattaagaagtaggagccagttgaagttaaataacttgcctacagttacacagcagttttcagtgttggggttggtactgggaactaggttattcattgctccagtgaggaaattggacaatccagcttttttgctgataaagatgctctcctaatatccctactcacgttttctttccttcttttctttggctactgtcttttaacatctaaaaaagtattctgctgataatctcaggtgtagaggctagttattaaatatatttagacttttaaaaccattagaattagctgagctgtaaggacagtgtccaccacgtgaagcctttttttctctattttatttggatcatgtaagtaatgaagatataactggaaaaaggaaatgtcattgaataaatagttctgagctcatggcagagttctaaacgtgaaaaatgtaatggacacctatttaaagacaggccatttttatttttacctcctaattacagttaatctgaggtatttgaaatgaacataagctaaattttgataccttttcctcctaaattgatatcattagatggatttaagttggaaaggaggaccatggtagaaatacgaatcagaattttagacttccataaagtttataactgtcccagttagcctctgtgcttgaaccccaggggaaagttgctatttggccctagtatcaccctaagttgtgaatatgttttggatcaacttctcactgatatgataaatatttgacttaaaaattagtgaaaactttttaatgtggtatctgttgaatattaccatttaccccttagtgtccttagtaaggttctagataccaaacaatttctactagagtgtgagttttactcggttaccagagctgactaactgaatatgcaacagaacttagaagtgatgccatcacatcagacatagtacaaacacagactagtgcactacagatcctctaaattttgatttggaaatatatgaattattcagagatccaaaaccccagagaaaatcaggtagaggaccttcatataaacacacccatagcctgtattccattctaagaattgcagtttgaaccaatagaagcccgaagcagctacacacatttgatttacaactgtgtcctgtctacttgcaaatagcagctagtttccttgtagggttggctgacaaggctgttgttttttttatatattattaagagtcaatagcagcagcacatgcaggctaattgttagaatataaagctttgttggaggtggaacatagggttctagtaatactcttaaattcacaccaattgacacaaaataaatacggttctctaagaaatatagaaggcttaaactagaaatgactgaaaaataccattttcacaagcatttagctatttccacctccaaaaaagtagtttttactttatctatatcttcataagcctttaaggtgaaagatgaatgacagcaacaaaatgacagtgacctaaaagcataaaattgtagttagtttaggtaatcccggggacaaatataatccagggtatttattagtgagataaaaggggaaagaaatgctgtgctttcatcatactgcaaataaaatgcttaattaaaatgccctaccaaagtaaacaacttatttctaagaaattactgctgaagaaattaagactaaaaaatagagaaagaaatacaacgcccgtttttgtacatttttcttatatttaggtgcttttaaaaattgtttttatgaactcctaaatttgagtgcaagggagatgggattacattaattgccatttaaatactcagcttcatgtttgtaggcatctttctgaaccagaacaaaaagaccataaaaaaatttctagtgtggaaatcatatttcatgtggtgaaatagaaactcaagaaatttcctgatataataagcttgagagtgattaccaaagaaacaaaagtttcttatcactcggcctgaggcaaatgtggcatattaagcttaaaatgaattctcttttcctgaatgcacacaactcttattaatgtcttggaaattatgcccaaataagattttctggatacatttgaaaaagcatccactggggtttaaggactattttatgtctatggacattttagtgtttagccacaaattagtttttgctcttttacctctttcttaggtttaactttagatgaaatgacttgtttttatcttaaaagaggcctttcctttagtgagagttaggttccctggtggcctgaaagagttaatgcagtttccaagagtgtccaacttacttccagggagtagtgtgtgcatgtgagagagtctggctccaggatatttgttcacatcccaaaaccaatttggcacaacttaaaatgtctgctaggcagaggattcagtgttgttaggccacgcaattagtgctttatttcatgagcaccaaattcacccaatagtgttttgatttaaggaagagcttgaaattcacaataacgggtttcatttatcagagccatatgggactcaacatctttggatatatttgtaaggctttcacaaagaagactttttagacatctcagatttcaccgattggagggcaatctggatgaatatctttttttggaaaagatgaactatcgttttcacatgtagtctccaatttcagtattccttgagaagctcaaaacaacaacaacaacaacaacaaaacaaaacaggaaagcgttaagtaagtctcagcttattagcttttactggaaaataaagaccatgattcttagatctggttcagaatgccaagtgaatctttgatgttgaaatttggccacctaatctttgcagtttgtgatggggcatttatgaaagagaaggtgggttctaagtctcaacatatttgtgcactttttgctagttcggtcttggtcatatgtcagtggattcttgggacgctttctgcagcatagctaactgattaacatgatgatactttttatatttactcaagattatttctttgttcactcctgattttccataattttctgatcattagggatctatcttaatgcaaagtattcttgaagatgttaatataaattaatcttttaaaaaaacaaatctcatatttttccactgatctgttaatttagatattaaaaaaacagattgaccttcatttggcaattgttgttaatactttaatttttggttcacagattttgtttagtgggctataaatggcctataaacaaatatttcagtgtttactaattaaaaatcagtattttttttaagcatagagtgctattgtgttatgagacaggcaaccactaattctgttaggttttcaactttttattttcttagttctctagtctttttttttttttttttggcactcttcatgcagtatggtaagcctggttaagtcagaatatttacaagtagtaaatattactgtgacagttgctacttacctatacaaagtctatgtaaacatcgtaaggatgataattttaatttgtaaattgttatggtaaactggaaattacttgaaataactcttgctcatctttaaataccattttattgcatctaacattattttactatcctttattaaaaaaacttttaacactttattagctaatagtgcttatattagcaagttttagttttcacagacaatatccactaaactttgttcagttatgagcatgttgaataatactaaattaaaacaaaatacagtatattcttggttaccatttacattttatattaataccaatgtcatatattttaatgctatttcaaaaatatttagaaaccctctctctgctccctaccatttcttctccaatatatatcctactctacagagagagcacttaggaatttgttatgtagcccatctctatcatgcacacctatattgctatgggtcattgacccctatgctataggccaatgagcctgctggacaataggtagaaaattggaattatagcatgagctataattatagcttaactgcttaaatcaacttaacatgaattgtgctgaatggctgaatatattctttctatatttattttgtagtcaaatgttctaaaataactttctataaaaagtataatactcttaggtttaagttttattattcacctttgtttacaaacataggtattgtaatccaatgagggtaagtgttttcatcactgaaaatttcattatggaatacagacttttttggtattttctttgtgaaacagtatagtttgatggcaacaaggaaattaaagatggcagaaagactatatagatatagtggtatctaataagactttggatttataaactctaggctgtgaggagaagatgggcacatggattgaaaaagaaaatgtggatgcgatgatcaatggttattctttaataatattcctaatgaaggacatatgatgaggcaaagaagaatacaaattgatggagtatatgtatgaatgataaaatagttgtatgctgagagaaggagattgtgaagcaaagagataagagttatatgtagctttgtggctataattgccttggtttttgcatttaccttgagtttccattgtaggtattaatggctcctgtatataatgttcttagtataagtagaatccataaagcatttggtttgagcaggaatatttatttgcttgtgaggatagacctgtttgactttgaaatgtagtgtgctattaccttatggtcagagtaaagtttatattgtttttattcaaattacaatatgagtatatttaagaggagcagatatgtgtgtgtttgtgcatgtgtgtgcatgtacacacatgtaaggaaggacattttcatttctgtatatttctcctgtgtttgctgctttttgcttgccagtttttctttgtctctatcattttatcactgaaaccatctgtgtagaaaatagtatgcttggttttatcattttaaattgttttctatttttgttattttgtcctcccaacttgttttcaccttaagtattcaggctcaagtataaggcattttagttttcacattcaagaggtgtttctgctttctttcccgtccgtttgtccatatgtttactggtttctgataggctgtgcagtgagacagcagtttactatctgtgtgtgtgtgaaattagctaattggtgttagcagaaatattttcacatgttttataagcaaagtgcagcaaggtatataaatgtagatatgatccagacacgcgcacactcacgactgtcactgctcatgcataggcgctcagaagtaattaatgttaataagattttaatgtgcttgtgagatcataatgaggagaaatgaatgctctgattaggaaaaggtaactgtgtgtgtgttttggcttagaacaagatttcaatttttataaaccgcaattttagaacttgtttgtgattgcatcaattggtttttattttcaaattagaggtctgtttagccatttgaatgattaaccaaataaatgggtgaaaccctgatcataaggaatagtgcaggtttttcatttgcaaggcagtgttagtatacagcaaggctgtgatgtcttttgccaatgtgccattttaatgttgtttttttaaaagaagcttttccagaagccacttgtgaatatagtatttatttttataaatgtagatgctatctatacgttccagagacaccaatcagacactgtaactattgtgtctgagatacattcctgccagtcagtgatggtgtattccgtgtctaaagaatctatatcatgcttctcaaaatgtttatttggaaatgtagcactaccaatatttttattcataaatataatctttacaaattttagaagcttgatatattttatggtgaagtcaaacatttcaaggtaagtaaagatctgtctgataatagatttgaaggcaatgcagtcaacagctatattatagactggcttaaatccagctggacaccaggggtccttctccacaacaaattttctgaaaatattgtttacagagctttgacatacatttgcattattattattttttaattatagtataaatctaaatatctattaagggcccttgccctctagcacatagaaattacttatgcatttttaaatataaattgtggattgagatattcaaggattgtaatccttcttaaaaagtaagcagcatcgtactgaaatgcaaggaaaagtcttagatatgaactggatataggatagtgtagtttatttccaaccaaaccctacagatgtgtgttttaggctcttttaggttttggttatattactgtgatctttctgctggggtttaaaaatgatgatgaaggaagagaaactgttaaagtttgttctactcaacaattttgagatttatgtgattcccagggttgttttagatattgctttacatagaatccagagaatgatgattatttgataaaaagaggtatttgcctttaatacccagttgtttagttgactttcttggatattatcacattgaagcataattagaaacagttttcccagtgccagtttgtaagggaattcatcaatgtttcttctagtacttgcatgatatcctatagtaagtttttctatacagtcagatgtatttctatattcttctattctgtgccattgacctgtctatgcatgtgatattatcacattattttaattatagaagctttataacttgtttttatatctgaaatgttagcttccctccctgcttctaccattactctttttcagtgttttctggcttttcttgcatacttgttattccaagtgaactttataatcaactagcagatcttgaggaaaaagaaaatccctgatggcatttctattgaaattataaggaatttatgaattaacatcacaacaattaatgttcttatgagggtgaatctttttatccaagaatctgttttttatttccatttgctcagtaactgttgtatcttgctgaaatgttctaattttccttttggctttaggtttaaacatttattattaagtctgccttttggtattgcatccacttatttatttacttgcttactttcttacagccttactatactaaacaggctcttttcttctatattttctagctggcatttgtttctgtgtaggaaggctgttgatttttgtatgttaactttatagtctcctattttgcaaaattttcttattgtttgtggtagcccaaggtggatttgagttccccttctagtacaatgtttgatctttgtaagaccatggacagcttattctgagtgtcttagtcaatttgggctgctgtaacctcacagttctggaggctggaagtccaagatcagagtgccagcacggttgagttctggtgaagaccttcttctgggctgcagactgctaactcttcattgtgtttctggtagaaagagatcaagctagctcttgggggtctcttttataagagtactaatcccataaacctcatgactttatctaatcccagttacctctcaaaagccccatctgctagtggcattacattgggggtatagtttcaacatataaatttgggcatgaacattcagtttgtaacactgagctattttcctcatctgtaaaatgcagataagaaagccaaactagaatgatggagaataaataagatcatatcgtaaacacctaatattttccccagcacattgtaggcactctatttctagtatccattaataatgtaatgtaatgtaatgcaatatgtcacttgagcaattatttttaaagtatggataatatgcaattgaattattgaaggtttagcatatcagggtttttacgaagaatggagtgaattaaattaatgaacagaacttaaacttcttgataaacatttgtgatttaagactctaggggcagggcgcagtggctcacacttgtaatccctgcactttgggaggccaaggtgggtggatcacttgaggtcaggagttcgagaccagcctggactggacaacatggtgaaaccccatctctaccaataatacaaaaattacctgggtgtggtggcaggcaactgcaattccagctactcaggaggctgaggcaggagaatcgcttgaacccaggaggcggaggatgcagtgagctgagattgcaccactgcactccagcctgggtgacagagggagactctgtctctaaataaataaataaataaataaataagaaagacttgaggaactgaagattaattctgagattatgatattttgtagctatgcgcacatatttccattacttctgttttaattatgattattgcatgtaatactcattagccctggagagtaagtggaaacttcttgaacatctagagtgattattcaaggcaattcatacagtgtgttgattctagcacttgttattgtgccctacctcaagaatctgacaactttaccatattttcttagtgaacagtgtactaacttgtaaataagtttatgtggaataaatattaaacatatgtgaactcatgatggtatcagtataaacagaataatagtgattgtcagccctttatataactttttttataaagttggtgaaaacgctaattgaaaaaaatgtagttcatgtattatagcagtccaataacttttaagcttcaactctaataaaatggttattcactttacattcttttaattcacttgatacaatctattgttaaagaaaaggaatatcaaaatttcagggttcaacttttttttacctcatggttgttgtgaggaccaggtgagatgattaacataaaagacctaataaggtgccgagctcttgataggtgtttgagaaaatgttagttgttttcatttctattatcttgttattaccattgctggtttcttcattcccaactacctcaacccccatatcatctaccccactctctctctcactcttcatatatatatatatatatatatatatacacacacacacacacacatattcttactgataatgttgttctatacttagactaaaatgtatgaaatatgtgccataatggtcattaagaatagacataaaataatcgtctgtaattttccaatattgaagttagctaagagtgaagatcctatgagtgaaacatgtgaaaactttagttacttgtggataaaatttctgaggagttgtgaggatgaagaataatttctcataaagaattttaggcacactttatatatagtttatggtttaccagagttctggcttagcactcagtgtgattattcctccatagcttcatattgctcttttattcattcattcatatcaaaaacaacatagaatatctattagcaataacacgttgttctagatagtgtgagatatacaaataacaagattagttatatgaattgtctctatatttaagaagtctattaggtgattcagatagggaagcaatgaggttatgtgcatggactttggagccagattttctgttttgaattcctgctctgaaactcactagttatttcacttcaggcaagttatttagcctgggtttcagtttccttatctacaaattgaggctaaaagtagtacctattgggttgtcctgaggattaaatgatttggtacaagtgcatcatttagagaaataccgtggtaagctcttttcaagatactaattttagtttcttttgataaatacctaaaagtgagaattctgaattgtataacagttctatttttaattttttgaggaaacttcagactatcttccatagtgcttcaccattttgcattcctaccaacagtgtacaaggattcaaatttctctacatcctcatcaacacttgtcttttgttttattaataacagccctgacaggtgtgaggcaattcctcattgtggttgtaatttgaattactctgatgatgataagtgatgttaaatatttttaaatatatctcttggccatttgtatgtctactttaaataaatctttattcaagtgtctcttagtctgggctgctctaaggaaatacagggtaatttatgaacaacagaaatttattactcgtagttctggaggctggaaagtccaaggtcaaggcactggcagtttttgtatctggtaagggcctcttcttcatagatggtggcctctgtgcccacacattgtggaagggcaaacagctcatcatctctttttaaaattactagtcccattcatgagtgatctgccttcatgatttaatcacctcctaaaagccctgcttcttaatactatcacattgcaattaagtttcaacgtatgaatttgggggaggggtaatattcagaccttagcaaattccttagtgcattattaaaagttggattattagttttttttttctttttgctcttaaattataggagttcttcatgtattttggatattaaccccttatcagatatatcagggaattcacccctgctcgccacgccccaggctgcagaccagtaatggtccctggcctgttaggaactggactgcccagcaggaggtgagtgtccggccagtgagcattaccgcctgagctctgcatccagtcagatcagcagtggcatgagattctcatgggagtgtgaaccctattgcgaactgtgcatgcaagggatctagattgtggacttcttataaggctctaactaatgcttgaggatctgagagggaacagtttcatcccaaaaccatcctcctgtccttggataaattgtcttccacaaaaccagttcctggtgccagaaaggttgggaatcactgagatataaggtttgtagatattttcttctattccataggttgccttttcactatgttgtttgctgtgcagtcaagatgtatagtcttacctgtttatttttatttttgttgcctgtacttttgatgttacagccatgaaattattactatgatgaatgttatgaagcttttcctgtatgttttattctaaaagttttagtttcaggtcttacatttaagtctttaatcgatgttgagtttatttttgtgtatgttgtaagataaaggtccaattttattattttgctgtttttcccagaaccatttgttgacgagactatccttttctcattgtgtattcttgacacccttgtaaaaaattagttgaccatttatgtgtagatttatttcttggctctatattttgtttcatttgtctatatatctatctttatgccagaaccatattgttttgattatttttgttttgtaatatattttgaagcaataaaatgtgatgcctcaatctttgtttttctttctcaagatcgatttggctattcatggtatttgtggttccatgtgaattacagaaatgtagaattgactctatagatcactttgggtatggacattttaacaatattaaagtcttccaatccatgaacacaggatatcttccatcttgaatttctttcatcaatgttttgtagttttcagtatataatctttaatctccttaattgtcttcctattttatacttcttggtgctattttagatgggaatgtttttccaattttttttcagatggttccttgttaatatatagaaatgcagctgattttgtctgttgattttgtgtcctacaactctattgaattcatttattaattctaacagttttttaatggagtctttaggattttctgtatataaaagcatagactctaccaactagacaattttactttttcctttacaatttgaatggcttttgtttctttttctttcctaattgccctgggtaagacttccagtactatgtagaatagaagtgccgagagtgaacatccttgctgtgttgctgattttagaggaatagctttcagttttttccattgaaaactgatatgtagccttttcatatatgtgcttatcatgttgatgtactttacttctgttggtactttgttgtttatctaaaggaattgaaatcgggatctcaaaaagattagcaatgaccaagatgtggaaacaacctaaatgtccttctatggatgaatggataaggaaaatggtatatatacacagtggaatattattcagtctttaaaaaagaggaaatactgcaatgagacaacatggctaaaacttgaggacactgtgctaattgaaatgagccagtcatagaaagacagatactacatgattccacttatatgaagtatctaaaataattaaattcatagaatcaaggaatagaatgatggtggttgccaagggctgaaggaaagggaaaatgggaagttactaattaatggacataaagtttcagttaagcagatgaataagttctagagatcttctgtatagcattgtacctgtagtcaacaatactgcacacttaaaaatattgtactattaagatttgctaagagggtagatctcattttaagtgttcttactaacataaaataatgtagtaaggcttcaataaatgttaattcacattaaaattattattaaatatagcaggaaagttaatgttatataaccgtaaacacaaagtaatacagtatttagaggatggtaatatctttactgtgactgggaacagttgggatcggggagattcactgaatgcattagtatttaaattttgaagtatgatttctatagtgtaaaagaaaaaataaaaaggtagaggtgagtaaaaattaaaacttctggggactttgcagtcagaaaggttcctatcagaggcccagctccactcctcactattagtgtgaccctagataaaacaatctctgttaggattctacctccctgagtcatggtctgataactctctcaagacagcatactacagcaatagcaggaataaccttgttaatttccttttctcagcaattgctgtgctgtgcctgttgtgcaatgtctgcaagcaaatattttatatattttgtttagatttttagttgtttaaggcaggaggtgtatgctatttctgttacttcatcattttcagaagcagaaaaccaacatatttctattttacttttcaatgagttgggacttactgtctaattctagtagcacagtgtagttagttaccttttttgtactaactaaatggcagtacaagttttagtttacttacctgcttccttactaaactggcttctttgagaacaggtactgtgttgagctcatctttgtcaccactaccaacccactatcaagtttggagtctggaacctatcaggcagttaatgaataccttttacatttatttaattactgttaattgtagttctgtgccacactgtgaaagactgaatgctatgcttagagatacattttattctgtaaacaatctaaggtttttgaggaggtgagggaaattctttgagcctttctttttaatagaaggtaattcttgaagcataaatatggatgaaagaggtaagaggctgaaaataattagattatttaggattctaggctataatagtggaaataaagaattgacaggatctagtgattgattggatgggcattgctgaaaggaaaggtgagaaaaatgacttagattttcactaattatggaccaattgttttagaatgaaatagtagggatttttttggtcttcagaacttatgtggaagattttagcataaaattttgggagcaaagtttcataatgcaaagtagtaattaatggtagggatttatttagtttactagaattaagtttgaatttaaaatattttataattcttagggaaaggtttattttgagttaaattttattgtatacggttaatttttaattatattataaatatctccttatatacaattttttctcattataatctcttatctttgtttatagttataaatatttttaatttccctatgctttctttagtctttagaattctttggtaatgaacttagagctaaaagttaattttgtgccattgaatggtacagcacttgtagcatgacctagggtgagagtcattttttctcaaatatattttaacgttgcttttgtagtatgagttttcattcaaattattttctctttttgagagaggttggaagagcttctgagcaagtggatggtaggagtcgggaataagaaatatcagaacaattagggaaaccctccaatgccaaagatttatctgtaaaacatcgtatattagtagccatttgaaaagttaaaacacttttaacaagaacttatttacagtagtttgaagtagattatttagaacaaacaagttgaatacatggaaaagaaatatttctcccaattagttattttcactttgacataatcttttgaggaagcaatgcttttcttaaactgtgttctaacctgaaataaatgacagaatgtttgaatcaatgacagcatcctgacaggataggggaatatttttgatactgtgttccagttctcatttcagtttcttacatgaactatttgttactcctgttatagaaaatgacactgataatgactgacatttattgaatcaccccttgtgcttataactaaactgtgaggtaaatattatcttattattcttcacaacaatctcataagacagatattattttcatttgaccaatgaggaatctaaggctaaatgagattaaataacttccacaaagtcacgcatctggttatgcagagttcatatgagtcattgatgtaattggtagaaatgattgccaagtctattgtgtgtactgttaagggcaatgaaaagagcctttcacgtttatcctgtaaacagaggaaggtgagctttttggaacagtagtggagaagggccagagagggagagccagtgttctttttagattgctatgaatgagtgaacttaatcagaaaaggccgatgccccagtgcagcattgtctttcaaaactttaggtgctgcttttgaccctctttaaacatggatatccaaggcagcttaagagttggattatgcgttgctgtgaccaactgaggggccaagagcaatggcagctgtatggcaggttcttatgactcttaattctatttggagcacttcctgtgggcaaactcttacctgacacagctattcgagatccttagaacccatgagacctgatgccatgcaatgagtattccgtcagttacatcactgagacctcaaagtctgtgatcttaaccagcatgctacttggtataacaagcatatttattattcattgtatctacatcagttacagaaaagcccaatacctattcttccatacagttttaaactctggggtgatatagagcttcaactcggaggaaaaaataatcaattatataatatggtctcttatgaatgggaaaccctcaaaactgtataaccaattagaaattattcaaatttcttttactcgcaagaatgtttaaatgtgggtgaattgcagagataaaagaaataaaccctgatatttctcaagttctgccataaagaagtctagtttattgccttagtttcaaaagaatagttttctaagtatttcaaaatgtccggctggctgccccttccattctctttggaagcttctttgtcatcctcgtggcacatccctctggcatgcatgaccagctgcaagctaaaccctgtggaataagaattctttcatccctttgtgtgatgtgtttcattttcagagtttggatgatcctcttcggcagcagcagcaggcattgttagtttcaataggctgcctggatgcacaagaacagtcatcatagagagacaggctctcagggtccgtcccttcatgtcatggtgctgtgttagatcactttcctctgctggattaatggtcagagaaaaagggaaacaaactgtacccaaaggaatccaattaaagcacttgaacttcactgacgtctatcctattgttttcttaacttcctaacctatggttaattattctgaccagtggaaagaaacagcataaacatgggaattatcttaaattccctactttgtttagtttgtaaaggcatcaaaattttactgtgcaggatggaatactaatttggtatagttgaaattttttttggctaatctttctatttcttctttactctcctcaccaaaggcactgccaggacttaccgtacaacactccttggcttctggaattttatctctgctcacagtctacattacaacattagttcattctgggcactttagcttccttgaatctccagttgatctcacacccatgcctatgatattcttctcctggttaatcaagaattctctatttctgctccgtcatccatgccactgtaagtaggaaagtaatttaggcttttgaatcacagccttgtcatttgtgaaatgacttcccttgactctgaaattctctgtccaaaatataagctaggatttccagtaataacaatttatatgtataagatgattgatagtttgcagagtgtctttatatattttattttatataattctgactacagttttgtgaggagagaaccattattattatcttttttttttcagaaaaggatactatagctcagtgaggtgaattgatttactccatcacataagtagtaactgcccgaacctgaactttaaattcagttttccccaccaagaggtgatggttttctctagtagggagaaagtttctttcttaaaaccttaatttctttattaattttaaaagttttttttattttttatgtgagtatatatgtttatgctttgggtaggagtcttcttatgctgaattgagtttggggtggaattttgtgctcttagtttttgtcagtgaagaagtctcctacaatttctaattaaagaaagataagaaggaatgtattacttttctagtgtagaattttggtatcattgtgaacctccctgctaaatttgtttgtatttttccatggtaaatccattcttccagaaagctaatatacctattaaatagtattgtttataattaggaaatggtaggtatacagtagactccctcttaggttattcctgcttctggccaacagaatactctgaaaaaatggtgtgtttctgttcatctgtttacctgctgccatgcttatctacagtcatttgtgtttgtttttgaatttgtttatgccaaatgaatgtgcaattgtaatttaattatgcaaactgataaaatatgagttcaaaaatataaagagttgttgattttatgaaatttaagttggtgctttggaaagactttttaaaggtgagttgctaaaacaaattgcagtttaaaaaggtgtgggctagacaactgtgaaagattgcctgaggtaggggtgaaaaaatgtaaaaagctggaaggatccctcattcagtttgctttccaagtacctttaagctgtcattgagtttaaataaaccaaaacaggaaatcataggtgatacatcatggtgtagtttaagcaagaaggaaaacatgaaactttatatagcagatcaagagtcagtgacagccattggtcctacatcaaagggttagtaaataatttcatgttttaactttaaataagttaaatatgttaaaatcaatttattcagtttctttctgtatctcaatgtccttttgtgtaaaatgaaaatgaaaataactttacccaagaatatttttttttttttgtatatgaggattaaatgagatgtatagtacatagagcaatgcttggtacaagtaacatactaaaaaaagttagccatcatcattatcaatgacaatctgagatcatctgttgtagtgtttatgtatacttatattacaaatataatgttatggatcattgctgccagctattggaatattttagcagcaacacatactagttctgtttaggttagcagagacattctgtccattttctacctccaacctacctttttttctcaggatttatgagaagagcaagtttgatggtaactacctatgtcagtacgtgctgagacctgagatcacatgtgtgacataagtaaaagcgctatgtgtagtctcaactgaatcctatcagaaagcttgggatatggagagttcgtggcatattagtggaggtgtgtggaatgcttacacagtactcacccacactgaacctagatctagccaacgtgtttctgacttaaacgaacactcagcttcacacagttctctcccgattgaaaacagaggaaacaaaggaaaaagaaacaaaagtcgtgacaaaaaagactgttagctaagctagaatagttgtgtggtagtagaacactgattctaatagttggcattgtactgtatgccttccattcctaaatgcttctgctgactgctaggttgtaagttttcattaatgaatccacatttagaaactgctttttttggaggagaattaagcttttacctgctttctttctgaatgctggggcacatatttttgtgtaatttcatatcctgttttcctccctaagcatgtgctctttgtagaaaagagactcacacttcagagtaggagacagcatcaagactgctgaaagtttcctcttggtttgaatgttatagtggttgattcagtgctggaggcataagaatgaatgcactatcaaactgtcaacttttttttttttcaaacaagcaatgcaatactatctacagtgatttacatggcatttttctaattttttaaaaaataaagcaagtaggtagcaaagtggaatttgaaacattttcccaagttgaaaaaaatttaaatggtataatctaaagttaagtgcccagttgctttcttaaatattataagtatcactattggtcactttcggggcctataatggaaattaggtctatttgttcttcagattatagtctatctttacctgtcgtgaagcttttggataaaagaaatacaatcattctatatcgtgccttatcatggcattggaatttccacagttcattcctatctatgaatattattcaagtttcttctctactctttcttgtgcttttatttcagtcattacaaattctatcaatttcaactgtcctcagccttttgccctcagatgtgtattcttcatatattttctttattctgctgtgtgtcatcattttgttaacatgtatcctttttaacctatactgtttattctttagttggttgatttaaatttcacccgttttgtctctttaggtataccatttccatacagttattttacatgaagacaacagtaaaacataaaaagtaggcagcagcccagaaaatcgcagcctttatatactatacaatacatactatttatataatgggttaggtattcaggcttctatctagtagggatctacacatcatactcttctgttaaacctgatatttttaaggaggtaagatttaagaggatttccttctttatatgacatacctgtcagtcaacatgatattcagaacccattgttaagtacctttctaggcagagaaaagaaccagtttcagtttggatatgtttgaagtgctgtgttcttgactcatatgcctggattggcccagctccttgatattttacattttaagttgtggattaatgcatatctataactggtccaggatgtattgctaaacttgaggtgatgggttaatccaccactattgttttgctgcaacaataaaattgcggcaggctagcaagttagctttagtgcatattaatggcgagcatatcatggtacatgaagttgatacgatagaagaagtgtacaattcaagtgcatgtgcatgtgcaatgtttctgttctattttgcttagaagccagtttgaatatcattatagtggtataaaaggcagtaacttgatcagagttctaggtaagaaagtttttatttctctgtatcagagggatgtgctgtggaggacaatctgaagataagaataccaacaatagaatcatctttttttttttttttactgatttttcaaatagcatatgtctttctgttatgttgaaaattttcactgtgttatccattgaatgatttatatgcccaaataaagattagattgatgttccgtataaagatctgcagaaaaatgtgtgtatatatataaattttttaagaggcactcatgacatttgactaactcgatcaactataataataaatatcattgaattattggcctcatcaagtagtaggcaaataattgcttcccgggtttgtgggtgtgatattatttctaattttatttaatcatttactaattcactgtgcatctattatgttggggatagtatttggcatagtagggaatgtaaagatgattaagacacagtcctgtctactaaaagtgtgcagtctggtggtatggtatagtacatttcttagatttggcccttactataataatgtgttaattccttaattatttcacatgataagagtctaattattattgttatggtcatatttaatttacatcttcagtgttctgaataataatttaatgtactaccaacatatttaaacagactataatccctaaaagataaagataaaatattataaatataaatgtaaaatattatggtaaaagcactttaataattttaaatggttttaactggtttttaatcttttcactctcttttgttggattcctttatttgggagaagacaggggaagggacatttggcatttggtgttgaaaatccagtgtgaatagaaacccgagaggagacttttgattttctgatttctagttccataacatgcaaggtgaagagccacaggagatgaagatggagggataagtaggtgcctatcatgaagtgccttatatatgctatactaagaagtcagaaatgaggtgggatcctctgaagggttttaagtgaggaaatgacttcttagttctattgagaaaaagcacttcagcaattgagtgtggaagaaggggtatgaagaaagcagaccagagtctgtgagactgttagaagacaattaatggaaatcagggtgaagtatagtgagggcatgaactgaaacagtgactgtgaagctatgaggaacctaagaggaatggattcaagggatttttaggaagtagaattgataagatttgggtactgtatcggtgaaggggtggaagttggatgctgttaaagaaaaagagaagtttaggatgactctcaagatgtttttctcgagtacctgggtggtgccatttgcagaaaaaaaaaaggactattttaggagtaggaggttggtggccagccagaggtcaggaaggaattgagggtagaaacttaggaaagatataaaagattcatttgaatttcaaacacagatttaccttgctttgagaaaatatgatgtgattctgtaacctgaaagagtaaaagttaggataagtgtgttatgctgaagctgaataaggggaatgagtttcatgggagagtattgattagggaatttctactagtagaaaacaggatgtccagagtcaaatatttattcttggagacattttttcccagattttctttaatgacagctctcctccattttatatccaaaagctagattggcttattcaaatgtgttaaccctaggatgtgtctgggagtcttctgagtcactactttaaggggatatctatttgaggaggcactatggtaatgaaagcaagtcaaataccaaatgtatggattgctatttaaataaccttgcacaaaccacttaacctctttgggtttccattttctcacttttataaaataagagggttgaatcggatgatctctgataacctttttatagtaagagccctatgattttatgaccctgtgaatagcatgattatagctctaggattaacatcttcaggaaatttaacagcagacttccagttaaacttcgtgattgaacacatgtttttccatgttccttcctagtaagggactaaaaattttgagcaaaagactaaaaaatatataaatccacaggcataaggaagaggaagcaacatattaaagagacacaacttttggaagatgtaaaggaggaactggcagaaatgggaaagccgaatacatgtgactggagagtgttgtgtcaatgagaaacaagacagttcatactccagaacctgtttaagaattagaggcagtatgtcctgtagaaaacagtagctgaagtagaaataaagtataattaatatactcagagagatagcagaagatactgctactatgaaacatgacaagattatataaaaagaagaaataaccagagaataagcacttttataataactgaaataagcttttatatgatagaaattttcctgaaaatagagcaaaaaaaagtcaaataaatggaaaataggagagaagagataaaaatcaaacaaacgatccaacaagctgaacatctgattaatgggaagttcagaaggcaggcgagagcaaagaaaatgatagggaggaaactgttataaaagtatatggtaaaatttttcagccccaaaggttccagtttggaaggatcttctgagtgcccataaaaatgtgaaagcaattccacaccaagatgcataattggaaaatttcaaaataacagtaataaatagatgataatagaaagttcccgagagaaatataggcctcatacattggctcaagaaccagaatggtatctgatttcttaatgacaacattcaaagctagaagatgtggctttaaaattcagagagaaggccgggcacggtggctcacgcctgtaagtaatcccaacactttgggaggctgaggcaggtggatcacctgaggtcaggagctcgagaccagcctgaccaacatggtgaaacctcatctctaaaaaatttaaaactagctgggtgtgttggcacatgcctgtaatcctagctacttgggaggctgaggcaggagaatcacttgaacccgggaggcggaggttgcagtgagccaagattttgccattgcactccagcctgggaaacgagagcgaaattccgtctcaaaaaaaaaaaaaaaaaaaaaaaaagaattatgagagaaaattacttttaactttgaattctacacccaaactaccaattacgtataagggtagaaaaaacatttttatttttagacacatggttctccaaatgtacccccacacttgctttctccggaattgtttcaagggtatgctacgtccaagtgaggaaaaactgaggagaaaagaccaagatagagggttcaggaaacaggtgattaaaatgaggtgagaaaggtgaagggaagttactggataacttctgtgcattgatcttaaaaataagcagtctttacttgagctagaagatggagaactcccgaaagggatgtcttcaggggaaagaattagaataggattcttcatgtgtaagagtgtgaaatattatatttatagaggttttacatttctgttgcaaaccttgggaatgtggggggcaaagtgacaatattaacaataggaaggaaatattgttactactcaaggtaccaaatgtattcaaaaatattacttcactgattactggaaggatggaagaaagggaaatgaggtagtatcaaagaactaagtcttctgccatgataggaagttaatatattatgtctaaaatttataaataaaaataacaatagaagcatattatttagaaatcaggcaaacactagaatgagttttggcagagggtcaaagttttggatacgggatgctgtattttgtataaactttgtggtactatttaactggtaaactgtgtgtgtgtgtttgtgtgtgtgtgtgtgtgtgtgtgtgtgtgttgctttgacaataatgagaaatgataactaaaaattcttacagatttctaaatgctatgagctgaatgtttgtgtcacctcaaaattcatatattgaaaacctaatctttaatgtgatggcatttgtacatggggcctttggtaggtaattaggccatgaaggtggggccctcaagatgggaatagtgcccttatagaagcttgcttccactctgtctcttggccctccatcatgtgaggacgcagtgagaagactactatatgcaaaccaggacaaaggcattcatcaaaacctggtcatgctggcattctaatctcagacttctcagccctcagaactgtgagaaatacatttttgttgttaaattctgttgtttaaccaagtctatggcaatttattattattgcaccctgaactcagataccaagtattttggactttgattgttcaggtagtagattaactcatgatgaagtgtatatatttttgttatctgcaggaattagagttataccttgacattatatttgaaggggttttcgcatgctgtttgaatgataaaaacaatgatgaagaatctaaaagttgttgctacaattctgagaccttaaatatatgttacaaaatttaaaaaggcattaactattgatggctaaggagaaatagaaaaagacagataaactttcatttggtttggtaggtataatcataagacaaattaaacatagttgctttgttaaagaaagaatagtttcccttcattctaagtagtttttaaatacttaatatatttttccctcaaaaactttgcatggctagtgcatctattctcatggaatgtttttaactgtttgctgactcattagctattcatctgtagctaatatgaggcacttttgttgtggtttacaaaaatatggaggttatgtgatttggtgcatgcatttcagaatttagattgtcttttaataatcaaaaacatgctttgccaaaaatctagtatgagtgtgctcaaaatatcaagtgccttttgaatttttaaaataaaaacattccaacaataaaaacccaacagcaaacaaacaaaaaaccccagaacttgtcttgtaaacaaaagtgtttagcagatatccttaaacctccttgagagaatttttagacataagagaggcagaggcagagaccaagatagaaaggggggatatttctccttgaatttttcttttaaccaaggacatttggttttgggaggaaaagaaggagagaagaaatgaagaaagaacatgatttgtctcaaagatttattttataattgattgtagcttataaaggttttcattgatagtgtatgggagagagaattgtaagtttcaatgctgacactttgaagagttgccctgttattgcagctgcttaggcagccttgctcaaacatcaatggtgcattgtggcagtttgctctgcttccctgtttctgatggacgttctccaggcagtgaagggcaaaggggctggcaatgctggtaactggcataataggagttgttggatcagttttgagtgtatgtgtgtgaactgaacgtttaatgacaaattctgtgttatggttagtctaagctgagtatcagaatgtactttatgttcaattaatgtagattggattatatttttatattgtcattttatagcatagagtgcataatgtttagggtgcataatttgtagtggttggtaaaaaggaccaatgcttgctgcctgaacaaaaaaaattgaagatatactcagatataatcacactgaaatatttctgtcataaaataaataattgacttttactgttcataatattttattgtttttaaggatacccatattaaatagtttcagctgtttgtgaaaatgtgttctgattttttttggtctcttgtgtgtgtgtacaagaacactctaatttactcttgtaaaatcgtaaacttttagaagagatttgaaaagtcacctcagactgaatagatagaggcattacttgggagaatatgacataattttcagagatgacacagagaaggcagagatgatgaacaaatattttgcctatatttttctttccaagaagaataatcttcaaattagaagaaatgaatggaaatcaataaattggttaataggagactattttggcaaatttacaatctaagtccacagagtttggtaacttttattcaagaataataatgaccataatttttttaaaaacttgcatatttatataatgtgtgtttttcaaagtatcacaatgtatgtattcactgaatccttaagggaatcctgaaaagtaaacagggatgactatttgcattttgcaggtgaggaaaccaaaaggaagcaaataaaaagtttttagcagtaggcagtaggtcataccttttcacttattctcatttaataatcaccatgctccaagaaaattttattatctccatttatagatgtgttaactgaaagtaaatatatctttttcaagccacactgctgtctatcagaacaactggaatccaaacctaaggacttttgctccaaagtctaaactttctttgactgaacatcataacttccagaaatgatcatatttggagaatcggaagatataaaataatggatacaagcaaacatataaaatattaaagatgaaataaaggtgaattctctaacctacagagttaactttatctcctgcaaaattctgaaatattgaatagattatttgtgaccatgtagaaaccaaggtgttattttaccaagaacaagtcatgtcatactaatctcatttctccttttctgataaagttaactgggttgttagctaagaaaattttgcaaacatatgtatcttggtgtaaacaagggatttgataaaatgatggcagtagatttagggagattcataagttatttgaaaaacttcccccatatagtcatgtttaattttcttttctgaggcaagtatttgtgaatagcctactaaatacaaagcaatttactgtccactgtgggatatctttttgaaaaaagagagagtaaaacatggaagctcctttcaagaacttaattgcttagtatagaagctaagaagaaaaatataaatcacataaatgccctgtgatgagtatcttaagaaagaatcctctcagcatggatcccgggaaagccttcctgtagagatggcattttaactgaaatggaattacggatagggtttgcatataaagaaatagggaaaaggtttgcaagtgataacattagctcacattcattgactgtatattgtttcttttattcttcataatcattttgaggtagactatattattatttctacatggacatgataatatgaagtcaaagatgctttaagtataacttgctttataaactagttgggtcaggatttgaacttagacagtttaccatagatctcattctcttaaaaatagaatcaagaagatgggtgttaaaagaggttgtttgagtaatgatacaaagttaagcatggctaaaatataggtatgcccaaaggaagatagtaagtgaccttgtttgatcttgtcgtcttaaatagtattttatatatcagtggtttgggtgagaagataaggaattactatacaattttcaggttattcaaagatgaaacactgaataaattcaattcctgtattttatttcaaaatagtaacaacataaccagataccatataaaagacatggttcttgaaaataagccctgaaatttgtatgacataatagggagaggtatacacttaaaaataatatcttcttctgttgcatagaaaaaattttatgcttggatgtactttcctgatcataatgtacagaagggaaacctaaacagagcacagtgatcacactgagattaggagatagaaattgaaattcagggagatgaggcagtagaatttgcaggtagaataccggaggaagggagatatgcagacaaggaactttggaaatctgcaaaaggattgccttgagcctattgaatgctgaatattaaactgtgcatactttgggtaaacctccagaaggccggcaaagaacaaccagagagctgaaaaggtgaaccactcctggagctttcgcggattggaagtgtttgagttttgttcagccaaagtggagacactttgttaatagccagggaaatgagatcccaaaaaggataattctttttcagtagggcctaacaagcctgccctaatagagcttaagaataagactcaaaaggaccaaactgatctgcaagctattaaccagcctgccagaaaaatgtctaatactttgtgaagttcaacaaaattcagcagtcaacaacaaaaagtttatgatgaatgacatcaaaataaaatttatgttacatgaaaaagctggaaaatgtgacatgtaactgggaaaaaaattaccaatgaaaaaacgttcagaaatggcagagatgacggaattagaagaaaaatattttgtaaccattattataaatgtgatcaaggatttaaaggaaagcttgactatgatcaggagagaaatgagtggcataaaagggaactaaatggaacttttagagatgaaaaatatatttggaatgaaaaaatttactacattggtatggtataacaggatattagatactacagaaaaaggattagtgaatgtgaagacatagcaatagaaactatccaatctgaagcacacacacaatctgagaaaaaagattgaaacagacacacaaatataacctcagagatttatgggacactatgaagcagtttaacctgtatgttagtcctaaaaaggaggtggggaaggaaggaagaaaaattacttggacaatcaaaggctgaaatatatatatatggagtcttgctctgttgcccaggctggagtgcagtggcacatcgtggcttactgcaacctctgcctcctgggttcaagtgattctcctgcctcaacctcctgagtagctgggactacaagcaacccccaccttgcccggctaatttttgtatttctagtagagacagggttttgccatgttggccaggctggtctcaaactcctgacctcaagtgatctgcctgcctcagcctcccaaagtgctgtgattagaggcatgacccaccatgcctggccactgaaaatatttcaaatttgactaaaactgtatttacaaagatctagagatttcaactataagtaagaggagaaaaatgaaggaaatggcatcaagacacatgatactaaaattgttgaaaacaattgataacaagaaaatcccagaaagagacaggaaatggaggcattatgtacaggaggaagacacaaatattaaatacttcttgtcagaaacaatataaactagaagacttagaatttcattgatatgtttggctatgtccccacccaaatctcatcgggaattgtagttcccataatccccgtgttgtgggagggacccggtgggaggtaatttaatcacgggagtggttacctcatgctgttctcatgataatgagtgagttctcacaagatctgatggttttataaggggcttttcccccttttgctcagcacttcttgctgctgccatgtgaagaaggatgtgtttgcctcctcttccatcatgattgtaagtttcctgaggccaccccagctgtgctgaactgtgagtcaattaaattttttcttttataaattacccagtcttgagtatatctttattagcagcatgagaacggactaatatagacatctttaaaatgctgaaagataaaaagagtcaacctagaattctataaaataaagacttttggggacataaaagctgaaagagaaatcatcacccacagacaagcactacaagatgtgttaatggaggttcttcaggaagaaggaaaatgataccaaataagatggaaatttgtaataacacaaagtaaagaggagtaccagaaatggtaaatatatgagtaaatataacacacttttttcttttaaaattttatttaaaaggtaacactttgcagcaaaataattaacaatgtattgtgggttatatagtagtaagatgtttgacataaattacataaataattggagcagggaaatagaagtgtgttgttgaaatggtttgatattatatatgaagtggtatattattatttcaaggtagccttgataagttaaaagttacatattgtaaaccctacaataatcattacaaaataaagagatataacagtaaggccaaaatagagataaaatggaacattgaatactcaactatttcaaaaaaaggcagacaaagagaaaaaaaaataaagaacacatgggacagaaaagaaatacgaagttaaagttaatggatttaaactttcttatatcaataaatgcaatgacaaaaattgcaatcaataattgcaatgacagttgcaatagcagctcatccaccagaggtgttagagaagacagaaggataatgaaaaggggttaactgttttgactctataataattttgaaaattatgtttaagtaattagagtatgtagattatttttattctcaacagaatttatacaagcacatatattctggaatagatatgtgctacaacagaatgactccaactccttgaggctctcattagacacaaacctgttattgttaagtagctacatctcaatccatattttctggttaaataaagagagtacattattccttattctacttctttgctcttccttttctcatattaagcccaaacaccctataatgaaatatggataaccacttacataaatggtgtaccataaaattgagatggtaagatttgactattaaacaactaggtagctttatggtttattattttctggatataaacagaagatcctcctgatgctatccacataccctcacgcaatcattagtatagttcggtatttttaaaataacttttgaagagaagacactttttaaaatacaaaaatggcaacatataatacatattattctataagctaacttgttaaaatgcaaaaatatgaaagatgcttgtttttcaagtatttatgtgtatcagtgtccatgactctttgcaaatcatgtgtgacttttatgattatttctttaggataaaatcattgccaggttgcaggggcatgagggagcacatataaggttatgatacatattgccagaatactcttcaagaattctttacctctcacagggttgtgctagtttctctaccctctcatcgataataaacattttcagtctaagccaaggtaaaaagtgatacccatgactttttcattttgtatttcctttattttttgagcatctctttatatgtttactagtcatttgaactactgtgaaatttccattcacttacttgcatgtttttgttttattctgctgtaaaaaatgttttacacactcccatacatgcttatatgtatctctcattattttgtaagactgtattttaaagatactcactttttgacatatataaaatattttcacccttttggcatttgacttctaacttttatatggaattatttactctaaagatgttttcaatttttatgtagtcatatctctcaactttttgagggtctttaccttggattatgccaaggaacatttttctaccccaaagctatgaaaatattcttagtgttttcttataatacgtttattgtactgttctctataattaatttcaattatctgtatttattttagtgtatgaatttcacttgctcagctaatgaagtaaacatgagccagcaaaagattatgaaacatggcaaacttctgagattgataatgatagttataatattaatagaaaaataaaaaatgacattcattgagcttttactgtcttctagggacagtgttttttatattctttatctttacaacaatgcgatatgttagatatttatatctctattatctcattgtaacggtgaagaaacagattcagtagttaacctggatttctcatagtgggtgtttgctatctattgtcatataacaaattaccacagacttagcagcttaaaacaacaaacatttatctcactatttctgtgggtcaggaatttgggacctgctttactgggtgcttctagttcagagcctcttgtaggttgcagtgaagatattgaccaggtcagtggtcatctaaagaataatctgtttccaaaatggattaatcctatggttcttggtaggaagtctcagtttctgaccacaaagtcctgtctgtagggctgcttgagtgtccttatgacatgacagttggtttcttccaaggctagtggacagtgagagagagagagagagagagagagagagagagagagattaccaggagggagcaaaagattgtaagttggagggagcaaaagtttgtaagttaaaattactctatggctatatatattagtgataatagaaagaagtccaagaaactgggacctgcattgtgtacatggctttgtctcaaggaacccctggaatgtttgtctgttgtcaggaaagcatggactcctataaaagttttgatttctataagaactcagacctgaggttgaagaccttctacatggattagcaggagaattgaggcaagtcctaacacttcttataattaatttctgcattttcctgatgcctgtaagtcactataagagtaaaatattgagtgtgaaaagcataaagagctaagaaaaatcaaaattattgcattacttttatgaatacatgtagggatcttaataatccctctatgggccaacctgggagccattcctagttttttatttgttttgtgatttataataatcaaagtgtcaaatcagttgattttgtattatctaagtaattgttgcttgcatgataaaggttaaccttaaatattcctcctgtttggcaaataattaattatgcattattaattttcacttgaactatgtagtcttagcctagagagactcaaaatagaacatgctgtagtgttctaatggaatacttgacggggaaaagatttgagtttgggttctaatgctgctactgagtaagtgcaaaaatgtgagataattcatacaatctctctaagcctaagttcttcatttttaatattaagacgttggttgtgaaacttacaaacttgctatgattcaaatagttgagcttaaattaaaaaagtttaaagaataattaaactggatgactattggttatttcagcgctttcctggaaatacaaatgaaaaggaacaacctatgttgaaagttgaaatggtgccttttattgctccctgtaaacagatcatttgatatttttatcacaataagaagtattttttcacagctatttctctatagtttgtttcttcataagtttagtcataggctttctgtcttgggtatgtgaaaagcattgtatatttcaatgcctcacatgttaaaattcagaatatttaattttacaaagcagaaattgactaatgggggacaatggattatgattatgcttacagagtaaagaactaatttaaacaatttaatatgaaagcccaatttaataggaattacaatcattagtagtttatgggagagttttttgcaatataatgataaaccaaccacagactaaacccagtaaaaactttgtaacatgtccttataccgacacattctgttgttttcatcctttttcctctttatttttctggatattatcatcttacatctcctagaagtttcattcagaatttaagtatcagacaggtttatagggcattcggataatataagcagagaacaaattatttgcaggtttcaatatggaaattcttaaattatagaaagaatatgtattctaatgaaagttgggatgaaatacagtagaatctcatcaataaatgtgagttaatatacacatacttaatttacacaaatttaaccatatgcattcatttaaaaaagaaatttttatcaaattattgagcaagtactctcactattccacttaaataagctcttgctgattagtgaactcaccaccctgagtgagattggagttatggttggcttccatccctgtttacttctcaggatgtgagcatcttgccattctgagtgattctaatatttgatgacaccaaaaaatacatagctttgacctaaaaccaattcagttactttatatggttctgaactgaaataaaaacaaaacaaagcaaaacaaacaaacaagaaactgttccaacgatgaaggataagaaaagctctgttggatttatagggagaagatttatagtctccaatgtgttacatcttttaaagggatagatcaaatgctttaaagtcgttatttctcatttggattcacaggaaaacaacataggctttgttttgtacttctttatctgtggttaacaatatttagttcagggggaattactgttcttgaaaggggagctaaaatggctaaaccacaacagagagagttataggcagtgatgtcagcattcagattagcctttactgtggactttactgaagagtacaaaaaactgaatgaccagagagtttgattagctataaacgttttttgaaattaattaaaaattcaattaaagaatgaaaattattattactaaaaacaattcaaacatgaaaatttttacagtgctcattttgcagtgatgggattctgaataattttatcttctgaaatttctagctttttgcattttctgagtctcctataatagcatttacagtttatagtgaaaattagatatacctcaaacattataacaaaactctcagtaatttaaatttatgatttcttaaattagctcacttttgtgtctgtgtgtgtgtttgtaggataatcagtgataggaatgaaaacttgacaagcttcttcctgaacaagatatttgtcttttagttaaactttgcaggaggaaagatgacgaatttccatttattagtgcaatataattataatctcatctctttaactctgtatttctttagtatacaagatagtactgtggtctagtcactttttttttttccatgagaaagcgtctcactccattacctaggttggagtgcaccggtgcaattttggctcactgcaacctccaactacctggttctagcgattctcctgcctcagcctcccgagtagctgggattacaggcatgcaccaccatgcccagctaatttttgtatttttagtagagacagggtttcaccatgttgtccaggattgtctggatctcctgaccttgtgatctgcccgcctccacctcctaaagtgctgggattacaggcatgagccaccatgcctaaccacacttttatctttagaaagttttattatatcattaaattgtggctaaagtctcatcaattaggatttcactgatatggttgggctctgtgtccccacccaaatctcatgttgtattttaatccccaatgttgggggagggacttgatgggaggtgatcagatcatgggtgcaaatttcccgcttgctgttctcatgatagtgagtgagttctcaccgagatctggttggttaaaagtgtgtagcacttccctcttcattttctctctcctgctcctccatagtaagccatgcttgcttccccttcacctttaagttttctgaggccccccaggcatgcttcctgtacagcctgtggaactattaagtcaattaatcctcttttcttcataaactacccaatcagaggtagttctttagagcagtgtgaaactggatgaagacagaaaatataattctaaatttatgataattggaaaaagaacttgctgaaatttgtcttacaaaacacgggtttgtcaaacacaaagatcctatggccagcatttctagaatgatttctcgccaatttaggaaaacaaactattttgaaggtattactgtaacaacgttaattcctgtcccaacaatttactaatcaacagctcttactacctatgaatacctatgtattcatttaaaaaagaacctcttaatattaatcctggtccctattagctttaatttgctagtctctaaactcctacccatctatcatatcagcttaaacatcactttctcagtgaaatcttcttaagcatgtcaattttttttcctcagatgctatcatggaatctcatttttctctccaaaatctatttatagttatataataattttatgattattgattaatgtctggttcccacaaggcattagtaatatgaaaacggaattgtgtctgcttttttcttctcattgtcaccataggaactaacatactacccaaaatatagtaggactttaatagtcatttaattattacctaaatgtctgaatgaattattgaatgaatgtacctagcaaaaaaatttagccaagataccttaagctttaagttttagtattataaaatttccgttaaatcattaataatttaaataacagcgttttggaatttctgagtataggaattgaagcttatacctgaaattgaagattgtgctaaaaaatgatagatcattattttaaaaacaatagtttgtaattttgtcctcctatgattttggattgactttgtttttctattgtttctaatagagttgtagagtacctttcatcttattaccatccttttattattacccttttctgtagggaaaactacacagtgatattttaaccatatgtccatatcagaggacatattgatcatagcctttaatcagaactgtcatctgcacataaaagtttcggtgaaaagttacctaagtttacatgccagttatgcctgtatgcgtgagatggtatgtgactgaatatttatggtagggattatagaaagtgaaataaaagttaataaatcattgagagattcagaggacccctaggaatgcatacattctttaaagtatcataatttataaaatgtattaaaattatttttatataaacaaacataaaggtgtttgataatataattctagttttgatttctaagatgaagagagcttaattcattcacttaatcatgtatttatcaaatgtcatacatgcccccaaataactctaagctaatgaattttatattttatcataaaaaaactcttttgaagggagctttagatatgagagacaaatatttacttataatttcatagcatatacataattataactaaagtcatataaaataatattttaatttactaatgttaattttcaatcctaactttatgaacgttttattcatattcgtcacatacatttataaaattcgtaccttttcaatgttttccgaaccacatcatttttggttttacctaagttattttagttataacatgttttaaattcatctttgatactgtcacttaaaatttcatcagaagacacaaataccatttccataacactaggggaatttttttcaacacttgttccttaagcatatatttacgatctgtactatgtaatgatataatcttttggctgttttatatgatgtttgaaaggcatatttaaatcagcagctaacatttgcaattgtgaaaaaaattccagaaataaaaactaaacttgtattacattttattttgcctctatttttaactattctagcagattgacctctaaagccatgacaaaccagtaccaactgaggtaattccttgctaataaatctttcctaaatactactttgttgtttataagaaagtaattggaagtgtggcccataatatgagagtctttcttctgagaaataacattgactaaacagtttgccttataccagttgaacatccataatctgaaaatctgaagtaaaatattccaaagtccaaaactttttgagcactgccatgatgccagaagtggaaaatttcacacctaacttcacttgagaggtgcacaaaattattataaaatattgtacaaaattaccttaaggctacgtatataaggtatatgtgaaacataaattttgtgtttagacttgggttctattgtaagaatatttcattatgtgtatgcaaatattctaaaatctgaaaaaatctgaaatacgaaacactttggacaaggaatacccaacttgtattctgaaatatactttatttagtcaatacttgttatttgtctagatgctagaaataaaaaagtaaccaccagatactccttttctttgagaatgtatggtatagtgggagagacaggctgggcactggacattttcaatatcttataataattgctgttgagtgataattcctctctctatataccagagaggtatagagtcacaagaaggggcacttaacccaagtcagggaagacttcctacaggacatgatggctaagagagcactgaaaaggtgagtaggaattagccagttacaagtattaagggttttataagaagagaaacagcttattaaaaagtttagcattaaaaaaaaagtatatgacccgttcatgggtttgcatatagttcacatagttcagtatgaatggagtaagtttggaggttcaagtatgtgtacctgtgaaaggtgaggttgtagaagtaagctaatatgtgcatggattggtataaatccttttttttagatagaagtctttaataaatactcttttatatatcatccaaaaattactgttttaagacaagtgctaaataaatgctcaatttaaatgtaaataacaatttaaaaatagtcacatctttgtaaacaaagggtaaatcattggtttcacttcctatttgtgtaagaaaagactaatggatgacttttgcaatagtccttaatacataaactttgtgagagtagcgattgtgaatttgattcattttgtgaagcttatggttgctttcaaatgtacatagtaataattacctcaacatttgttttaatttagtcaagattatttatcttacctgaaatgacagacatttctgttgagatattattatgattatcattatgatttatcagtataaattatataaacccaaggccctgactttgacataggatttaaactacattaaataggcagaccttgaaatggtctcaaaatgagttgttgtgggaacttttctatctgagtcaaaccaattcaggaatataaagctaactgaattgagatagaaatagtagatttgtgtgtatgtgaagatgtgatacaattaagaaaagatttaggatttaatttagaaaattttgctagctctttttttatttttattttttgagacagagtctcgctctgtcgcccaggctggagtgcagtggcgcgaactcagctcactgcaagctccgcctcccgggttcacgccattctcctgcctcagcctcccaagtagctgggaccacaggcgcccgccaccacgcccggccaattttttttttgtatttttagtagagactggggtttcaccgtgttagccaggatggtctcgatctcctgacctcgtgttctgcctgcctcagcctcccaaagtgctgggattacagacgtgagccaccgcgcccggccagaaaattttcttagctcttaataagtattagttttgtttattgcaaaatcatgaatatagcatctctgggactgaggaactgtcacaattccaggtcattgtgtggaatgcaggccttgtaaacaatttcgttatacataaagttaactttactatagtgaaagctgttcaccaccaattagatcctgaaactgatttgcttgtgtttatctcaaccaacaggcatttaacaggatacagtatataatatgtccgggttaatatgttttacataacttgcagattgtttacatttattaaattttgcattattcattgttacttttctgttgtatttccaattcacaaaaatacatcagtagtttaaaggagattcattaaaatataaaaatatgaaaattctaacaataatgtacaataatgattataagtataaatagtgaatagttttctggagcaataaaatgtacatttaataagtgctgggtaaagtgaacatggaggtgtgaggatttcgtacaatcagcttaagaagcacaaatagaaagcccactgacaaataccagcagtcctttttcttcctgattcctctggttccaagtatgttgtcttttctcaaactttgtcaaataatcaaaggaagctattgaaactttttgtttttgccattttactgttttctggtacaaaatagatgacttttattactaaaggtgaaaagatcaaaactacaaagacttcattcagaattgtactcctcatagcaaaaacagttacaagtaatgcgcaggattgcttcaaaactggtaaatcagcctcaaagatgatgacaaatatgttcagagagaaagcagaagaaagtattgataaaattcctttatcataccaaattgttggattctgcattatatcaacatattactgtactgtggaaaaacagataccatctaacgtatgtggtagcagataattaaattttaagttggaaggtctaaatcagctcttggcatttgttctgtgaatatgtgaagaaatgcttgatgacttttgtttttcttatcactaaaaacccatactctataatagatatttgtgtttgtttgtttgtttttaataattatttcctgagctgtgatgttgactgcgaaagtgtcattgtgacggtatggagaaccagacttgcccatagcaaggagagggaggtttttacatgaatggaaatgttgttttttaaagttatttcataacctacattttgcaactatgaatgaaaaaatgaaaaactatttcttcataatacttgtaaatcctataaaaactattcctataatttcaagtagtcttattaagtcatacatatcaattcttaagtagccttgacctattaatttaaggtcaacaagatttttagttgaggacaagatagcagaatttctttagaatattaattttggtacatatggctcaacgatcactgagaacatgacttttacccaacatttgatgtgtttactcattttgggggaaaggaattgatgccacattattaagcccatttaaaaataatttccaggtgcaaaacatgaagactttttttttctaacaactttataggactgagtgctgtcaaaagatggattaagaatccttttttctccatcttccgagttaaaaccttcaacgttttaggtttgtgtgtaatataatttttgacttagcatctgttacatattgaaggtagtcttcagtgagaaaccttttcgtaacctctgggttgatgcttattgcaaattatctagaactacctgacagagccatctcgaattcagtattaatcccagtgacctctaagtatgtcatgattttctgattcagtacaaatgaagatgttttaaaattatttttctggataaaaatttcacctgatctatggctcacacaatttatcattgagccagtaagagataccttgatgaaagattgtaaacaatggcattcttccaactaaaactggtggtccacatgcttgttgaaccctcatcaagtgatctagcagttgccaacagtttgagaacaatcttagaatcttaaaatatgaggagaaaaaagaagtagagaaaaagattaggatcagaattagaatttagggaaagaatatgtcagtagtataatgaaagaaataatctattctgaaaatattttctttactttttgaaagggagggctgaataatttatttatattctctttctctcttatttggtttttcctttcctattataaaagtcttccatgttagtgctgttctgaagaactttataacaccatgaatttgactggattgattgcattttagttgtttgccttttttttttctttaaggaggcttaaggtcagtgcagacaataacaataccagtaaacaaacttctaataaattaattgtagaaaggtgtagtttctttgtatttttaaatatatatgactttttatttgtttaattaaaatgaaatcagcatcttacttataaaaatgatgtatgcttattttaggaaattcggccactacgggaaaattatatagacaaaaaaattacctctgttttttaatgtttcatatatatgtaaaaatatgtatttatgtttatatgcagatataaataggaacatatactacatgttttttagtttattggcattagatatagagaaattgaataagaatgttcaatatgactaatttaatgaatgggattcacgagttattataggaaattgtatgttgggtcccacagaggcttttgtggtcctgtgtatggcatgaagatacttcattaaggctaacatctatcacaggaatgctaagtatgatttgctgctgtatttcctatgtctcatgggtatagcacattgctggctgcgattgatgtttaaagagtgttcttccttttccttattcataggcataccatttcctttctgtaacacctacaggttttaccagtgcagatcaacaggagctctaatagcaataccacctacaaatgagtacatactgtgagccagtcattgttctggattcttcttaagcattatttcatttaattctcacaatatccacatagtgtagttattctgcccattttggggatgaggcaaatgaagttcagattgaaagtagcttgtgttctcgataactttgttaaacagtcttaacaaaatgctacctcaggtatgttttaaacttggcactgccaaatatgatttaattggtgtaaggcagggctctggcattggtatgttttaaaaggttcccaagcaattcttctggtagccaccattggaaatcactgatatagataataaccaatttcattttttgcaaaattttaataagtagtcattaaagtttacaaaccaacatcatctggtttagctgtcttttatttcttcactgtcatttattttgcctttcaaattagccaggtaataagactgaaccacattaggctttgccttctcattggaggtctgaagcttggaaaaaagtatgcctgatacctataaataaaatgaatgtatctgtaaatcaaaatcagctctatggatttagttttgttttgttttgtttttctcgctgcaaaataaaagagggtgaacctacgctggttggcttgcagtaagaatactaacatttagtcttacgtgatttgaaacttcctggagagtgtagtaggccattcttgtattgctataaagaaatacctgaagcaagttaatttataaagaaaagaggtttaattggctcatagttctgcaggctgtacaggaagcatggtgctggaatctgcttggtttctggggaggcctaaggaatcttacagtaatggcagaaggcaaaggaggagcaggtacttcacatggcaaaagcaggagcaaggaggtgaggaggtgccacatgcatttaagcaaccagatctcatgtgaacttagagtgagagctcacttattaccaaggagatggtgccaagccattcattaggtatcaacccccatgatccaaacacctcccaccaggccctcctccaacaccggagaccacatttcatcatgagatttggaggggacacatattaaaaccataatagacaataaattctgaaaataagggcttatgagtgcaaggaatagtggggaaatattagtgacaaagaaaatgtggagtaaaactttatatctcaaaattctactcctatatgttagatgatctctttttttctggtttcaactacttttatttattttattattttattttattttattttattttattttattttattttattttattttatttctttttgagaccagagtcttgctgagtgttgcccaggctggagtgtagtggtacaatctcggctcagtgcaacctctgcctcctggtttcaagcgagtctcttgcctcagcctcccgagtagctgggattacaggcggctgccaccacacctggctaattttttttttttttttagtttttagtagagatggggtttcaccatgttggccaggctggtttcaaactcctgacctcaagtgatccgcccaccttggcctcccagagtgctgggattacaggtgtgagccaccatgcctggccttcaactactttttaaacaaattattaaagaagttctaaactcttagaatgtattttcagtgttaaaacatgaaataggctcattaattctgatatagaaattttatagttcaatatttaaagcattatcaacatgacattttatgggtagaagcaatattttcagagctaaggctaggaaaaggacatgcatttctagaaagatgcaaccgaaaactggaaaggccagaaattatagagatagaagttaatgaaaatttttactaatgacatcttcagttaactattttctccctttgtattaataaggccccaaatcttagatttaatttaggatctcaacacttatgatcaaagatattagtcccctttcttctttgcatacaaaaaatggggtatgatcataaagcatggaaaagatgtagcttattggtgaagatctcatggacaattttcaaatttggaagaagtaagtaagtttagatttatctttcttggtttaattgtgtcttacctaacaaattagctctcactgtaaaataaaattttagtttttaatccaaaaagggaaacctgaaatgcattttgtatgagtgtgggtatatatgctgaatttgaccagtttgtaaatcagtaagtgggtggtaattcaaagtcaaacgaaaactattcagttggtgaaaagggtggggtaagagaatatttaattgttttggaatgtactcaataaaaatatttctttttttaactctaggaaaatacactggatactttgtttctaaactcactgttgcacaaataaataaagatgttttaaaatgagctctattctttttcaagacctaaatggaagtttcctctgcgtttgagcagacttcagctactaatttgcagatgaactgatgtgttggaaagattttacgtatggaccttaacatgttttaccttttataaaaaagtgaaaataatgttttaaaattggcatttttcttccctgatggcatagagtatattgtgatagggttttaagtagttggaacactaaattgagctttgaaagagaatgctcctatcagctcctcttttttcagttcctctgtacatctcaaattcctgtattgctctgttggtgacttttgctttctttcttgtttcataatgctaaaatggcatggtctcagtctggtttagtttgtcttggtggagagtatcaacaacaacaaaaacgatgacagctcttgagggattggattcttagctggggatggagtggcaagagaggaaggcagaaataaaagttacctcctatctgttagaataaactctttaaaaaaggaaaactttattctcataattcaggcaggctcattatagccgctttccctcaggaaatagacagaggtagaccttccacactactaaataaacaattctactgttgagtattcaaacttttgcgtctaattttaaaggcatgatgacatggggcagagatggcttctccatagggaatttatagttatttggaatcttttacatcttaagttacaaactatttttgtgtttcttactaatcatcttgttaacatattatcaaccaaacattaaaaatatatagagcttctccaatgtaaattccttggtataactaaatattggtcataattttctttgacatgtaaattcttccaaaataattgtcagaaaccatgggcttaatgaatatacaatccaatttacagtatttgctctctgtttatcacagaatggcattagaatcatttggttctatcatttccttgtcttaatcttgtcctagttcccaattgtttttcagttgtgaaacatgacaaagtgaaccaaagactggatttgtaataaaaaaactagagttttggttttggtactattatttattaactgtaccatataaactgggaaaaacatttacatgagcctcagtttcgttccttgtaaaatgtgaattgtaatgtttgtccatgtggtaatggtggtaattgaagaagaggacagatggtgaatataacatgactttatgaagtttaggtgttttacacatatatgtattattatttaaagacgaatggcaacttctgcaagagaaatttaagattccattgaactcaaagttgtatttttaattttatccaaatatttttataatcctcaactgccttttccatcatgcaccaacatgggctttacctcttttaaaaaatgcgtgttccccttacagtagtctattacttcatgccaatcagtctaaatagtgcatattcatttaatgggatttttgaataaaggaattatttaagtcaaaaatacaggctcagaaatagtaactgatattatgaagaattgggcactctatgccgccatctagtgcccattaatttacccttgctggtgccagtaactcgaggattccactccccctgaaatgtttcaaggcaaaaactagtatttatagaaatgagtttctcacacatgatgcacatatattgtctaaaatgcaaatgtaaccatgttacctttctacttgaaaacatttctttgtgcccaagattaaacccaaacaccttagcatggcttatattgaccccaaatatttagtcatgatctactttgtcagtcttattttcactctttccatactttatacctcacatttcagctttaccaaatttcttgcctttttcactaaccacaccatgtactttcatgcctctgagtacataatgcttcttctgcctgaaatatcattccattcccttgctatctagttaaatcctattaatcttttaaagcccagctcaaatatcacctcctcagtgaagtcttccttgattcttctggaaagttaaatgccattccagtgtgctcccagagcacaggcttctagaataagatcttaaactttgaaaatgattatttttgggtgtctacttaccctgacatattataagcataggctttgtcttattctttctttttgtatgccactttgcagtctttggcacataccaggctctgaataaatgtctgttgaatgaatgacagtgattcaatcagtcagtgagtcattcagcattatataaagccataccacttgaaataaaaaaaattatatatgtaactttgttattatttttaattgacaaatgaaattgtatatatttatggtgagcaaaggatgttttaacatatatatactcagtgtgaaataataaatcaagctacttaacatatctatcatctcacatacttatcatttgtgtgtatgtatatgtgtgtgtatggtgataacatttaaaatctatcctcagcaattttcaggtgtgtagtgcattatttgttaccaactatgtgttttcatgctgtaaaatagatggccataatttatatctcctaactgaaattttgtaccctttgaccaacatgtccccattctccccactacgcaagccccaacctttggttaccactattcaaaaaataacttttgaaaagcaatgtccagtgcataaacttcttcttaaattgggaaaatgaacaactttttaatactttgctaataaaaatcagacacttgtaggttgataactgcagattccaggccacactgtaaaaacatccaccactcagcattattaaatattttaattctgagctttgagaagactaatagaatcatattgtaaaactgctttaaacacctccagtctctgcttgaaatatgttcactaatatttcaagcaacacgtcatctgtgagcaattctgatgttaagaggttcttatttactttgagttgaaacctgtatctagtattctcaacccatcattttattaatagtatatgccttgggaacatacagagtaatctcatttgaagttttcaaacatttgaaacgttttctatcccgattgttttcctaatcgcatagtcaacatgtaatacccttgattctttctaccattccaaatatgttatgattctagtctttcacccttcctcttcccccttcttaggatattattgtgcttctgggtcatgtatcacagtattgatcatgccatctgaccattgctgatgagagtgggaatgtcatctccctcattctagatactgttattctgtcaggtcagtttaagatttaattggaatttttcagtacccatatcacatggttgactcatatttgaccttactggagatgctatctcctcttatccaaggatacagtaacaggtcattgagatattatctagttatgatgtcagagaagaaggcaataatctccagtaaagggagagaatgcaaaaaataataataaaaaggtaaaaaattgcataactttgatataatgcaatggctaaaaggtgaaaatattattttaaaatgttaaacctttagacgttaccactttcatattgcagatgtgtgaagcaaatgttgatagtagtatatagtttttagaattaaaatattaaaattttaataattttaacatttcctttgaatataatgacgttaatagtttaccaacaacagatttttaaaaattgatgatttctataatgttggatgcattgtttacatttagggataaacttgtttaggcaaaatttagctgcagttttataataaaaattcaaggaaaatgtattcaggaaacttcactgggatgagtttagtcagttcaacaagtattctatgttattttcattgcttatttttttgagtatttactgcataagagtatgaagtatgtttatcaatgtactaattgtatttacatctatttatttgtgatatttatgctttctagttagattgcaaacctgtatggccaagtcagttttcaccttgttttgtatgtgcttgtatagagttctatgatgttattatacatacatacaaagggacaagctttgtcattgaaaattgttaattgggtttatgagtatcttcaaaatgaagggtgtgtagtacttgccttgttcctaacaaatggattttggattaatcagtgtgtactggttaacccaccttagagctaacgtagattttccctgtaggtctttgaccctgtgacatttatcatcatgaataggcttgagattggaagtttaacccggaaaagctgttatttctttaaaaacctgtgactataactttttaatgtgtgacaatgtaggaggtggcatcacccatgtgaaacttcattgtttgaatagctaagttttctattgtaaggataatggagttaattatttaatcatgttttagacctcatttgtggtatttggaaattaaaatattattctatgtactaaaaccacaaagaataaatgttttctagcatatttatttatttaaaaataaggcaagatttaaaggaatagcaacttacaggtacagttatgtgttttctgatttttgtgctcatcttcacctatcaattactgcttaaaccacattcctccccctagattaattcttccaatgtatttatacttctccttatagactactaacttgttcacagctcctgttgtgctttggaacattttagcttcagattcttgcaagaggatttttattttaaatcaccaactatgtcccagttttgaaagtccaaattacctagttaaaaattctttacttggggcccaccatggtggccacgcctgtaatcccagcactttgggaggtcgaggctggcggatcatttgaggtcaggagtttgagaccagcctggccaacgttttgaaaccctgcctctactaaaaatccaaaaattgagctgggcatggtgtgcaagcctgtaatcccagctgctcaggaggctgaggcaggagaattgcttgaacctgggagacggaggttgcagtgagctgagattgcaccactgcactctagcttgggtgacggagtgagactctgtttccacctcctcactccgccccccccaaaaatttctttactttggattcagatagatgtgggtttaacaccttactgtgcttgttactttggtcagttttcttaatctcatgatctttgtttctgaaataggtggaccttatcagattgttaagcaaaacgattgatagttaatgaagaatgctgaagattatcctcactattagtaaaagcttaataaacagtaatgatcataaatatattattatttaatcagatttctctgttgtccatttgaatcagcaaatcattctcctgaaccttaaagactgtcctgaatgtagctccagtttcattgtaagcttcctctgtgatgaaactaaattatattttagaatgctctctgctaatgctagggggaatgttcttggtttacttcgtggacattcatcgtaagttctgtatgggttcctatggatatatatatttttcagtctcagggccaaattagaaaaaaggttaatgctatctcttcaagcccagtgattaccatgaagagttccctatctatgtatttttggggtggggcaggtcacatttaaaaaatcacaaagtggccgggcgctgcggtgcacacctgtaatcccagcactttgggaggccgaggcaggcagatcatgaggtcaagagatcgagaccatcctggccaacatggtgaaacgccgtctctactaaaaatacaaaagttagctgggcgtgatggcacgcacctgtagtcccagctactcgggaggctgaggcaggagaatcgctcgaacctgggaggcggaggttgcagtgagccgagatcgcaccactgcactccagcctggtgacagagcaagactgtagtcccagctagtcgggaggctgatgcaggagaatcacttgaacccgggaagcggaggttacagtgagccgagatcgcgacactacacttcagcctggcgacagagcgagactccgtctcggaaaaaaaaaagaaagaaaaaaaaatcacaaagcttttctttcatttttttttcaacttttttattgtagtaaaatacacataacataaaatacaccaccttattcaattttaactgtacagtttggtggcattaagtacattcatattattgtgaacccattaccaccaagtatctccagaattattttcatcttgcaaacttaaagcctatacacataaaagaacaactcctcatttttccttcccaccagcaacctggcaaccaccgttgtactttctgtctttatgatttaatttccctaagtacttcatataaattggatcatacaatatttgtctttttgtgtttggctttatttcatttagcatagtgtcctcaaagttcactgatgttgtagcatatgtcacaatttccttactttttaagactgaataatattccattgtgtatatatatcacaatttgtgtatccatttatccatccaatagacacttgaattgcttccatattttagtaattgtgaatatgggtgttgtgaatatggctgctatgaacatattaacaaatatctcttcaagaccctgctgtcagttcttttgaatatatacccagaggtggaattgctctgtcatatggtagttctattttttaactttttgagaaactgccatgctgtttttcacatttctatcaaaggtgtaaaatggttccaacttctccatatcctcactaaaacttgttttgtgtgtgtgtgtgtgtgtgtgtgtgtttgatagtagcaattctaattggtgtgagattccatttcattgtagctttgatttacatttcccaaatgattagtcatgttgaacatcttttcatgtgcttgtttgccatctgtatatctttcttggaaatatgtctattcaagttctttgcacagttttgattcagatttttgttgttgtgtttttaggagttctctgtatattttggatgttaaccccttatccaatatgagacttgcaaacatgttcccttattcagtggtttggctttttactctgttgatggtgacttttgaggtgcatttaatttttaatttttatgaagctcaatttgtcttttttgttgtcattgcctatggcctgttgtcatactcaaataattgccaaatccagtatgatgaagcttttgcctcatgctttcttccaagagttttatagttttagatcttatatttaaagcttatatttagaatctattttgaattaattttatatatggtgttaggtaaggattgaagtttattcttttgcatgtggatacccacttttcccaatcactatttattgaaaagactgtctgttccccattgaataattttagcacccttttcaaggatcatttaaccacactggtgagggtttatttctggactctattttatttcttagtttgtctttacgccagtaccgtgctgttttgattactgtagctttgtagtacgttttgaaaccaggaagtttgagtgctttggttttattcttcatttttagttttgttttggctgtttgggggttctctgatacttcgtgtgaattttgggatgagtttttctatttctgtgaaaacataatttggatttttatagggaatacattatatcttactttgggcagaactgatatcttgacaatgttaagccttccaattcgtgaacacaattcttttcatttatgtcttctttaatttctttcagaaaagttttatagattttattggtaaaaattttatttctttggttaatttctaaatagtattattctttgtgatactactgtatatggaattgttttcttagttttctttttagattgttcagtgttagtgtgtagcaatgtgactgatttttgcgtgatgattttttttatcctgctgctttgttgtatttatttattagttctaacagggtttttttttggtggaaattgtggaatatgttttttacatatgagatcatatgatatgtgaacagagataattttacttatttctttctgatttgggtgcctttcatttctttttttcctaattaactgctctgactaggactttcagtattatgtggaatagtacttgccttgttgctgatctcagaggaagagctttcagtattttacccttgagtattattttagctgtgagtttttaatacatggattttattatgttagggttttttacttttattcttagtttttgaggatttttattataaaaggatgtcagattttgtcaagtagtttttctgcattaatcaagattattgttttttccctttattttgttaatgtggtgtattatgttgatgggtttacatctgttaaaaatccttgcatttcaacgacaaatcctacttggtcatagggtaaaatccttttaatatgctactgaatttggtttgctataatttgttaaggattttcaatccttgtcaatgctcataagagatattggtctgttgtttttatttattgtgtttttgtctggttttggcatcagggtaatacaggcctcatgtaatcaatcagggagtgtttccttctctgatttttttggaaaagtttgagagggattcttttttattgctgaatagtacttcattatgtatatatgccacatcttctttatctattcatctgttgatggacacttccaaatcttagctattgtaaacagtgctgcaacaaatataagagtgcagatacctctttgatatactgatttcctttcttttgggtatatacatacccagcagtgggattgctggatcatgtggtagctcaattttttgttttttgaggaaactttagttgatattattctttttaaaaataattggtagaactcaccagtgaagtcatcaggtccaggacttttctttattgggagatttttgaatattgattcaatctccttacaagttatataggtctattcagattttctattcctttgtggtttagttatggtaggttttgtttttctaggaatttctacatttcaactaggttatccaattcgttggcctagcaattgctcatcgtactcttttataatcatttttatttctgtagaatagtagtagtgtttcctctctcacttctgatttttgtaatttgagtcttctctttttttcttagtatatatatccaaaggtttgtcaatcttattaatatttttgaagaaccaacttttggttttattggttttatcttatttttctattctgtattttacatctgctctaatacgtatttctttccttctgctagctgtgggtttagtttgtttttttttttttttttttagttccttaggttgtaaagttaggttctgatttgaggtcttttttgttgtttaatgtaagcatttataattataaactttccccttagcactccttttgctgtgtttcttaagttttgatttgggataatactttttcattcatctctgggtgttttctaatttctcttgtgatttcttttttgatcctttgtttaagagtatgttgcctaactgttttcattttgttactgatttctaactttatccctttgtggtcagaaaggatactttgtatgatatttgtctatttaaatctatggagacttaatttgtggcctaatatgtggtctatcctggacactggtaattgccttacatacacttgagaagattgcgtattctgtttttgttgggtggagtgttcccagtatgtctgttttattgttattgtttcttgtattactaagtaacaaatgagttttacaattttctgtacctcacaaacccccatttctcttcccagaaaatatctataatattttattcaatttgttcttgtagtgactgtgtaatgtaacttttcctgtttcttctccttccttgtgtctcctgcagccacacacttctctttcctcattactcaggtttaaaaacataggtttcttaaaagatcaataaagtggttacttcattatatataatcatatcactccctaacacaatataatttattgtgtgcttactgtcaaagccattttataaagaaagcgcaatctggaccatattacataaaatacgtgctgttatgttgcctttcatttcatgccaaaaattctagaaaaaaaaatatttttaaaggattaggaccaccagataaatctaagaagtcatggtccttaccactggctaatttagctcatttaaacaatttgaattttcccacttcccttgaaagcccaaaggaagacaattttgtcatgatagtatgacactaacttatcttttgatgagggtattaagagcaagcagtctgatgtactcagggttgaatagcatgccccaatttttgttgactagtgacctctaaaacttattacatttaagcccacttaatatcaagtcacctaatggaagcacatttttttccaccaaatcattttgtactaattcagtacaattttacccatttaatatcaattgacactaaatgatttcctgtgcaatgtcaattgaaaatcactgatttccttctaatacagcacttagtgtcaatttctgtgtgtagcaaaagcattttttcaattaactacaccatataattttttgtttttagttgtttgcatggactgtctgataatagttttatgaaacaaagacataagaaggagaaaaagatgactttcctttttggcattaagtaatttaaatctcatgattttattttcagtctataggaggtcaaatagctccttggaaaactttgaattatatcaagcaatgtggtggtaaattgacattagcagtaaatagaattctgtaatttggcacgttgcatatactaagctatatatagaaaatgttttgactaataaaaaacatcataagttcctcctctcatgatttagttcaagaagatgtactgttgaataatgattaatgaaaattattctttcctttgttagagggatgagctcacttaaatatccttatgcactcttactagaaaagtggtttaacattacctccactaattcatgaaaactgggaaagctgtgtggactagcacagctaggagcagcacagccgaagctgttcttttgattagataatatcgggtttactcagcaaacgcaaatattttcttaataatctatacatctcttcatcattctggatgatgatgggtaatgaggaaattggagtagatcctgattttcttagaaaattatgaagggatgtatgtaaataaaaacagaaaattacttaaagctgtatagaaaatttgtgcatattgaatttttattaaagtactagggtacttagccaaacactttgtaggatatctgcctagataaggcatgacctcttcacataacagagattaacgtctaatgagagaaaagactcataaatgagaaatcatttaaaaacaataaactttaagtgataaattgtgggacacggtttgtatatggtacatatgtttagatttttaggaatatcaatatatacctagaatactctagggtgactcattgagctgtaccctgaaggaagcttctggtttaacgtgaaaatgaggacagaatcatctctcatgacgttaagtcttttttttctttcagacttcttatacagtttgatgcctcttgtgttgtttgtctccctattgatgttagcttcattttggaataatcttaattagaagacattttagcaataattcaaaccaatattttcgaatgtgtactaattgacagatataatactaggaaatgagcatgcagaaagaggtaaaatattaccctttctcttaaggaactttaatcataggggtggagtaatacatgtaaacagataatattaaatagcattaatttgatggtgtacaacaatgtactatgggcaaacaaaggaagggcacatattccagcctgataattcaaagaagacttcttgttgtctaaagggatgtcagaaatgatgcttgaaagatgaataggagatgtatagacagggaaggaaggaggatctcttcagtcaaaggggactatatgtataaaagcatggaaattataaacatggtatatgtgggaaaccattatacccaaatgtaagtgtattttacaaagttcctataataatgtatgtactgttttataacaatttctccgtttaacactatgtgctagttgtttttcccaggtccttaattatttttcataggacattgttttcagctgctatatgatactctgtcatatgttgcaaatagttttttctaaatttattgtttgccttttagtttcatttgtttttgctatactgacctttcatttttatgtgttcaaatattctatttttaaaaaccatattacattttttatggcttctgcctttgcttttatgcttaggaagaccttctccaacccaagataagattaaaaattcttctgtatttgcttctatttcttttatggttttattgtttacatataactcttcaaaccatctggaattttattttgatatacagtgtgagataggctctaaatttactctgttctaaatatttaaccagttgtctcagcaccatcaattgaaaaaaaatctatgtttttcccactgatttaaaatgcattatttatcatatgctaaatacttaatttacaaataggcttgtttcttgtctttctatttgatttccagcctattttttctcttcagttctatcagtttctatatggtttactaggactacactatttattgtggcttttacaatacagtttaaacctgctaataaaagtttctttttagtatttttcattttaaaaggttactggctattcttaaccaattttttataagagatttagaattatttaatcaaggtctctctaccactgcccccccccttcaattttattggacttctgagagtggttgcattaaatttatgaactgttttagggagaattgacatagaggtttctcatctggaagatgtcttaatttattcaaaattttttaacattacttagaaaaacattttttccatataagtctgacatttttcttgtagtgttagtttctatgtagtttttattttttatcattggtaataagagattgttctttcctttgcatttttaaatggctgtttttggtgtgtgtgtgtgtgtatgtgtgtgtgtatagtaaacaagcaggttactgatttataagttctaattatttcttaatttttttattctactcctttctcatgtttatagttcatgttaggtggtattgctggagcttccaaattataataataagtgctagcaagagtttgtttttctcttggcttcactgggaataccactaatgttttcaccattaggtgtagtgtcaaccattttataggtagatattcttcattacattaaagagtttcatcatagtttattaagagttttaaaattaagaattgtggttgatttttattgcatgcattttcagcactatcaaaattattgtttttaaaatcatacttatataaatttatcatatatattagtagatattctaatggaaaactttcaactttcttggtcatcacaaattatttttaatatattgttatatttaactcgctgagaagttttgtatccttataagcaaaattatctatattaatactaataggaatacaatgtgagccatatatgcaatttaaaattttcttgtgactacatttttaaaaagtaaaaagaaacagatgaagttaattttaataatgtattttatttaaaacaatatagccaagatattaccattttaatatgtaatatgaaaatgttaatgagatattttagagttttttatagtaagttctataaatctgatgctttacacttgcatccagtcctaattcaatggagtgaagtaacagtgctcagtagcctcctttgctgtactgttttaggcttttgctagcttcagaaaatgaatttggaaatattttgtttttgttactatgttatgggtttattttgatccttgaaaacttaatgaaattcaattttctattaaaactggggtttaaggagatattggtcaaatgatatgacatttcaattaggtggaataagtttaagagatctgttgtacaacatgatgactatagttaataatacatgtattcttgaaaaataatgaatggatgtttactcagaaataactgtgaggtaatacatgtgttaattagctaaatttagttgttctacaaggtatgtatacttaaaaacatgttatacatggaaaatacatagaattttatctatcaatttttgaaaaaggaaattaaatagaatttgctcttgaaccacctgtttctggaacctttcttaattaatttttaaatttattggcctgttaaaattttccatttatagagtcaattttgaaaatgtatattttcttagaagattatgtcctgagattttcaattttattagtatatatctgtaacagtattttgacatattttaatgctttctgaatatttgtagtacatttcttattctttattttgtatatttatgcattgtcttccatatgacttgattaacaaaattgggtaattatttacagaatattttgtgaagtaagaatactttacttttattaatgcagaatccaaaggactgcatgacacaccataggatatagtcaagaagcctttggacatgggagtttcaagctcaaaggagaattcatacctgaagagaaatttggaagccatcaatacattggtagttgataagctcatgaaaagagattgccaaaggaaaatgtgttgaataggaagagacagaatatccatcagagtgcctgattcagtagcattgatttcttttctttacttgccttgtcaataacacaatatttttagtataaatttaaatggaaaaatttcccttaatgaaagaacaaagactttaagcttgtgtcagaaaggtaaaagctattcacattgtttattttactttagtcaataatttccaatcttgaagattattttgtagaaatattcagagacgtatgcaaagatttatctgcaagcatgtttatcagaaccatttatagtagcaaaaatttttgacagtacctaaatgtctaaatgtaggaatgaataaatgaattatatttcattcttactataggatattatgcagtcattaaaatactattttaacactttttttagaaaaggtaatgctatataaaatttaatattaagcaaaaatactgagattcaaaacttctgatgacaagtttattttatataactatattacacctgggaagaaatgcctgtggttgacaacaggtgattttttttttatattgttactgttgctttttattctattttcctcccgcaatgtttttcatataaaattactttgaattgttttttgtttatttaatcaatatacacaggtgatgaaaggagggagaattgttggtaaaaagaggcacagagtcaaggtaatgttagaatacaaatgatttacatgttttgaaaaataaagagccagcagagaagacattgaagtcaagcagagaaaaatgataattgtatagaaaagtcccagagacttcaaggattaccacatttagtacttaggtaaaggggttggtctcaagtagaaggctaatgatagtgggttggtagatacgtaagtgaaactatgacatgctttgagtccgtctgattgtcacaataactctataatgtaggtcttactgttttacagaccaataaattgagttttaaagatgttaggtgaagaacaattaaattctagaaaactttggtgagatggggtccagcatttgtacagttgaagcaaataaggtatttatatgttatagatgaaatgatttcaaactgccaggagttatttggtacagattgtcagtaagcacagtacagtgaacatgcatgaatttgcagaaagtagatgaggggaaattgccagaaataatcctagtcaaaatggaccttacctaacttacttcagttttctctatttcttgttttgacccccaaattgaacatcggttatttgtaagcctgtaaaaatactcatttctgggtcttcagtgtctctcattaaatgttgttagatgtgtagacatatacctgacttcacatttgcatcattgtgtttttctattaatccaagctttaatccatccaatcagccacctaaattatgctaaggcagttactttgtgttaggcattattttagtactgtattttagtatatttagtatttttaaatattttatatatttagtattttagtatattttatatatttctcttatatttagaaatataagagaaactcctttatttatgcagactgcctaattgtgatattgtagcaactaaaatttcatgtagtaggaaaattgagaaatatttatgcaaatgattcacatatgtgttaagcctggaagcaagaaagtggagtttttcttatttaaacccttcattttacaggggaggaatcccaggtccacagatactaatttttttcctaaagacattatattaaataaggctttcctcaatttgtataatttttattttgtgatcccatgaatcattttttcttgatatatgtaaatatttcttattatattttattacttttattgtgggaatcatacttttccaactagaaaaccattccttgctatttcatgtgaatcttcataataatatcaaagaatatacctaaaggaatataaatcattctattataaagacacatgcatgtgtatgttcattgcagcactattcacaatagcaaagtcatggattcaacctaaatgcccatcaatgatagactggttaaagaaaatgtagtacatatacaccatggaatactaggcagccataaaaagaatgcgatcgtgttcttctcagggacatggatggatagggctgtaagccgttagccttagcgaactaacaaaggaacaaaaaaccaaataccatatgttctcatttataagtgggagctaaatgatgagaacacatgaacacatagaggggaacaacacacactgggcccatcagaggatggaaggtgggaggagggaaaggatcaggaaaaataactaatggatacttggcttaatacctggttgatgaaataatctgtacaacagacccccatgacacaaatttacctatgtaacaaacatgtacttgtacccctgaacttaaaataaaagttaaagaaagaataaggcaaattttataattttaaatcgatatataatttctattttagtaacagtagttactagcggtaactactactactaacaacaattaaattcaattgtattttcttagtgaatatgtagctgctatgttgtttaaataataatagtgttagggcatctaaaaggaagttttatgttgtacggtcaacccctctctgttgtgattgaagtgtatgaggaaagttttacttttctaatggcctactgtacagttcttgaaattcccatcactagcaaccagttcttttcaaatggactgacttgttaaaatgcaagagggatgtgaggtatatgctttactcttttaatatccagtgtgagttaatttgtgggattgttttcccaaagcacctatccaaaaggggtgccttaagggaaaatgggattcaataacaggtaagttttaatgaggaggataaaaaggtgggttgcaagtatggggaaaatccaaggaataacgtagaggtctctgagtaccagatgtataatgaggatagtagcctgttcttcgtcccattatgggccttatcaatttatattgcagttatgtttctccctctccacctaggttgtaagctcttccgtgtcaaagaaggcctaatacatctatcaatagcacttaccatagttcctggaaaatagttaggattcagtaaatatttattggctaaataaaggaaaaactggaatctaggagttcaagattattacaaggaagaaaaagggagggtctaaagaaaacagtcagtcctatttttggccttgaccaactttgctttctgccaacagtagtcctctcatttagtcttgcaagaagaggtaagctacaaaaactttccatatgctatacattagaccatgtagtatagttatgaaatgagatatagatatcaaatataaatgatcagtctcaaaaattatacagtaaaatacatttaactttgaagtactagtcatttaatacttgactcaaaaagagataaagagatataagttggaatcattgaaatcttaaatgaacttttatgattgaactagttatgcttggaagtactggttaataatattctgattgtaaagaacattttctttattttagcatcattttttcctctgagtacaccagtagtgtagtgtaagaatcaaaaaggagagaaagaaaagggagaaaagtgggggaggagaatataaaatttggacagattacaaggaattaagtgaagggaaggaacaatttaaaaaaggaaaaaagtacaaagagtaaggatttgttgaaaactccatagtgtaagagtttattcaagtttggatttgtcaaagagaagtatagcatatttcaattccttatggcaatcaagacggaaagatgactacgagaggggatagcagagacagggaaaggtgagaaacagatgtagaagaaaagaaggtgatgcagaactgaaaaagacacagacatgagagctgagaaagaacacatggggcacaggcatagaaagatggaatgaaaaacaaaacaaaaaaagagagtttatgggattcaacagaattgaatctaggcatattgtgtagtgccagcaaagttgaaacaagcacagttttactgtgtaagctatgaatagaaagtaaactgtccattttttaaaaaaagatagaaaccctattctacattgaacaacttacttcctcttcctagttctttcttccatttctacctgttaaggtttcaatctctgtccttctaggcacaatttaactgtcatgcttcagttaaaatgaattcttccctctctatttatatagtgcattctaactccaagagaacacttaaatctgtctcacagtagagtcattgaaggttatctccttacctcactatttgttcatgagtcagggctggtctcattgtttcttcatcttcatattttgtctcagcatctcgcacagtgttttgcataatataggtgctcaataaatactgcactgaatggaaaatacatatcagatatccaaaagttaaacatccaaatatccttgtcatagtgaaggtaatatatttattccaatgattctatcactatcaaagttacttacctcttttgaaactgcctttagaaactgcacaaaaccacccaagataaatggcttttatcatttccataatattttttaaatgattgcccatttggtgactgaaaacagatagttacagccttagaaagattagtttgaagggagtagaggaggcaaaggacaacaaattggagtagattgtagagttggaggtgaagaaatgaagataagggatttctataactatacaggccaggttttgctatggcaataaacttggctctgtcaggtaaacatggctctaagttactcttgactatttctaaaaagcaacgaaaattaaagagcagttgtcagtgaaaatattcaaaatgatatgttgttggcactgaaggtcaacattgttcgcacattgtgcaatatttagagcaatagctatactgtttaaagaactgtctcccaaggcaactactttgcaaagaataatactcattttggttgcataaattttcattatgtaatagacagttccttttgtttaaaagtatgttttagaatatcaacttgagtctttttatatatgttattaaataactaaattttgtaaataaattatacttttaaaatttttataaataatactttttccatgtggtaaaccatcattccttaatttatcttttttacgtatcctaaattttcaaaatttaggaatttaaaaatggagattgtctgaactattatgtgaatagattcaaatcttttgaacaaatgtctcaactttttcttcaaaactgttaataaagtgtcttaaaggccaaaatgttgctagtattcagaataatttttcaaaatgaagtgattcctaaaattattatgctatggagtaaattaaatatttatcctacctggaatagccactttcaaaatgtctccattcaaatttttttaaattttatttatttttaactaagaagagcattctcagtggaaatgtataaaatattttaacataatatttagtttgacaaatatacaaacatttccattgttacactacacatattttaagtaatgatgacttattttgagtgtgggagagagtagattgtttgaattataaaagtagaatttcttggtagcagaagaaaaaggatcctttttacagaactcagtttatatagcataacacatgcaaatatgttcatttgagaaaatattcatgtttgaacagtgactcaagtttgcattcattatataaaaatttttaaataaaacctttacaatgtaggacatcattgaaaagaacagcttcattacacataaatatttaacagtatttctaatgttgcgtatgtgtagtttttttacaaactttcttaactttacgtgtatatgtgtacacacagatactatatatatgtatctatggaaatatacatactaccccagtctttacagtaagcttgttatagaaagacaatgcgttttcagtaagtaagcttgcttttgtttttgctgctgaacttcatatgtttaggcctgatttcagtgaaaaatcaagctgactaaatccaaaattcaaacataaagttctttgtattcatgcaagctattattcaggaaaagaacaattaagactttaacttagaaaacactctaaattaaaaatggcattccaaaaatatgaggaaagactcaagtaatacataaaattagactagatgaaacttgtccattaatgtaaattaaaagttaaagaagtaactaaaggataaaaaacctacagtccatggctgtatcctgccttttactccatctaacagcctgtaaaaatttaaattaactcacagatctaaccagtaggacattcgatcgtacaaagttataccatagcaataatgttctgcctcatagtggtattaaaagaaatttctgtttaatagaagggaagtctttcatttataataaagctattcaatgtagagtcaatccaacaaaaatgtttcaataaatgtttaaaagacttacaatgtaagcataaatggaagagaataggtattatatgtgtgtgtgtatagagtatatgtacaatatgtttatttaaagtagagatgaataaacatgaagaagcaaactagatttacatatgaggcaggggagagactataatgagtacagtacaataaagtctctagattttatcttttatcatcctcaaaaaagacaattaaatgttttaaaaaggaaaagaaagaaaatgtttcttccttgaactgctttaagattcctttacttgaagttaaaaactgtagctgccataactagttgggccattagtttatctaaacctgtctagacctgactgtagtgtttcccattatatgcctctgaattaattatcatttgcaaagatctgaaacctttgtcactgaagctactttcatgggatttaacaaaacattttgaactgttgtgaaaatactgaggctaaactgttggttggctgctattggtattacgtttggtaatttataggtgtagcataaccatgctcacacatatatcaattttaaaatataatttgtctttttgaataagcaataaaacactaaagcctgtattacataagagcctgggtacttctggtggctcaagacatttgggtttcagctttttgcttgaaaatacatttgaggaagtgcaactaatcctacgcagagttgtgctgcccaggaatgtcttgttcttccactcttagaggaaagagcaaatacttcatttccaatcatgctgtctgcttcttgcatacacagttcaaaaatccttttctgttagctggactgttctgcatttatctcctgaatttttgttgttcttatttttgtggaagcattttatttcttctctaattatttctaacttttctctgcatttgtcttccctagtttgctcagtttttccttttactacctcttcggagttctctgtccaaccaagattttctttgcagttttatgtaaccacattggctcttattttggttttggatgtctgtaacttaggaagagacttctctttattgtcattaatgttcctcagacatcttccacctgcattcagtatatatccagactttatttcacattctttcaaattctctttccaccctcagtccattaattttgtaatataacttttatatgaaacaaatgttcctaggtacagcaaagactaaaagaacgaataaagtacttagatgtccgctaatttttcatgagtctaatgttaacattgagaccatttcagtatgtattaagtctgcaacttccttttttattgtatatacataatatttgctgcttgaagcactaaaacataggacatgcactaaattcttcagggagccctgcatcacatacttttgttcactaaatcccaggtaattataaacctcattttgtttaaaataccatgatttcacttggtataattcattcaatgcagttttctttttacctcaaaacaacccctgaatatgatcataaattatttgtcaacaaattatttaggttcaaaattaatccatctaaaattttttctctgtcaagatgaagggcagatttaaactgctatataaacagagaggggtaacaacaacattgggaaaaattagattttttcttttcttgtggcagcacttaaaatatttagtcagggtaggtaaagtataactgagcaaattgctgaatttcaaaccataaattgatgtcgggtacaaaggacaaaaaaatcacacaatctggaggggagaaaagttaacactgtattaaaattgtcaagcaacttctaaagtagatgaactgccttcataatattctcagaacaaaatgttctccaagagcagatctgatatgaagagccaaaaaaatgaaaaacattcactaccaatttactgcagtcacccataaactattacaagaacattatgtattagggttcaagccagcaagctattaaagcagactgccctggtgtcttttcattttactttaatgctaccgaagcattaataactcttcaaggaattgtagttatgttgaaattatcttatctcataatcaatttttcaaatattccaagtcttttaaggtgagctctgtttctttgtttcttgttggtcagtgttgttccactttcacaaatgcgatcatcattttttttgtctagtccaattcttactttcatcttgggaacatatcaatctaaatggtgctaattgccatagttaatgaatgccaagccatctagcacccttggccccattgccactttatgtgtctctgctcatgtggagatcaaagaacaaaagatggaaataatcatatttaaaaaattaagtagatgtcacatatacaccttttttggtttgttgttttttcaactttgggagaataaataatcctgctgaaattacttttcgttatagtctgtggttaattttatcttgttaaaaaattttctaactaaaccttttttttttatttaaaggatagcaatgatactatggcaaagcatgattaacccaatgatctaactctttaaacacactaatcactgtttttccttggtggcataaattccaggcaactgaggcatctttcagtcttctttactaatggaaaatattagcacatataaacttggtacaaaattagaagtcctggtaacttcatgcatacaaatcagcagtgattcaatgtgcaactttaagagattaaaaaaacaacaacaaaaatccttaggcataaacaggattaaatttggaagaagtcattgaaaagtaaatttcaagaaactgggtgtttcttgccagcacagaaataaccacaatttagtaacattatctgaaagtaaatattcatatatttgtgtgattatttagtatgtgcatatgtgttgtatatatgtatgtgtatttgtatttctacctcaattagactgtaagatccatgaggcatccttcatttcattaccattatatctccaattccagcacaatgtctgaaacacagcatttactcaacacatatttgataaagaaactatagtgatgatacaaatgaaattgtatataatttaactttttaaaatccttaatatgaaagaaattgtgagaaagcattaatgataacatacttcctcaataggtagttcaattcacatctctctgtgacagcattttttttgatctatctaaataaaaattgccatctttaaactattaatttatactataaatttttcttaaaaagatttaccaatgatagtttaatggaaatagcattgaatctataaattactttgggcactatggtcatttttgtgatatgaattctttctatccatgaacatggaatgtttttccttttgtttgtgtcctttctagttttccatgaggagtggtttgtagctgtccttgaagaggtccttcacttcccttgtcagctgtattcctaggtatctcattgtttttgtagcagttgtgaatgggagttcattcatgatttggctttctgcttgcctgttgttggtgtataggaacgctagcgacttttgcacattgattatgtatcctgagactgctgaagttgcttatcagcttaagaaggttttgggctgagatgatgtgcttttctagacataggatcctgttatctgcaaacaaagataatttaacttcctctctccctatttgaatatgtttatttctttctcttgcttgattgccctggccagaacttccaatactatgttgagtaggagtggtgagagagggcatccttgtcttgtgctggttttaaaggggaatgctcccagcttttgtccattctgtatgatattggctgtgggtttgtcatatatggctcttactattttgaggtatgttctttcaatacctagtttattgagagtttttaacgtgaagggatgttgaattttaaaattcatatggaacccaaaaagcacccaaaaagcaaagacaatcctaagcaaaaataacaaagctgcaggcatcatactactggacttcaaactacactacaaggctacagtaaccaaaacagcatggcactggtacaaaaacagacacatagacccatggaacagaatagagaactcagaaatgagaccacatgcctacaaccatctgatcttcgacaaacctgacaaaaacaagcaatggggaaaggattccctctaataaatggtactgggagaactggctagccatatgcagaaaattgaaactgaaccccttctttacaccttatacaaaaattaacccaagatggattaaggacttaaatgtaaaaccccaaactataaaaaccctagaagaaaatctgacaataccagtcaggatgtagccatggggaaggatttcatgacaaaaacgctaaaagcaattgcaacaaaagcaaaatgacaaatgggatctaattaaactaaagagcttctgctcagcaaaagaaactatcatcagagtgaacagacaacctacagaatgagagaaaatttttgcattctacccatctgacaaaggtctaatatccagagtctacaaggaacttaaacaaatttacaagaaaaaacaaacaatcccattaaaaagtgggcagagcacatgaacagacacttctcaaggaagacatttatgcagccaacaaacgtgaaaaaagctcaacatcaatgatcattagagaaatgcaaatcagaaccacagtgagataccatctcatgccagtcagaatggcaattattaaacagtccagaaacaacagatgctggtgaggttgcggagaaaaaggaatgcttttgcactgttggggggagtgtaaattagttcaaccattgtggaagacagtgtggagattcttcagagatctagaggcagaaataccatttgacccagcaatcccattactgggtatatacccaaaggaatataaatcattttattataaagatacatgcacgtttatgccaattgcagcagtattcacaataacagagacatggaatcaacccaaaagcccatcagtgataaactggataaagaaaatgtagtaaatatatatcatggaatactatgcagccataaaaagaaatgagatcatgtccttttcagggacatggatggagctggaagccattatcctcagcaaactgatagaggaacagagaaccaaacaacacatattctcacttataagtgggagctgaacaatgagaacacatggacacatggggagggggacaacacatactggggcctctcaggggtttgggttgggggaagtgagagcatcaggaagaatagttaatggatgctgggtttaatacctaggtgatgggttgatctgtgcagcaaaccaccatggcacacatttacccacgtaacaaacttgcacatcctgcacatgtaccctggaacttttgaaagttgaaaaaaatatttatcagtccaaaataactttatttatgtatcttataggaatgaaacaatatgtttctttatttgtgcacaaaacatattttatattgcttaattagctgatctagaatatgtttttttgtataactattatgtaattagtcacattccaatcaaacttacattaaaatgataagcaatgatttctacttgcatagcatatagggcatctgagacccaccacacagcaagtaagaccacaactattgctaaacttctcctcactccttccatgatttatttcctcataacagaactacaaatgtgatgtcattaaaacagtcaataaggttttcagcgaaatagcttttcttagccttttataaagtgacagccactttataagtttatgggtgaggcaatgcagtgaagagcttgttttgttgtcttttgtattgtcttgtctttctccttgacatgttgcttaagctagtgttttaatgagaaaagtactcaaatgaaaaacaaacaataaggaaacaaaaaacaaaaaagacaccgataatcatagatgctttgataaacagacactttgaaatttagagcaacccttctacgttaactagtataccctaagatccataagagcactttttggttcatcgctacatctcctagcagactaagagcctaggagattgtataattcacagaaaaaaactcaataaaaatatttatttattatttttatttttaatttttgtggatacttagtaggtatatatatttatggggtacatgaggtattttgatagaggcatgcaatgagtaataatcacataagagtaaatggagtatcgagtatccaccacttcaagcatttatcctttgtagtacaaacaatccaattgtacacttttagtttttttaaaatgtacaattaaattatttttgactatagccattccattgtgctagcaaatactaggtattatttaatctttctaactatttttaacccattaaccatccccacttctccccctaccccaaacaactatctttcccaacctctgatagccatccttctctttatctctatggttcaattattttaattttagcttccacaaataagttcaaacatatcaagtttgtctttctgtgcctagcttatttcacttaacctaataatttccagtttatcaatgttgttttaaatgacaggatctcattctgtttatggctgaatagtactgcattctgtttaaatactgcattttctttatccatctgttgatggatacttaggttgctattataaatatcactgcaataaacataggagtgcagatatatcttcaatatactcatttcctttctttttagtgtacacacacacacacacacacacacatatagggattgctggatcttatggtagatgtttttagttttttgaggaacttccaaactgttctccatagtggttgtactaatatacatttccaccaatagtgtacaagggttcccttttctccatgtccttgccagcatttgttactgtcttttggatcaaagccatttgatccgaaatgtgtctttgttgtgcctttttctgatttgaacattagggtaatactgtcaaatatagaatgagttagaatgtatttcctcctcctctgtttttcagagtatttgagtaggattgggtgttctttaaaggtttggtaaaattcagcagggaagccatcaggtagtgggcttttatttgctaagagacttcctattatggttttgatctcattacttgttattggtctgctcaggttttggatatgttcctggttcaattttagtagcttgcatgtgtctagcaatttatccatttcttccaaatttttctatttctttctatatagctatttatagcagccactaacgatcctttaaattctgcggtatcagttgtgatgtctccttttacatctctgattttacttatttgggtctaaaagtttgtcaattttgtttacctttttttaaaaaacaactttttgtttagcgatcttttgtattattttcttcattttctactcatttatctctaatctttattatttattttcttccactaattttgtgtttgatttgctcttgcttttgaagttctttaatatgcatcactgggttgtttatttgaagtttttctattttttcatgtaagtacttaaagctataaacttccctcttagtactgcttttgctgtatcccatagattttggcatgttgtgtttttactatcatttgttccaataaatctttaagtttccttcttaatttactcatttaccacttgtcattctggaacatattgtttaatttccatgtgtttgtatagtttccagaattcctcttggtattcatttctggctttattccattgtggtcagaaaaggtgcttgataatatttcaattttttgaatgtcttaagacttgttttgtgacccgacgtatggtctatccttgagtatgaactatgtgctgaggaaaagaatgtttattctgcagctgttggatgaaatgttctgtaaatatctattagatccatttggtctatagcacagattaaatctgaagtttctttatggattttctgtctggaagatctgtccaatgctgaaagtggggtgttaaagtctccaactattatagtattggggtctatctctatctttagctataaaaatgtttgctttgtaaatctggatactctagtgttgggtacctatattacaattgttatatccttgtgctcaatcaacccctttatcattatgtggtgaccttctttgtctcttcttatagttttcatccttggaatctattttgcctggtctaagtgtagcaactcctgctcttttttagtttccattggcatggaatatcttttcccatccttttattttcagtctgtatgtgtctttataggtattgtgtgttcttataggcaacagatcattggatcttttttgtttgtttgttcattcatccactttgtgtcttttgattggagagtttagttcatttacattcaatgtattcttgataagtaagaacttactcccgccattttgttttttgtttcctggttgttttgtggtcttctcttccttctttcctttcttcctcttttcttttcgtgaagatgattttctctggtgatatgattaatttcttgctttttactttttgtgtatccattgtatttttttaaagtttaagttaccacaaagcttgcatctactatcttataagcaattattttaaggtgacaacaacttaacactgtttgcatgaacaaacaaacaggcaaatagaaaactaagaaaaactctacacattaaccttgtccactagcttttaaactttttattatttgtacttgtatcttactgtactatgtctcaaaaagttgtatttattttttttatcggttcatcatttactctttgtacttaagagatagcagtttatacactgcagttacagtattaaaatgttctgtgttgttctgtgtatttactattaccagtgagttttgtactgttagatgatttttttattgctcattaacatccttttttatttgattgaagtactccctttagcatttcttgtagaacaggtctggtgttgatgaaatccctcagcttttgtttgtctgggaaagtcttcatttctccttcatgtttgaaggatattttcaccagatatgctattctagggtaaaagattttttccttcagtactttaaatattacctgccactctctgctggcctataaagtttccagtgaaaagtctgctgccagatgtgttggagatccattgtatgttatttgttacatttcttttggtgcttttaggatccttttttatccttgatctttgggagtttgattattaaatgccctgaggtagtcttctttgggttaaatctgcttggcattctataaccttctcgtacttggaatattgatatatttctctagggttgggaagttctctgttattattccttcggataaactttctacccctgtctctttctcttcctcctctttaaggccaataatcaggtttcctgtttgaagctattttttagatcctgtaggtgtgcttcattgttttttattcttttttcttttgtctcatctgattgtatattttcaaatagcctgtcttcaagctcactgattctttcttccgcttgatccattctgctgttaaaggactctgagacattctttagtaggccaattgtatgttaaagctccagaatttctgcctgcctctttttaattactttattctctttgttaaatttatctgataaaattctgaattccttctctgtgttatcttgaaattaattgagtttcctcaacacaggtattttgaattctctgtctgaaaggtcacacatatctctgcttctccagcattggtccctggtgccttatttagttcatacggggatgtcatgtcatttccctggatggtgttgatgcttatagatgtttgtccaggcattgaagagttatgtgtttattgtagtcttcaccttctgggtttatttgtagccgcccttcttggaaagatgttccagatatttgaaaagacctgaatgttgtgatctaagaaatatctactttaggggcatcccaagcctaataacactgtggttcttgctgatttatagaggtataagctttatggtcttggctaagatctgggagaattctcttgattaccaggcagagactcttgttctctttccttgttttctcccaagaatacagagtccttctttctctgctctaagctatgcaaagctcagagtgacccaagctcctttgcagggtggagtaacccaagctcccttgtggccatcaccactatgactgtgttgggtcagacctgaagccagcacagcagtgggtttcacctaaggcctgatgtaactgctccctggctactgcctatatttgctcaatgcctgagattctacaatcagtaagtggaaaagccagccaggcctgtgtacttctcttcaggacagcaaggacccccaggttccacatgggtccagaagtaccatctgtagcagtatttttacaaagtagtagaaaaccttccatactcccttaccagagaaaggtaaaggtcaatgctcattgttttgttttttgcttagtgggacaaaagtaggaaaggaaagacaaaactttgataattaaccaaagctaattaccttttcgaataagtcggcacttagtaaaatgtaaaacaaaagaaaaaatacataatactgtcttagtttattttgtgttgccataacagaataccacagactgggtaatgtataaagaaaaatttattgctcactgttctcgaggctgtgaagccctataaaagggtgttgggcatctagtgagggccttttttctgtatcccaacgtggtagaaggcatcacatggtgaaagagctcatcaaatggggagcaagaaagagccaaacttgcttttataacaaagctactgctgtgataacattaatccattcaagagtgtggagccctcatgacctaatcatctctcaaaagtcccacctttcaacactgttgcattggagattgagtttccaacacatgaactttgagggatacattcaaatcacagtaaatacctagtcatctcaggaagaggaagctggtgtagaggcacatgaacatgcacatatgtaacctctacttgccagctctggactaataatgtgatagaacgtaattattttactggatttattctcactgcctgaaaggggatgagaaagcattgttgggagaataggtatgtaggagaaactaagcacctgggcttattggctttgttaaagcaaaattttagtcctggaataaaagcttacaggataagtcaatctgaattcagatggggtggggagagtggcaaagagtttttactcacacaatttttaaccatatagattaagggctatatagtgattgtacattcaaatgagatgacataactgtaaaaataatacagaacaaaaatatatagcattaaaaaaatttgaagaatacattccagaagaaaacattatccaagaaacagaagaaaattcaagaacaagaaatataaataacccagtagataatgttcaaaggatctaaaaacataattcataaaaatatgtgtccaataacgtataaaaatattcaatcttacatacacacatactaagtttccttatcagattgacaaggttttacaaattagataatattcatggtttgtgagcatataggaaatatacaggattggtgggagcataaatagtgtaaattacttagaaagcagctgagaaagaactctcactttttaaaatgtaggtacattctactagcagaaatttgtattacagatatactttgtttaaatcttgctttctatgcttgtaatgacctgatttatctcctaccaagaaaaaatgtttgccattacatagatcagggacagggaggagtaagttacttctaataccaaggaaatacaaaacttacagaagtggatctagattttagtccacactttttcattaagttacttttatattagacatttatctttcctctctaggactgttttttcatatgtaaaattatgtttagaatttttagattattgaatgatccttctatctctcaaacattgttcacgattacttacaaaaagatgttctttatgttttagctgcttattatcaggagcatttttatggttatttttctaataccagttgaatattgatgatacatctcatctaatagaaacatattttctcctagccctgcctttaaccctcagcatacagattacagggcaactgtagggaaacaaaggaaagggcttgaactcaaggttcttccaaatccccttggtggatgacagtgccattaaaagagacgggaataacagaaaaatatcattttggagtgaagatttaaaaactgcagtttgatatgtcataagttgaagtatctatggggcattcagctaaagatattccatagtcagcagtatgtatacaactggagagatatagaagagctgtgataagggcaggagctacagacttgagagtcatcaaaataaaggtgatgtttgaagttgaagatgtgaatataatcactcaaggaaaaggatgatgtgagagcaagagactgttggaaagcagaagaagaacccatatatagggtcaagaagaagcagaagagcctgcaaaggaagagaaaagggcaggagaagagccaaaaagtatgaagccagtgagaggacagtgtttttgaaagaaaggagttgtcaagaatgtcaaaacatctgagatataaagtaaggtcaagtcaaaatatattcaattggatttgaccgtcttgtgatttgcgatcttggtgggaataattaaattatgttataagggcagaagtcagttttcagtggactgtaaacaggatgaggggtaaagaagtaaaaactctcttcaaagatttgactagaaataatagagaagaaagtggtaacagagcaaatcttcaaaaaaggattttctttcttttctattgtatgcttatttttatgtatatttgatgggagataatcatgcatgtttatatgctaagaagaaagaacttataaagaataaaaagttgagcatataagtgagaaaaagggataagtaatagaacacagagcgattgttaaataagtattcattgaacagcttattatgagtaaagtcctgaagaatgagtttgatgacatttaaaaaacacataaaacacattgtttaaaatattctctaatttctgttttttctctttctcttttttttatttcagaaaatggtatttcctccttattcaaaaggagtagacataattggcaaattaagtgataaaatatatagaggacaagtatttccagaagaagttgaagtcataaaggatatttcacttgattttatcaaaacatatttttttagacgactcaagaaaaagtaaaggaatctcagaattttacttaaaacatactgactataatgtaattacagtgtcttaatgaaagaacagactttgcacaatgagaagtagaaagaaatatagatagaactattttgcagaaaaataacaaatactcctattctcatcattaagtttactaacaatctgaaagactaaactcaaaagggattttctggtattgctacattaaatcagaaaagaagttacctcgagttttttttaataaaaagaaacagctaaatcaggttaaactaaaaagatttcaaatgaatatctaagggaacaaatagtgaaaagtcagtagacagcagaaacttggaatgtattagtaccaaaacgctaaacaaatattaggctattaaaacactaagaattagatgtgttgccttaaaaggtacttagttcctccagcctggtatgtctcagtggccacttgatgctgtagaagaggctcaggtgccaggtgcatgataggggtaggtgggctctaaggtgcccttcagctccattttgctacggttatatgattctttgagatactttgctaaaacataaaggcacaatatatttttgccaaggaggaagataatgttctgaccaagaaataatattcaggggaaaaaaaagaagtgccatgatttcacatatttcaagctttactaaggacaaatggttatatatatatatatatatatccaactggataaattttatgactatatttaattaatatgagcacattttagagtggagaaaacaaagacttcattcatccagcaaatatttattcagtacccgaagtgctagaaactatatgagggtagtaaataaaatagaatattcctgtcctactatggagggggaatggagagggagtggaggaatagatgataaacaaacaaacaaacaagcaaactagttcattgtacataaagaagttatttttttctgacagtaactaacaaaggtctgggcaagaatcagagggtgaccattttaagaggtggtgtttctgttgagactcaaatgataagaaggatccagtgatgcagaaatccagggcaaggaataggatgtttgaagcctccatagaagaaaagcattttatagtagatcagaaagcaataacaaaaaagaaaaaagaaaaaaaaaacatttggcaatgtctaggaacaaaaaggacattaacgtgggtagaatgctgtgagctaaaaagagagtagattgaaatgaagttaaagagaaatggagagacagacctcatagaattttgccctaaatgaaatgggaagccagggaagtatgacacagtcccataataaacctgcttctggtgcagaatggattggaattatcaaggcagttagtgaggaatccagttagaaggtgaatacagtggttcagtggtccaggatggaaatcacagtgacctcaactaagaaggcagcagtagaggtagagagaagttgatagatttgtcagttaagtcctgaatcaccttgattgttacctactctctctctttggttcttaattttgtcttctgtaaactgggattaattatattaatgcaaagagatgttcagaacatgatttgagacaagacatgagtacctgacataaggtaggatgcagtaaatctcagttctttacaaataacttattttaaaataatgtccattccaagttcaaaatagtaatagcaactaaacatctagtcagatataaactgtttggttttcaaacatgtgtataatttcctagataaaggaaaacatttaaatgttttcatgatatatttggggtcattaaaaatttatacagataaatttatacaaataaatacaaatacacatacaataaatacaaatacagataaaatgtatacagataaacccaatgaccaattaattacaacaaaaaaataaaatcaagaggtggaaatttttatttaattgaggttcagccacattctattaaaccttttctaaatgtattaatttaaaagtgaagaattgaaaacaaattttcagggtaagaatccctctcctttgaaatggggttgttggcttgaatacaatgactacccactttccctctgtctctgcttctccttcataaacaggcccacacacacacatacacacactcatacacacacataacttttagtaactctgtttaacatttggaaagaaatggctggcatgttgaagggggataagtaaataagttgcatgaactgtatataaatgaacttacttaaaattctttaaacagaaatttcagtaccatagagatccttgaaatgaagacagataaatctgaccaattatagccaaatatctcttgctaaaaatttagagaaactttctatgaaatgatttgtaaataaaaatcttaatccaaaattatattataaatatgtcttcctcagttaaagaaatattatgccctttaatatagagcaaaagaaaaaactggccaagtgttctgtgtgagaagaatacgctgaatattcatctatgaacaatgagaggaatggcacccaagaaagggaactgtggaaaaatgaaagaccctcttgttttttgtctttcctttatacatgtataaaactgaacaaagaaaagaggcacaaaccctagtgtgtgttctactgaagaaaaacttgtttctgagagttgtccagttttgctaagtccccaaatagctatcctctaaggaaaaaaaaatattttgttttaaaggcaaagactcttggttacagaatacttccatgtaatgtaatgttcagtcttgcatatacggagattataggcaaggcatctttttggtcattttagaccatagcagtgcaggttttataggtacctttctgtactcttttgaggacaaaatgtgcatgttttcaaggcaggaaaccttgaaagttgggggatagttttgggcagtagcacagagttaatttctttgcagaccaactagagattgaaaccacgagcagatctattgaaatcccaagttctcatgacagtataggcccaaattctgcagagatctcaagtgctagaataggtggtttgaaaagtatcagagctccctgccttcatcctgacagtagcattaattttaaaatgactatattcctagataaaaacacacattttaaaaattttataaataacctgaatccttttgttctgacaatataataatgaagacataatattaataaatacaaattaatgttttttggagtttttaaaaatccatattgatttccaaaacgtttgtttctactgctgaaaagagaaattcaaaccacctgattgttcacagtaagtaaaattcagctacatatttatctttgatttcactagacaggtaatattgaaaaaaatgaaacatgcctgtcacctgacacttgcaaacataatatttgttaaacttagtgtttttgttgttgttttgttttgttttgttttttagtaggggcgtgctcactatgtttcccaggctaaccttaaacttctgagctcaagcaattttcccacctcagcctcccaagttgctgggattataggctcatatcaccacactcagcttcttaaacttagttgttttatgtttcctgttttaaattttagaaataaatggatttaactaaaacaatagcctttaattattgtagcagttttaagtttacaaaaaacaaacaaacaaaaaacaaacaaaaaaaaaacctggggagaaagtagagttcctgtatgcccattcacccttctcctccccacttttccccattattaactatggtggtacatttgttacaactaatgaaccaatattgatgcattattataactatagtacattagggttcactgggtgtacatttaatggattttgacaaatgcatgatgttatgtgcccaccatcataatatcatacaaattactttcactgccatagaaatcctctgtactctacctgtttatccctccccatttccaaaccctggcatcttttttacggtatctatagttttgccatttccagaatgtcatatagttggaatcatacgggatatagctgtttagactggtttatttcatttagcagtatgcacttaaggtttccctgtatagtttcatgattaatagctcacttctctttagtgctgaataatcttccattgtatggatgtagaaatttgttcatgcattcacctacttaaagacatcgtcgttgcctccaatttttttgcaattataaattgggctgctataaacatttatgtgtaggattttgtggaacataattttcaatgaaataccaatgagtatgattgctagatcatatggtaagtgtatgtttaattttttaagaaagtgccaaatagcattttgcattcccaccagcaatgagtgagagtttgtatttctccacatccttgacggcaattgttgttgccagtattttgagttttagccgttccaatagatgtttagtgatatctcattgttttaatttgcaattctctaatggcatattatgttgatcattttctatgcaggtttttcatctgcatttctttggtgagatgtctgttcagatcttttgctcacattttaatcaagttgtttttcttcttgagttttaatagtttttggtgtattttggatgacggtcgaatatcagaaatgtgtttagcaaatattttcttctagtctgtgatttgtctttcacaaatatggaagttttaattttaataaactctaacgtcaattatttctttcataaatctggcttgtggtgttatatctaagaccttattgccaaacccaagatcaactagatgttctcctatttatcttctaaaagttttacagttttgcattgtacatttaggtctatgatttattttgagttaaattttgtgaatttaatgtcagtgtctagattttttttcatgtggatgttcagttattggactatttgttgaaaagacttttgctctattgtattgcctttacttctttgtcaaagaacagttgactgtacttatgtgggtcaatttctggcctctctcttctgttccattgatctaagttgtatgtttgcaaataccacagtaccttgactcatgtagctatatagtaagccttggggttgggtagtgtcagcattctgactctttcttcaatattgtgtttcctattctagatcttttgcctctccatataaactttagaatcagtttgtgaatatccacaaaataactttgtgggattttgattgggattatgttgaatctaaaaattaaattgggaagaagtaatattttgatagtattgagtcttactatccatgaacatggaatatctctcagtttatttagttcttttttgatacctttgatcagagttttgtagttttcttcataatagatcttatacatattttgttagattttatatgaagaatttatttaattttttggttttagtgtaggtgttgtgctttcaattttacatttcaatatttaattggtaatatattgagacacaaattttgtatacctttaatgcctgactctcaatttctctttaaaaaaaaaatccctaaacttgtgtatgtatattaaattgctctttgcttccacatggttcccaattcttcttttttaatatgtgatttaaaaaaagctccccattttaaatttataatactgctattggtcaacagctcatatttttatttgaagtttattctggaatgtgtattaaatgtggtgtggtgtgtttccaaccatcttataagtctaattcatgtattccattggatataaaagagtaatctgacttctttatcttgtaggaatagagtgctagaatttatcttttcaaacttattttttcctgtttttaaagtgcttattttaacaaacctggaaaacactgaagagtataataaaattgttcagaagcctacaatacaagtaatagtttgaaatataggctcctttttttaacttgtgagaaatttgtttttttttttttttgatttgtgggaaattcatcaggtttagaatatgccacttcagatataatttttttcctcgtaatggtcaagaatttagtacatatcagatgaaagattttgctagttcacctaaatgtagacataagcatgtccctgctagtattgatggtattctcttgttgcaagaagtttatagtgttttcctgtgccagagcttttgggactgaagtcataggacttgttatatattctcagaattctctgctgacctagtagtgggggccacatttttctttaaaaatatataatgaggttttttgtttgtttgcttttggagaccagtttatccagatatatagcatttggaacctggtaaattacttttggcagcacatcactgagtaacactgagttaaatgtttatgagtcgcacataaggtaaagtagctgttttcaaagtgttaagttctctttggtcttgtccacaacatggatactgagaggtcctgataggccaatgtttcttttgaatatagccaacctatggagagaaaaatctgttaagtgtttctaggggttgggcaatgtgaaagggtattggtaagttatggtgaactggactcaaaatattactggaaaagaaaacagtccacaaaactaacaggaaactgttactttaaatcctttattttaaaattataatattccccttaaagacttctagcggtggggtgggagaatacaaaatatttaattttataaaagaaatagtctgctaatttacaaataatttaaaaatgaattagtcaatatttaaaatattaaataatgtgctgtaatcaacatttaaaatcatctacattcagatctgttatcctaaaattatcagtaatataatatgccttagaagaaaaaccagaagaatttgcctcttataagcactttagagcaactatttgataacagtgccttcaaagttaaatattagatggtattgccagatggatctcatatggtaaatagcactctacgagatggcattttattttgctattttttttttaaatgaaagtccaacactaaatagtctaggtcattaaatgaattcagagttatgccttaaacaaatataacattgcaacataaattgacaaaggccaatgaattcaaagttgatgctgactttttccattttatttaaattatgcaatagcttcagttatcattgagaattgttttattatttctattgttgttgctaacataccttttgaccaaaatatctccaaatatttggctgcatattgtatattatagaggcagttaaaaaacaatgatagctgaaacgcttggagaggtggtagtataaagaaaacttaaatgtagcttgaaactcttttttctttatgggaaagagaacacttcattcaactatatttttcctgacataacaaatatatagcactgttttcaagctagttaccacagttcttgggccaagaaaatagagatgtttcattttagaaaaaatattggtatcgaatataaatatttgaggaaattccttctaagaataaagaacttttcgagggaaaaacagtaagtaaaaaaaaagtaggtttaaagaaagaaaagctgataagtttgcattaagttttatatagcacaaattatatgtaatgagtacatgatatttgaagtttttacatgtgccctcaatttgtgcaagttccttccttcctctcttccatctttctgtccttccattctttctgttttgccctgaaaatttccctccccctttcatttccctccccctttcctttcctttcatttccctcctcctttcctttccttcctgctttcatttccctccccctttcctttcctttcatttccctcctcctttcctttccttcctcctttcctttccctctccctttccctttctctctccctctccctttcccccttcctcttccccttcccttccctttccttcctcctttcatttccctgctcctctcctctcctctgctctcctctcctctcctttcccctccttttccctcccctcccctccccaacctcccctcctttcccctccttttccctccactatcctcattcttttctcttgacttcgatgataccatattctgattgatcttacccaattttctggcttcagttactatatatggatcaattacagccacatctttatcttaaacaagatcctcttcctgaacctcagactccaataccaaattaccttctagacatcttcatttgaataacccataagtaacttgacatataaagaaataaacttagcacatccaagccacttctctcatgattcacatctctgtgaatgatattaccaccaacccagatatccaagtcaggtaagctcagcttgatcccttcctgactaccacattcagttaactaccatattcttttgaatctacatctttgaaattatccactctgctgcatatctagagtcactattctattctacatcatcatgctttaccttagttattgaaataatattctaatgcctcttctttcttcagttatgcacccctgtttttatttgagataaagggaaacatgaaacagtctgccatgtgactttatcacttaatactcttcagtagtttcccattactcttatgattaagtctagttattttcagaggtttcagaaggtcaggcatataaagaggtcacaaattcttttgtgatggcacaacagctttgtatcttgatttttttggtggttatatcaatacatgtgatacaaagacgtacaaaaaatgagtgcatgcacaaattgatgaaatccaaataaaatttgttgtttattttattgtactaggtcaacttcctcattttcataatgtacatggttatgtaagatggtaccaatgtggaaagctgggtaacgggtaaatttgacctatctatactaatttgcaacttcatgtgtgtatataatcacttcaaaataaaaagaagttaatttgcttgactgtagtaatcatttcactatttatagttatatcaaaacatgctgagcaccttaaatatatcctaaaaaaataaatgatttcaaaaatgaaatctatccatttctagctggctaatgttgaacaaattatttaccctttctacctttgctccttcttctccccagcagactacattatcatctagtcaaaaaaaagtagacacatccatctaagtacatgcttaacatcccaagataaaatctgtaaatatcctgggtcagctgggtgggactagctagtggtatcctcttttcatgaagttttgtaaaaagaaattaacctaccacttaaaaagactaatctgtttacctatgttttgaacactaattctacttttttagaaattttgcagtattgattaattttatcttttctatgtcttcatgctttgtctctttgtaaactcctttgttatcaacattcgaacttgttcaagcccttcactattttttttttaaagaaaagaaaaagaaaactctttcctaacatttcaatctgtcttgaaaaattactttatttctttggaaaccattgtttttattgtttgctttttgacttttcatgtattatttggattatactaatcatgttactgaatctaatggacacttaaaaatttgttttacacataccataaaatttcacacatttcaagaatagagtttagcatattcgcaaggttgtacaaacatcaccactatctaattccagaacgttttaatcaccccaaaggttctacactgtggatctagcagtcattcctggagatccatgctcttgtcttccagtgatttgtaactacctgattatctctccacataatactctaccaaaaacatggtgatactggagatttctctctttgtcttctgttttccaagttaaacctctctagttgcctcaactgcccctactgtttaagatttctcaccattcttgaggaattgccacactgtcttccacaatggttgaactaatttacactcccaccaacagggtaaaagcgttcctatttctccacatcctcttcagcatctgttgtttcctgactttttaatgatcaccattctaactggcatgagatggtatcttactgtggttttgatttgcatttctctaatgaccagtgatgatgagcttttttttccatgtttattggctgcataaatgtcttcttttgagaaatgtctgttcatatccttcacccactctctgatggggttgtttgtttttatcttgtatctagaactagaaataccacatgatctaggaatcccattactgggtatatacccaaaggattataaatcattctactataaagacatatgtgtatgttataaaaaatacacgtatgtttattgtggcactgttcacaataacaaagacttggaaccaacccaaatgcccatcaatgatagactggataaagaaaatgtggcacatatacaccatggaatactatgcagccataaaaatggatgagttcatgttctttgcagggacatggatgaagctggaaaccatcattctcagcaaactaacacaagaacagaaaaccagacaccacgtgttctcactcataagtgggatttgaacaatgagaacacatggacacagggaggggaacatcacacaccagggccttttggggggtgggaggctaggggagggatagcattaggagaaatacctcatgtagatgacaggttgatgggtgcagcaagccaccatggcatatgtatacctatgtaacaaacctgcatgttctacacatgtaccccggagcttaaagcataataataaaaaaaagaaaagaaaaaaataagatttctcaccattctacatgtttttctctttaggctttttgataaggcagtgtcctcataataaaagacatgtgccatgatctggccagttcagagtaaggtgggataattgctatcttatttactttattattgtagctcatgttattattgtggaacttctttgatccttgactgatacatggaacttctgacatttgctgacattccctctatagtttcctgcttctaatgaataatattaattttattttgaaaagttggggttgggagaaggtaaaggggagatggatgtgaggaactggcatacgtgactaacacaaacttaatgtacatctggcataatcatcagttaattcaatgtagtttcatttttgacttggttagtatcctacaaaataaatatattaatactaagtttgaaaatgagtatatttcttgcaatagaccagagatttgtggggtttgggatagcactaaatgaatacatgttatgttctatcatactatggtattattttcaataactgaaatgagaaaataagtatattttgaagaagtgaatagaaagcacttatatctgatttctgctgagattttttcaaagttactaaataaaagcagcatttgtgacttagggtgaagcttatgaaataggggtctttatatgattttttgtctttaaatgttaagactactctgaatggatagtttaatgattctaaatggaaactagaaaagcaggtctaacagtaaccagatgtcctgggatttagaatggcatgctaaaagtagcaacctatatgaagcttttgaaaactcacaatgcttgtcatttcttattttcttttatgaactatttcaaaagtataataaggcacgaaattaatgtaataaataccaaatacccatcacccatattttaaaaacattagcatttgccatatttgcttgaattttgtttttacagaaattagtcattgcagaaatagttgaagttcccttgtgtttacagttccaccttttgtccctagaggtaaccactcttctgaagttaatgcatatgctttcagttcatatttttactatttttatattttcatttcatttcatgcagcacatgcgcacacacttatccatgaacattcggtgcagttttgtttacttaaaaatttacataagtcatttctcaccataatgccatggtttgcaatctatgttccaaggcactcctgtagggccacagtgaactcacaggtgggccatgagctatttaaaatttttaagagaaacgtagcaatattcaacatctgtcagacaccaggtcagacactaccctgaatagttcagttttagcgtgggatttcagtaaattcatcctgatggtgtcatgtcttcgtgaagcttggtttttgtggttgctgtcatagaaagcaggtactgcatgaaaatcaatatagaacaggaaataagtgtggcagtgtccaatcagatttcaaggtttgaaaagttgtgcagtgcctgacaggcacacacatcccaataataataaacttaaagatggctatataagaatgaagtaaaaataatttttaaaaatttgtgtttattatttctatatggctgtattgctgggacaaaaatacttatttaattgtttagacctaagtactaaattaatggatctgttacatacttttaagctaagtttgttgtgaaaatattactaagacactaagtgctctgagaaaaaagtaagaagacagtgaagtttggatatttatttttctttctgtaatagtttatatcaggctacgattatccattccttaaaggcttggcaggattcaactgttaaaccatgtgagatgtaacttgtcaggagattattttttctctcaattattgatcataaatttattcaggttttctatttctaattacatatttttcttacatttcatgtttctaggaaactgcttatttcatttgagtttgtaaattgattgccatttagttgtttagtatattctcaggttattttaaatctttcctatattgtttgagatacattctctttattcctaaagtttctaatcagtgcctctattttctttcttaaatatttaatgattaatattttttgatcagcataagttttactatgggttgaatactgaaaaaataatatggtttagcctaatatattacacctcttcttaaagaacaaattttggttttgctgatactctctattgtacatttgtttcatgttattaatttttgttctaatcattattctttccttctcttttacatggattattctgctattattttttaacttgctaagtgagatcctaaactaattaattttacgtatttaaaaaatctaatatatgcatttaaagccataaattttccactaagaaccactttagctgcatcccacaggttttgatatgtagtgcctttattgtgttcattttaaataattaatatttcaattatgatttcttctttgactcatggaatatttatgaatgtttttttagtttctaaatatatagggctttttaatctatcttttcatcttaatttcttattttattccattgtggtcagataccttattttgtaataccaattctttggtatttgttaacacctctttttagatcataatggttgaattttataaatattacacattagttggaaagaatgtgcaattttcaaaaggtgaagtttttacacatcagttagttcaaaatgatgtaatttaaatcttctatatctttactaattgtattctttcctgttgatgtatcttctgcctcatgactcactcctttactttgttcagggttctgctcaaatatcaccttcttagagtctttctataaatattttttctacatatctgtttctccatctcttcttctattttcttttgtactgcttttctcttgtggcatttgttagtactgaacattatattttatatttctgtattcattgtcttcctcatgagagtataaacaggaattatgttttattcactaatatatcttcagggtctaaaatattatctgcctaaaaaagcatttaataggtagatgttgaattgaacaaaagagtatcagtttttgatcctatggttagctcattctcaggtgaagaaagttgttttctctgtgagtgccttgggtccttccaaagtaatttagtatttccttctattctgtgacccatgatctgtgcctgtactggtctacagaaaacctaattggttttgtgttaatttttagctttgagttttctgtcccaaataatgcaatgctgattcctaaggcactcatggcacgtatctgggtttcattttctatgtttttttttcccccagaaccctaagaagatttctagttttattactctgtctctgggctagtctatagacctatagacttttctagtctaaatcttacagatgcgtgaggggacatccattaataagtgggagtctcagcttctgttccactcctctcattggcttcaggctttgtctgtttccccacactgcggacaaatatatggatatatgtggctatggtgctctagggggacaccaagagttcagccccaccttctgctctggctttgagttctttctttttgtctgacacccagagatttccctttatagctttcattctaacttgtttcacttcttaattagcaacatcatactgaatatctctttatatgaaaagaaagagagatacaactctgtcagctgaatctccctgtcttgacttttaatagtttttttaggttatttatgctaatctttatgattgcttatagcctaataatttttctatagaagtgcatagtatgtatatgattaatatatttagcacttgatttggatcatgttgccctaatttttcagttgctgacatatttactcttgcactttcacatcaataatcatatgtgagtgataaaattacatctcctttaagttagcagttagcatcatacagtgagtatttatttgtgagagagagtgggtatgtctagtggagggagtaaaaaagacagaaagagagagaagttgaaaagtttaggtggagagagagattattacaaaaaaaaagtttaggagagaaagagagataagaacgtgcatagacacataggctcaaaataaagggatggaggaagatctacggagcaaatggaaaacaaaaaaaggcagtggttgcaatcctagtctctgataaaacagactttaaaccaacaaagatcaaaagagacaaagaaggccattacatgatggtaaagggatcaattcaaaaagaagagctaactatcctaaatatatatgcacccaatacaggagcacccagattcataaagcaagtccttagagacctacaaagagacttagactcccacataataataatgggagactttaacaccccactgttaacattagacagatcaacgagacagaaagttaaaaaggatatccaggatttgaactcagctctgcaccaagcagacctaatagacatctacagaactctccaccccaaatcaacagaatatacattcttctcagcaccacatcgcacttattccaaaattgaccacatagttggaagtaaagcactcctcagcaaatgtaaaagaacagaaattataacaaactttctctcagaccacagtgcaatcaaactagaactcgggattaagaaactcactcaaaaccactcaactacggaaactgaataacctgctcctgagtgactactgggtacctaacgaaatgaaggcagaaataaagatgttctttgaaaccaatgagaacaaagacacagcatactagaatctctgggacacattcaaagaagtgtgtagagggaaatttatagcaccaaatgcccacaagagaaagcaggaaagatccaaaattgacacccgaacatcacaattaaaagaactagagaagcaagagcaaaagcgttcaaaagctagcagaaggcaagaaatcactaagatcagagcagaactgaaggagatagagacacaaaaaacccttcaaaaaatcaatgaatccaggagctggttttttgaaaagatcaacaaaattggtagactgctagcaagagtaataaagaagaaaagagaaaagaatcaaatagacgcaataaaaaatgataaaggggatatcaccatcgattccacagaaatacaaactaccatcagagaatactataaacacctctatgcaaataaactagaaaatctagcagaaatggataaattcctgaacacacacactctcccaagactaaactaggaagaagttaaatccgtgaatagaccaataacacgctctgaaattgaggcaataattaatagcctaccaaccaaaaaaagtccaggaccagacggatccacagccgaattctaccagaggtacaaggaggagctggtaccattcctcctgaaactattccaatcaatagaaaaagagggaatcctccctaactcattttatgaggccagcatcatcctgataccaaagcctggcagagacaccacaaaaaaagagaattttagaccaatatccctgatgaaaacatcgatgcaaaaatcctcaataaaatactggcaaaccgaatccagcagcacatcaaaaagcttatccaccatgatcaagtgggcttcatccctgagatgcaaggctggttcaacatacacaaatcaataaacgtaatccagcatataaacagaaccaaagacaaaaaccacatgattatctcaatagatgcagaaaaggcctttgacaaaattcaacaacccttcatgctaaaaactctcaataaattaggtattgatgggatgtatctcaaaataatgagagctatttatgataaacccacagccaatatcatactgaatgggcaaaaactggaagcattccctttgaaaacgggcacaagacagggatgccctctctcaccactcctattcaacatagtgttggaagttctggccagggcaatcaggcaggagaaataaatacagggtattcaattaggaaaagaggaagtcaaattgtccctgtttgcagatgacatgattgtatatttagaaaaccccatcatctcagcccaaaatctccttaagctgataagcaacttcagcaaagtctcaggatacaaaatcaatgtgcaaaaatcacgaacattcttatacaccaataacagacaaacagaaagccagatcatgagtgaactcccattcacaattgcttcaaagagagtaaaatacctaggaatccaacttacaagggatgtgaaggacctcttcaaggacaactacaaaccactgctcaacgaaataaaagaggacacaaacaaatggaagaacattccatgctcatggataggaagaatcaatatcatgaaaatggccatactgtcctgcgtaatttatatattcaatgccatccccctcaagttaccaatgactttcttcacagaattgggaaaaaactagtttaaaattcatatggaaccaaaaaagagcccacattgccaagacaatcttaagccaaaagaacaaagctggaggcatcacactaactgacttcaaactatactacaaggctacagtaaccaaacagcatggtgctgctaccaaaacagagagatagagcaatggaacagaacagagccctcagaaataataccacacatctacaaccatctgatatttgacaaacctgacaaaaacaagaaatagggaaaggattccctatttaataaatggtgctgggaaaactggctagccatctgtagaaagctgaaactggatcccttccttacgccttatacaaaaattaattcaagatggattaaagacttaaatgttagacctaaaaccataaaaatcctagaagaaaacctaggcaataccattcaggacataggcatgggcaaggacttcatgtctaaaacaccaaaagcaatggcaacaaaagccaaaattaacaaatgggatctaattaaactaaagagcttctgcacagcaaaagaaactaccatcagagtgaacaggcaacctacagaatgggagaaaatttttacaatctactcttctgacaaagggctaatatccagaatctacaaagaactcaaacaaatttacaagaagaaaacaaacaactccatcaaaaactgggcgaaggatgtgaacagacacttctcaaaagaagacatttatgcagccaacagagacatgaaaaaatgctcatcatcactggccatcagagaaatgcaaatcaaaaccacaatgagacaccatctcacaccagttagaatggcgatcattaaaaagtcaggaaacaacaggtgctggagaggatgtggagaaataggaacacttttacactgttggtgggactgtaaactagttcaaccattgtggaagacagtctggcaattcctcaaggatctagaactagaaataccatttgacccagccatctcattactgagtatatacccaaaggattataaatcatgctgctgtaaagacacatgcacacgtatgcttattgcggcactattcacaatagcaaagacttggaatcaacccaaatgtccatcaatgatagactggattaagaaaatgtggcacatatacaccatggaatactatgcagccataaaaaagatgagttcatgtcctttgtagggacatggatgaagctggaaaccatcattctcagcaaactatcacaaggacaaaaaaccaaacaccgcatgttctcactcttaggtggggaattgaacaatgagaacacgtggacaccggaaggggaacatcacaccccggggcctgtcatggggttgggggaggggggagggaggggtagcattaggagatatacctaatgtaaatgacgagttaatgggtgcagcacaccaacatggtacatgtatacatatgtagcaaacctgcacattgtgcacatgtaccctagaacttaaagcataattaaaaaaaaaaaaaaaaagaaactggataccatcacttgcaatgtgaaaaaaacaataaataaaaagtttctttcaaaaaaagaaaaaaaaagaagacgatagggaatagatgagatggcattgataagacagtttgtacctagacaagacttacctttggcaaggttggtttaattcttttcagtgatgcagataaactagcagaggcagataaattatttcaattctaatcttccctccctttcaacatgttgtacctgacttctacatgtagctaaacaggtactttttgctgatacctgagtgatgttgaagggtttgcacttacactcaacttttggcactttattatttgtgctgtattcatgtctacagggagaaattggtccctctgagtacagagcaagtgactgtcagcttgactgtgtttgaaagctcctatcctatcatgtgatattatcaggaaccaaggattagcaaacctatgttattttggaaatacttttcttcagcatgctgaacaaacagcaagagcataggtaataaagctattgaaacctcacaagtgaaatgtgagcacttcatcctcttttgaaaatattgcaacgttttgtgatttctccttcatatgaggaaagagaaagaatctttccaattatttctttaatgaatcagttactttgtggagcttttgaaaatgtaatttttcagatagattcaacagtcttacccctattgtgtaacttagtagtaagctttctgcattcattgtacctgggaaggtcaagcattttatgacctcaaaagcctgattcttgtttcatagagacaattacctaaaagttcccgttatttaaaatggatatttcaaccatctcaaggtttacttttactgggattctcaagtggttttatttattgaatactgaatcaaactgaagcagactttatcatgttatctaaaatcttactttatgtattttctcattttattttaaaaatcatggttgtatgacatgctgatataatttaatggtaaactttacatttagattttatagttttagcatttttgtcaaaccctagttgaagctacaaaaatattttgacactatagctagaatagataaagcagaattggatgtcagaagcatagagtacaatttattggttatcatgattagacgggctgataatgaaagctgattggcagtaggatttattacagaaactataagatggagaatagaaaatgataacattgctaattaatatgtaatgtatcttatgacagtgtgttatcatttagaatctttactaaattttagtttaattgtgtggctgttttggtgttaaaacacaattttgaaaaacatataatgcgtttaaaataccttttgaaagtagctatcaaccagaaacaggtaaaggtgtatttattatactttggataaaggtatattccaattgggaaatttggaagacctaaaagattttgagggagaaagaattgttataatagatgtaaatgtaatgttgaatggcttacagggtatctgacaacattctcataaaacattgtaagagaaatcagtaaacatcttgaagacaaaggaatcatgagcgatgaaaaaaatgagtttattataaacaaatcttgcctgacaaaattaataatgtttgaaatagaatgcagaattagcatggttaaggggaatgtatattttgaacttcaaccgagtgtttgttgtagcttttcaaaaataattgtagaattacgatataaataatctgatggataaaatatgcagagaaagctgatgaatctatagaaggccaaaatgtaatgccaagaacaccctcaaatggattgcaggattaggcggcagtgataagagtgacctgaggggttcagttttcccgtaatcttttccaacccccccatacacatatatttcatataaaagcaaaatgtgtatcacagaaaagcagattctaacacaagtcctcctaacacactttctgatcaaattttctttctaaatctccccatatataaactttggaggcttcactgatgggttagatcagggtttgccaaatgcatcccacccccttctgtaaacaaagttttattggagtacagccatggtcatttgtttatatgtttattgcttatggctgctttcagactatagtagcagaattgagtagttgaaacagaaactttatgacctgcaaaggctaaaatatttattatttggcactttatagataaaggtcctggtttaaatgaatggatgttttcacctgtagaggcattagaacgcttgtcaaggctaggtatagtcaggatatttgtacattgtatgaatgtgggagggagtgaacatgtaaagattcagggtttggtctcaccccgaatcttaccatgtttcatcattttgacccatctattttggcagtaaaggtcccaaattgggtatgtgtcgttgtaactactttcattcagttccattcaattgtttttgacatcataaaaggacataatgacatatcaaaagtttaatggggaagtgtgaaggaaacaatagctgagaagaacaatgttgttaatcttatgtattaatacattttaggtctaatgtggtaggaatatattttgtttagaactttttcaaaataagcttcatccacttgatcttggacctatctcttaaatggacttactgtgccccattaatgctgagagacagagcatttttcatcctaggattcaactgaaaaaagaactaccttgcacattgtaagcacttgaaaactatttatggctaacgatttctgtaaattcatttattcgttactcagatctatcagtgcttactatgtgccaggcatgacacctaggggcaagtgatttggcagagaataagacagatagcctccttaatgtaggaaaatcgacaatgagtcagtttataaataagtaaaatagttgcagatagtgatatcctgtgaagaaaagaaatctgggcagtgggatcaaaagtgacttgggtcagatagggtggatagtgggataaagagtaaccacgtgccatttgagttgaggactgaatgatgagaaggggaagccatcatgaaatgatctgggagaagagccttgtagaaaagcgtgttcaaaagccccaaacaagcatggcctgatgaaggaagacaaaaaaggtagtgtggctggattttagtaaaacagttggtgtgtagggatgtgtgagtgtatgtttgtttctgtgtctgtgtgagagtgctcttgggaacaggacattaaattagctccttgtttgttttcttaggtactcaattgattagtcttttctaaacataaatgtatgtttctgatctaaaatgagagttattgaattgattgtatctgaatcaactgttgttcaatgaaagagaaggccattcataggtgtcttgatagaaataagagtgagaagagagaatacactgagatagtgaaagtttgggagaaattgggaattaggacttggttctttggctccaagaccaaagagaagcttatttggaatgtcactacatgggtctgggtagttgttgtgcatcctgatggagcagagacttgttcacagaaaatggtgacggagcagggacatttaaagaaagctgtctcctgttgttggagggaggatttgagaaaaggacaaagatttttaaaaaatgactagttactgggtccagcacaccaacaaggcacatgtatacatatgtaactaaactgcgcattgtgcacatgtaccctaaaacttaaagtataataaaaatatatatatgtataattgatttttaacaagaaaaagattaggactgggaatgggccaggctcaataactgaaaagagacatcctaaaccctgtgatctccatcatcaatgccagtctcacagaagaaaaataagttgttggtagatggactggattatgatgtgggaggatgacatgttcaaattaaaccaggaaatggaaggagtgtgtatcatatcaatacacctttggggagaagaaagaaaaaagtaaattcagagagcaaaactggctttggataagaacgtcaactgggcaataatatagcaaaggaaatcgtttcgttttaaaaagcattactgtaatgcttattgaagcagttgtgaaaaacctgaaaaccgtgagtttatgcaaagacacatttttgaaactagaaaataacaagaggtctataacaaacgtatggaaaatttctaagcatttaaaacctataattgaaaattcagttaatttagtttaacaaattacttaaaatttaaactctgttggctgtattttggcttaaatgtaaaaattcctagtctatagctgttaatatattttatatcacagataggcaaaagtctatgccttaattgaaaggatgaagcctttcatatcagtctgaagccaaaagttacacacaaacttctttccttttttgacttgcttggatcagatactgatcaggtgctttgcttgggtacagacttgagagttttactattagctttcatcagctttttcaacattgacctttgaccatgaaatatgaagacaagaacggccttgagaaacaatgcttctccggttctaaatctggttcctcggtgtaattatatatcatgctttaatttctctaactggcatttctcgagttaaaattaatttgagttcactatgaatttaacagaaattgacagagtagagacgaatacctcatgctgaactatataggaaggacatcgtgaaggacatgttgagggcataggaaaagcctgatatatatgtgaaaatatttcagctacatgaacattgcatgacacattgtaaacccaataattgtttgctgaaacaatgtatatttatttaaaatcttatttcattgggtgagacagtataatttctgcattatttggaattaggatatataatggaactagattatggaggaatttgaaaaccaagtatataggacttgatactgtaaatcattaggaattattataggaaataactagattatttccaaatatttgttttattatggtgtgtaggatgatatagagatagatagaggcaaaggatgatattttattccaggcatacttttatattaaaccaggttctcattcccagcctagcttggctgcattgaaatgaatttcttcataaaagtctataggtctaatgtaaaaaaaaactttggactttggagggaggatttgagaaaaggacaaagatttttaaaaaatgacgagttactgggtgcagcacactaacaaggcacatgtatacatatgtaactaaactgcgtgttgtgcacatgtacccacaggactttgaacattctgctttattgtgcccttttatacttgtgtctcactggtacctgcctgtttgcatttattttagggagtaattcaataaaaattaaatggaatgaatttataactaaaacctgttctgtgcaaaccataaggatgggatttatttattttatttattttttaagtcagccttttctcttcatggaattactcaatgtgtaaagattggtacactaaaagcaaatcctgcattacaaattggttgctgtctttggtagcaatctgccaagaggatatttcaagaaaatagtcatactgcaaatttggccccttgctggccctcattaagtatgcattttactttgacatgttatttcatagaaatgatttaggactagaaattaaaagttgtatcgactggtgtacctctcatcagatgaattaggaatagcagacaatcctgcctttgagaagttattatgataatattgcccatttatactgttgtcttggttgcctttggaatataatcattcacatatttatcccatgaaaactatttccaaaaaggaaatgagaggtcagctttgattgtataattccacacttactagctggtggtaccttagttttttaatttttggcattgactctgggaaatttactatggtataaaactgccagctgcacaaaggtggggccagttttgtcagcatcttatgaacaattcaccaaatgaatttttctgggaaaaccagtatgaaagttccttgcatggtagtgaagaagtagacttgtgttaaatataataacacacaagaaaaaccatcaactcatgaaagattgaagaactcatgaaagattaaagctggaaatggaacatggtctgtaggaatccgaactctgcaaccagattgacgggggcataaatcctggttctgccgctcagtaaaagggtgtcctttggcaaattacttactccctctgttccttagtttacacattgataaagtgggtatgatgatattacctacctcctagagtttttgttaggtttaaataagtaaatacaaataaaagcgctttgaacagaacctgaatatggggactgctcatgtatttgctattatctgttaatctttagaagtaaagatgaaaattaaatagatttctctttgactctgccttctattgttacaaaaatataggaagaaaattgctgtcacttctaaaatgtggaatgattttaaagcagcactattttgtttcaaagctcaaataccttgtaatgcaattgtccttaaaggaaacatatttaacctttaaccaagactaaattaacaagaattgtttttacacaccccttttagaagaaaggttacaaatcataacaaaatagctcattattaggcctgtcttctgaaggaacttcaaacattctccttttgtcctgggggttactgtatgagtgcaatctcctatgtctagttatttagaattctgtaaaattagaaagcaaggggtttttattgggtctctggatccctggaaatttcatacaaaatttcgtgatcatatgcacttttctagagaaaaaagattcttggttttttttcatcgtcccagaggcccttctgacttcccaaaagttcaagagccatcctctaaggcaacataattttttcattttaagtgaaagataaaattataattccctatttactaaagcagagaaatctagtagaacatcttatatttttagttaaaatgatctaaaaacaaaaacacctttccccctagaacccttagctaaccagaacatttaactaaccaacatttcaggtaatcaatggttacttgcatcaagcagcaatctttcttcagtgattagctacgctggtgaaaatagtccagtcttatctggagaaaatggtgattttttaatttattcattctttttttcttgaagtttcaaaattattaatatttttatagtttcataattatacatttcttatggtatactcaggaataagagtattctataaatgcttacttcaaaactattatatcaatctaatataatttagtactgaatatttctgctcatggtggagtgaaatatctgacagaagactagggaaagctggaagaaaaataattttactgacctgtgaaatttaaaaaaagtcttctattttttatgaacttatgtaaatgtttaagtgcatatttaccttggtattttaaaattgcttttactaaaatggctaaatagatttttaaataattgttttatggacccttagaaaggatatacatttcaagcccaaaaactttaaagtttttagttgaaggggattaagtaaataatttagaagttcattgtgtttacctgttaataattaagcaggttagattgtgtactttttatagtcactgagttttaatttatttatttgttgatgtgttggtttttaagaatttatttaaggcattctgctcttgggaaataaaaataaacagaatgaagcttcacataataaaaggaagggctcgggttacttttaaacagacaagtaaagaaaaaaattgattgtattttagagttaaaaacagtatttagtacctaatctttctgtactttttccccctatttagaagcgaacctgaaatacctaagagcaagtataactgagtcagtgaatggtcttttgttgttgctctcgagctccagctccatggaatttgactttatttcagatggctttagtatggggtttagccagaccaatcttatgaaatgttctttgagaatataccatagaacttaccagatttccctggtgttttaaaaactctaataatatatccaaatccaaaatgaatacctccaccttaggatgcatgattatggatgaactgaaattaaagcttttccagtctttgaaggaatgtatccttgtcttcttgacgatggaactgtacaggttctttatgatctttcaggatgatcaattggctttcatttgccttttaaaataaaatacaattaaaccttatgtttaaatttttatttaatgaagacttgtttgctataattattaatagataatggtctttaacagtttctattcattttgtactcattgggaaggccttatacaaaataatgtccattgaaacaattaaccagaagtcatagttcatatgttgtagggtcatatgttttgaatgacatgttaaggactatggattgaaaatttcttatatgggaatgaacagcatgattttatagctacttaaaatttgcttactttaaacttttacttaattgaaatttatactactcctatttccaaaactgatttggagcatcttatgttctcatggtgtattttgtctctctttatacagtagtcctatcattgaaatcgatgaacatttcatctattttctcttgtaaaagtatgttcacagtataaatgtaacctccaacttaagttttctacattccaggctgtgcttttctttgaaagtttaattggagatgttaccagttaaaatttggttgctaggaacctaatagataccattctgagtagttgctgttatctttataaatcctatttttctttctttgttgttctcttcccttcctcacgatacctgccctttctcctttccttccttacatttttttttctctaaaaaaatctatgcagttaaaaaggtttcaccaaaaatgacagatagacattttcaaatgtctttcttaacattcaggaattctaataatataaattaaatttttctttcctgaaacataaactaggtgccttctttagtgctttttatgtttataaaaagtaatttgtttttattacagaaaatttggaaacaaattctaagaagaaaaaaactgtcataatcttaagataaattcaaagaataatgtagtttaagttttttacagtcacatacatactttttctaatgcacacacaagcacacacacacacacacacctggtacatacagatctatacttacatatgcacataaccaaaagttgtgcatagtctgtatttatattatatagagaaaaattattaaatattggtatggtatgttatcattattaccattttataacctgttttctaagcttaatgatgtattatatattttcacttgccatgtctaatgaacacttaatatcctattacatataatttatctaaccagttcactattctaaaatattttagtttatttaatttgcatttctttcattgctattgcagattaatattatttcatatgtattttagcttcttatttcaccttattacttataggtattagaattaataatattatttaataataaatagtaataagtattactattttatatatagtttaaaatatattttatatatgtttaaatatatttataaatgcattccatattttagaagagaactcacaattctattgtgaattgcctattcatgtattttgctcattttaaaaagtagaataatatgtttatttatttataaagactcttaacccaatgaacattatacactttaaaaatatttattttttattggcctcttaagtttgaattttgttaaagatgttttctgccttacactttttttttttttttttttgagactgggtcttgttctcttgcccatactggagtacagtggcaggatcatggttcactgtagccttgacctctccaggctcaggtgatcctcccacctcagcctcctgagtagctgggactacagttgtgcaccaccatgtccaactaatttttgtattttttgtggagacagggtttcaccatgttgcccaggctaaaatttttaattttaagtagtaaacatcataaatctttatgcttatattatataccactgtgtatgtactttaaaagtccttcccacattggagttcagaaaattatacatatgtattttcttagaggtccttgattgttttatatattatattgagttttattgacctgatttatattttagtactgataagaattagagaacagaatttattttgccacaggtaatcagtcagctatctcaacattgttcatggaaatgttacttgtaacatttaccccatacctaagttcccctggcctcttctactgatctatctcttccaatgccaatatcacactgtcacttatatttaactctttggaaagaacctaccttgttctctgcttctttgctataggactcaaacctaatgcttgatgttttctcatttaaatttgttttttaagtttgtcagtcccctggtttgttgttattgttttgagctagctttaaagcatcaaaactactaaacatcattttagttcatttcaggacaacaaagatttttttgattatttgttacatagcaaggcttgtgcttgcattaggaatacataaatgaatcagatatctgtgtagcaatgtcccttcactggaaaaatgtgttaatctgatggagtcagacagcatgtaaatagtaaagagagtggcctcatgttaataacttaattttcttctgattctttcttattcttttgttatctatgacttcttggccctagccatttaatatattttcccctttttcttttttttttaatttaggaaaggtgaaatattatgtgaaattgatttaacagagtttgattgattcaggtatacgaaagatggtgactttttcatattcatgtagtctgtttattttctaattaatgaactgaaaattgtgtctttctatttttgttctctaagtgtttattgagctcttgctaggcactatttaaggaaccttaaggaaaataacagtaaatgcctttgacaatgtaatctagtggggaaacataatttataaaaatattagcaatataataaaaagtattgagtacactgtttggtatatgctggccattatactaggcaaggaaatatgtattatttaatcctaaaacaattcaaacggtccttcagatttttttttttttttgaggcggagttttgctcttatcacccaggctgaagggcagtggcgcgatcttggctcactgcaacctccacctcttaggatcaagcaattctcctgcttcagcctcctgagtagctgggattacaggtgcccgccaccacgcccggctaattttttgtattttagtagagatggggtttcgccatgttgagcaggctggtcttgaacttctgacctcaggtgatccgcctgcctcggcctcccgaactgctgggattacaggtgtgagccacctcacccagccagtccttcagatttttttgttttgactgtcttctttacttgattcaggtttcttattattcttacgtcctttgagaagtttccctgtccaaatctatctaaaatatcaggccaggtaactctcagtgtcattatcttgttttatctgacttcatagtactaattatatgacattataagtctaacagtttatttgtttattgtctgtttctcctgttgctagaatgaatattgaatggaagaataaagaatgcattgtagaagtttgtagttgcagaatgacaatttaatttggtgtacatgatttaatttctttaagcctaaatttctcatctgtaaatagatacagatttagtgcctgttttattggttaggctgttcattcattcactgagtacatattcattgatatcctagtatatggcaggcactattcaagaaaatggggttacagtgaaaaagagaaagtgcctgcccttatgttacttccattctagaggaagagacaggtaataaattaataaaagtaacttttgtaatatatcatgtagttaccaaattaattttctcaaaggtgtcctccactttatctctatgatcagaacattttttcttttctgttcctaatcatcctatttcttcatcattaattgttctggtctcactcctcctagcagttactaacttttagcatccctcctagtttgctgatgcagaataactgtaataatgctgatgcaccccaaatataacaggagtgtcagattccttttctggaccctatttgtctattagtgcaaccaatccttaggtttgttttggtttactagtgtggtttgttgtttgcaaaaatactgtgcatgcatattaatgatatagtcaattaaaatcctcagatttttaaaattttaatgggcattttactgtagatgtactagattatataatcaagcatatgtttaggtattgcatttccattattaaaactgcttttgaaactttgaatgcctaaatctctgtggagattattagtaaatgtggcatcaaggtcatcattgagatttcatagcaaatttagagagatcattttctaatgggaacacaacatcaaattcaatttttaataggagagctgtttttagttaaatctttctatagtcaaaatcaccaaattggctttaaagtaaactcaacatcctgcctgttcccatccagcttcaattctttactaaagaaatttaaaagcaacccatccatttgtttggcatccttgcatctaaatatgggtaggaccctactattagcctttctgctaaaacaggaaatattaagccatgttttaatgtcaatgccttaggtactaagctgtactgaacatgttaccctttgcatctttatttctttccacccattttctttttattttctttggtttatctgagtttatgcaaatatctctaaccttacctactattttgagaatagggcttgtgttttatctttgcatacttttaaactcaccagtgatgaccagtacattatacatcatagaactttgcgaactctctgttaataagaatgagcaagtaaataggttaaaagcaatttgggatttgcttttcttaaaagaaaacatgaaataaaaatgcaaatatccttatgagttaagataacttcttatgatactatagcaaacaccgtgctatgcctcctcaaaaatgtatatgcagtggtttagattgtatatttgggccacgttttactgagtacttgtacacatatgaatgtgttagctttcagttttctttttaaaactatagatattagttggcatacacaaactcagctacctgggtcataaagatattatagaaatgcaaatgttttccttggcagatttctaattttaagtattcctttttttacagacaaataaaaagaagtgttaagaattgcctttgggactctgaaggctgaaggtaatgtccagtggtattttcctgaatgggctttatcttcttgaattgtcttataatatttaaggtcttggatttgctacctcaacttttcttttattttattatttttcttttattgtccttaaacacattaaatatctttttctatgtatacctaaaaataatatgaaattgtaagttaaaaagtagaaattttatactctttctgaatatttcagcttaattaggtgttgctctaactcttgttccttctatttcattatgtattatgtccctctgtcctcctttttttttttttttttaactggtttggaactcatgattttaaactgtgttcttttgttaaacagacatattggcttaaagtcagaatgtcagtaacaatttctcctgaggaagagctttacaattaactataagaaataaaattgtatttgttggggacattgaaactcttcagatgagatttagtggctactgatagtcagaagtccagaatttcaggcaagaagtttacaatagactcgtgtggctgcattgtgtataaagagctcacagggattgaaggaggcttcttagacaagagggggctgtaattacttttcttcttacatgcatggttagattttccagtgagactaacatggtagggtaatttattatagaagagtaaatcacagattacattggagggggatggggtggtgcgatccaaccatcagttttgtgaatacatacacttaagcatgtgtgatagcttgtttttaatttctttacaccagtgcacacctcaaacattccgtttagcagtgggatatgcaaattgttccaaatgcagcagcagtactttcacctgaatgtcaaaactgtcagagaggtttaaatcaaatctttataacattttttaaaaaccagccagccccaagatcgaggcaccaaactcactgaaaaaaacttcattctcatacttccagaaagctcctgtatgtcaacagggtaatgtcaaagttctaattcacctgctttctaattttaaccttttaaggattttattttatttggcttaattacgatattttctacaaattaatgataaatgccttgattaataaaaccaaatgtcagagaaaatgacaacttgatgaaaaattaatactcggcaatattttaaggtacagaagtactaaagatgtactcttaaacctcatatttcattacctctttctgaaggtagttaacgagaattctctttgcacgtaagttttcacagccacatgtacagatacattttagcaatataattttcagtaatttctgctgttctttttattattagctattaaagttagaaatatacttctaatttttatccctgccttgccccataagattatttatttttattcacaaaatcaaggtaaagtatattttggagtggttatgagtttaagttaccatactaagaatcaagttagcaacctgtctgtgtgaatgtgtgtgtgtgtgtgtgtctgtgagagagacagagagaaattaaagaaacctcattgtgtaaaattaatgtttggtgattggttatctgctagacgatttatttggttatgaacatttcaggtttatatttaaaattatctgagagggagaaagaatatcgcttttcaaagtggaatagattttaacatgataatttccatttttgttaaatatgtttttttcctgagattacattaaaagacctgaagacaagtgaagagtggtaacttccttttttcttgtatactaataattttttggctagctcaaaaaaccaaataatatgaaatatgattatttttctacttttactggagatcatgaagttgaaagttaaaaatatcccgtgtatttttccatcttcacaaatatcaggatttcagaacatgaataaaatatttgattaaatcttatgcagaaatggtactatgcaggtaccaatggtacatgcaggattgtagtccatgttagttttttattttcatattttacagataaagctgccaaccaaatgagggaaggcacaatgacctcttgtgtgtttgttttgtttggttgttcagaataaaaagacccacaatatatactgtcaatgaaatggactcactttaatgatctgttcatgtaatgacatgatgttcatgcctatcaacaaaaatttttgccaactaatgttagaatctcctttttctgtaatataatgagaatttctaagtaggtattttaggcatattgctctgcatagtgagataaataaaggtaagtgttggtcaacattctataaccacagtgtatgccaatcccaagggaaaacattcttcagtgtagatttccagtaatatttaaaatttggagatggattgcattgaatctcccttagctggctctaggttttattgtttttgtgtctttcctggttccaggcatccagtctgtactggcaaagctgcttgatgaggaggggcctccaacattgctgccccaattgcttacatacctgccataaataatagctttgtccactagttaatcattgcattgtaactgtctctgttccatcttagctgatcactgcccagaggagtttaagttccattgtaatacaaagctcctattacctttctgtacctgcatttatgtgcctgtaaaaccatccattcttctcatacaccagttaaataagacatgtcccactttttttgacagtttctaaattacatatttaaaaatgtgtcttttcctccttgtttattctgttcatcctttcgtcagtttacttctgcatataaactagtgttttttcattagttacaagatttgattaaggaattattaacacctattttacaatccgcacttttatctattttttgttgagattttagttatttggggtaagtactataagaaaatgtcatcctttccctaacacgtctatggacaaaggagaaagactggaaccccccaaaatctctgagacctttgtctggtcttacatggtttgatcctaggaatgagggcactggcccaaccttacacagaatcttcagttttagggagttgagttatgattatttaaactcagtgcttgaattaacacacataacaatcagctgatacactttgaataatctgaatcttccgaaaaaataaacagcgttagaatatctctcatccaacaaaagaaaaaaagtaaatatgttttatggtaggcttaaaatatataaattcccagttttgatactcataattgtaccatatgttctctctaaatgacttggtagcacctttggaaattgcattatcttttttttttttttgacggagtctcgctctgttgcccaggctggagtgcagtggcatgatctgggctcactgcaagctccacctcccgggttcttgctattctcctgccttagcctcccaagtagctgggactacaggcgcccactaccatgcctggctaattttttgtatttttagtagacacgaggtttcaccgcgttagccaggatggtctcgatctgctgacctcgtgatctgcccgcctcggcctcccaaagtgctgggattacaggcgtgagccaccgcccccggctgcattatttcttttaagcctgtattttattctgctatctcaagtaattgattgtgaccttattggcttgaaaagattaatgcagcttccagagttgactaatgcataacttacgtaccagtagaatgataagtttttgaaaataggaatcatttaccttatttgctttctttggaaacctgtttattaattgaataaaatgttttcatgaaacacactaataaatgaagcaagcagaaagtattaagaagaagcacgaacattgtccaagatgtataggtgatttgtgtttcttgcctcaatgctgcattcatgctttctccctgtctaccattccctaaaatacccaggtctctttctgtatcctttagtgataataagatgttttttattcctctaatgaagtgggaagtaaattaacacagttctttttgggaattacattactcattgtagtaccactcaacatacctttgtaatactaacccgtacccacaactaattagtgaatttcagaattaaggaaaatcttagttgtgtggtagctgtatatttaccagtgatcaaggaagtgttactaatacactcgtcagtattaaaaaaagaattaagtacacaaagggccagctggttgagcccaggacctatcaagagcccagtatgtgtgggctggcccaacggaatgacaaaaacacttaccaggctaagtggaatcagatttaagctttcacttacaagaaagataatgcttttcaaatgtgttttcttatcatattgtgatttacatgtgcaagtctcatttgtactggtaacatttgagaccacatatttccctgtgtatcaagaactatgcatatttacatgtatcagaaaaatctcttggtacatgaagtattgggttcatagttcagcagttaccatgtaagcatttttgttggttcagagaatcctacttttctctcctacaaaaatctataattttactgttataacatacatattatactttcttataactgaatatttgtctcatccaatagattgcctggctcataatataaggtacctggttatagagtatttgccatagtaatggttagataaggaacgagtaaatatttgcttagtgtttataacactattataatagtagttacaataaggttaaattggagaaattaaaaagcaaattccttctctttcctgtgatttaactgactttaccagtatacgtatagaaatatcctgttcccaactatattttgtatccctttcatttttcatctgttttaatttattttattgtataattgtgtacttttggaagccattttaaatctttttggtttcaaggatcgatgtatcagtgaattgttggatgggtaaattgattaaatacagtgtacatttttagggatttttctctccacaattgcacaaataatactagaggagactagctaactcaatcctccctcctttcttctgtcaaccccttctttccattttctagcgaatatttatggaatgctagctctgtgccagaaactttgtagatgttatagataactgttgaacaaaagagacttagtctttatccttgttgagcttatagtctaacagggagatataataagcacataaataaatattagagacatagatatattaataaatgactattttgctaaccttctcaattctagcttgggttagggaattgagtctacggtggagaaaattatcttcaatgatctgccttcttaatggtggatgacttgtagattaaaaattgtggagaggccaaagtatttcagattatgttttaaggagcaggtggctttgagatgaagctaggtgtggtaatatttgcatccaagatgagtcgtaaacagttttgtaaacctggcttactttatatgatatagaagatctccatagacatttgaaaatctcagattggaatattataggaatttctagtatttttaaattataaaaatcatttcttttgatgattatttatcaatagcccagagttcattcgtgaattggggtatagtaatgatgaaaaaagaggaggtgaccgaagtgtgttttcttttttctcattgggtgtatatgtggagtatttttgtcttctgatcagatagttcattatgctcccttttggatgtgtgtactgtttggccttccaacctgcatgcttattcaaaggcattccaagtcattatgttggacttcagccttgttcagtaaaaggctatttcctccatcagctgtccacttggacatacattctttttactcgcaaaaatatttcatatgcattcagtttatattagatgcatttgtcaaattactcacaaataatcagttttttaaggttataatttgaggtatgacctctcaaactgtaaattataaggtttgacctttttggttcacagtttgacataacagccattaattacagtttttaaagaacattttatttcatttagaatttgtattttgaaaacagtttaagtattttctctctaagtttttggaataaatgtggaaatgtaaatgcatatgtatctatatataatatatacattcaaatatactaaatagattgcatatatacgcatgctatattcaaatgtgtttatgcatagtacattggtatacatatatacaaatatttttatataatagcttgtgagttaacactaagatcttcttttatacaactctagcatcaggatgagatcaactcttttttttttttttgagacagagtctcgctgtgtcacctaggttggagtgcaatggggtgatcttggctcactgcaacctccgcctcctgggttcaagcaattctcgtgcctcagcctcctgagtagctgggattataggtgcccgccaccacgcctggctaatttttgtatttttagtagagatggggtttcaccacattggccaggctggtcttgaactcctgacctcgggtgatccacccgcttcggcctcccaaagtgttgagattacaggcgtgagccactgcgaccagccgagatcaactttttaaatgtatttatcagggtgaaagagactttattaccatttgaatctaggctttccccccttttttttcccttgaggaggaatgcaaaagtatatgcctacaaaatgcccagtgtctgacagtaatttgaaagtcttgaagaccatttgaagtagcatggtgtgggagaatgtaaactgttcaagtagtttttgcaaatgtacactgaagatactgagatagaaagtacagtacataccagaaaggtcagtttaggtaaacacagaaagatatccagatgtgtgaacactttgctgatatcatcagtatttgaaatggaggaatttagtatgttttttattggataaaaataagatatttatatagctgaaaataacaccaagtataacgttttctgctgctatttaataaaatctattaatatttagatgatttcttcacttctgaacaggttttctcattttgtgctaaactgtgttctttgttgctaaattcacaaaattaaatctaaaatactatggagagatgaatacttaaaaacatctgaataattatcttcaaggttacacaaccacctctttgtattttaagtattttagaaatggttaacttggttttgttcaaattattctctaggttaaaactagcgtgatgtgtttcataacagaaagttaatttaggcaacagcactgaaagcaaagaactcttcaggaaggtgactcttttcttatagaatagatagtattatcctaaaatgtttcccatgaaaaatgttttcccagtatgtttgagtgtactttttaaagattttttaaaaaaatatttaactttatgtaaatattttcattttaatttcagaattatgttactaccttagttaactctagagctttgagtggcttgtttttaacagactgatgtaattttggagttctttattgataggtatatgtgaacgtttgtttatttaacctgtatgttttgtacttcctatactggacataccattttattttccactggatttgagattcagtcttgactgaactattcactaacagttgggcaaattactttagttctctgggtttaagcctacacaccgataaaataaaatggaaaaaataacatctatctcttggggttataattaggattggagatattattaataaattgatgaattgaatacctagcacatagaaagtgttaaataactgatgattatttaaattggagaaatgttcaccatatttagaaaatattaaaacttttttaaacaatttccatctttctgataaatttgctacatttttcttcattcacctcgtgtgcttctttatttttttgcatgttctctgtttttatctacctaatttccccaagtttatctttgaacctggagttaccgtctcaccaatactatactggaagggaaagagattattccttaaaaggaaatcagtataccgttacaaagaagtaattgatgttccaaaaagaggcaagtatttgtcataggccatgtgtttagacatttctaaaatactataaaaacaggatctaagctgtagaaagtctttttctgattaggtagtttggatggcattcttttcttttaaaactcattagtttatggattttaaggaaatgtttgcctctttttttatttttctaaaagcaaacacttaacagtaaagacacaacctaaggaatggaagaatatgttttcaaaatgtacacctgataaggggttaatatccaaaatatataaggaactcaaacaactcaatagtaagaaaacaaataacccaactgaaaaataggcaaaggacctgaatagacgtatctcaaaagaagacatacaaatggttaatgggtatatgaaaaaatgctcaacatcactaatcatcggagaaatgcaaattaaaaccacagtgagtaccacctcacacctgtcagaatggatgttatcatgtgaccatcaatggaggaatagataataatatacataaacatgatgcaatgtaagtcatctttaaaaaagaaaatgctgttatttgtgacaacatggatagacctggaggatttttaagtgaaataagccaggtacagaaagacaaatgctgcatgatctcacttatatgtggaatctaaaaaagtcaagctcatagaaacggagagtataatgttggttaccagaggctgggatgagagactggggagctgctggtcaaggggtacaaaatttcacttagacaggaggaataagttgaagagatatgttgtacattgtgtaaataaaaatatactctatacttaaaaattgctatgagagtataccttaagtcttctcactacaaaaatatgtggagtaaggcatgcgttaaaaatagcatgttgtatatcataagtatatacaacttttagttgccaattaaaatttaaaaaacaaaaacaacatcatgatatattaactaagggagaattttcaaaaggcagaaaatttctgaaattaattataaacagatttttatatcacaaagtacatttaattatttgcagatttctcaggattccctggggtataaacctaacagcttctctttctactggcttccattaatatgttatcatcccatctttcagatagacatattttaggaatttttttccacatggcacaaattctttgatctaaatgcaagggcttccaaataacattatgggaggtttgaaatttgaaaatgtttttcaaagatcagtaggcttagaagaattcagtttaatttgaaggaatttattcagaccttatccttgtttagtagtgttatctctttaccttttcctatccctcatattacataaaagctaacacaagatgacattgaaaattcttaattcggtctcagtccactctttgagcccctaacttccaaactcccatatctcttcccatcaccccccgcctcctccacccaggcacatagttctttcaacacacacttcactgtttgctgtcttttaaatacactgtggatgccatgctttctgcctttgctcttactgttcatttagcctgctatagtctgcacatgacccagaaaaaacttgctatttcaccagcagaggccttatttatcctctacagatcaactgatcttttctgtgtcttcttaatgcatgagtatgatttaccatattgtagcatagtgttttttgggttttgtttgtttgtttgctttttgagacagactcgcactctgttgcccaggctggagtgcagtggcccaatcttggctcattgcaacttctgcctcccggattcaagcatttctcatgcctcaggttcccaagtagctggaattacaggcgtgctccaccacacctggctaatttttgtatttttggtagagacggggtttcaccatgttgaccaggctggttttgaactcccgacctcaggtgatccacccaccttggcctcccaaagtgctgagattacaggtgtaagcctctgcacccagcctattaaagtttttaactcatgcctggctcctttctagatggtaagcttcttgagagaagggagtatgtcatgttcatttttgtgcttagctcaaagtatttactcaataaatgtttactaaattgattagactatgaatggacttaaagaaactacatggtcagttgtatacataatttatccataacaaaaatataggaaaaaggggttctttaaaaatttgtttactaaatttccctcggcttactatctgatttccttgaggccaaggtgtttgttttgatgcttatttttatagtttcagtaaggaaacaaaagttttgtcttatacacagcaacaaagttgaatataattttaagacaaaagacattttcaaggcaaaaaaactacttgtcaaagtagttttcaattatagtacttggaatgaaaacattgaaagattaatacagaaagtcttagaagtgtttaatactccatagttttaaaatactcaccattgattattgtacttagtttgaaacattttttaatatgtatagacttaacctaggatcttgaatttaggcagcaattagccttttacatggacctgtttggaaagcattataaaataacagcaccttcccaaagaaagatgtggttgcggtaaaacttcactcatttgtttaataatgtttcaactgaaacaggtgccttacttgctttgttctccagaagcagctttatagatttaagcactgagtatacagtacacagtggcactattaacaaatcagaatgaggccaagggaaaattcatctaggatccacacacctaaatgcagttagtaaacagagacaccaactctcattaagcataattaaacctaatattgactgtaaactgttacttaccttaaacttctctatagagagtgtggaaagggattaacctagcagattgggacattaattactacctctttcacattagagttaccatcaagaagggctatattcataaataaaacataggagggattgagagactgaaaatatgtaaatttattttataaaaaggaatgaaaagtctaaattgaaaaaaaaaagtgagctgtgagtgatgccagcttcagcaaaatggagctctggctaattactacaaaaaaactaggcttaaataattatagaaatgtacccttgccttctgactgacagaacctgtttcacaagagactccagctcaactaagtacactatttttcatgcatagcttcctccactttcttaaactaatatggagtttaagagaggatgaagggacttgggagaaatacagtttttccctttttttctcagtcattaatagccttttatttatgaaattgattataatgactatataaatgttttttggtttgtcaacaagaaggcacagtgctgttttttgttcagtcaaaatggtccactaactggtctcctgctactatttaataatctccttcttgggtgcaatctaaaaggtatgttttgaaggatataaaaatgtcagctaaatttaagatcgactgttaagcttttatattatactgctgccccaagggggaataccaggatctaggagataagaatttaaagagaaaagcaaaataatgacaatacaaacttatctaccagccttagaatttccttcaaaatctatcgggctgtctgtctgcagtgagtgtagactgttatcttattacttgtttttatttcctttccagtaagggaccagatactcacatctgggtggggttacttattacttcaccagggtggggttctaatttttggaaccaaatcccatatacaattttgtgtatggttgttgtattaaaccacagtttaggtttaatatactaggctcttacctagattttagtgctatcatgctaaattctatctttcatgtgttcatgagcaccagaagaatatagcaactgtgcatgtggaaaagggagcttagaaagtaagcctggagcatgtattcatttttgtagtggaagtggagttcaattttaaaataaaacccctaatttttccctgaatttaatgctcatttcacaatttatgagactaacttatgcaacagcagtaattaatggacaaaaatctatccttcatttttcccgttgaacagaaatttgcaaactggttggatgacagaggatgaacgaaaacagtaagagtaagagtacttctatcctctgttcttgtaacaatcgtgacattatgaaataaccataacaatagcattcttattaatcagacatatttatacagaattagtgttggcttctgctctatattacctttagttttatatgaacttttattatctgtgcatatcaaaagagacatggtgaatgaacaaagaagccctgttatgagacaagtattatttgacattttgggaagctcttattatagggtttcctcttaggcaagaacaacgggaaggttgtcattagttgcactactacagatactctggatttttaaaaacagaaatggagcccacttttttccttgaagaagattcatcaattagaacaattagagtgatctgagacttccaaccgagacttgtcctcctaatgttcttgttttatcatgtgaaacaatgacctcataaggcatcttttaagataattgatttttccttggattacagagctagatagctgtatggtacccttatttttcaaagatgaataattatttttagacttctggaaaatctctgattaaaccaaaatgcagaagtcttgcaaggtctacaaccctactgcaaaccagatgccttttattttttgtattgaaggaggatagttctaagttcttttgagatccttttcctgggcttatgacatatttgactaggaattatggttaaaaaaaaaaaacgagtatggtgggtaatactgaatctcctcttaaaaccgctggacccacactttcagagattgaccagttatcatgtattttttttttttttacctgtagaaggacactcacatttcttcaaagaaatgtttctactctctatttccatttcttcaccaatccattcagcaattcaccttgtctgctgcagggacctccatcacttctccaaattaactctcactgggacctcactgagcatttgatcttgctgaccactccttccttattgcaatgctttcttcccttatttttcatggcgtcatgctttcttgattttcttcctatgctccttgtcatttcctcactatgtcctttgcaggcatttttttctgatatcctcactatgtcctttgcaggcatttttttctgatagctattaaatgttggatctccctaagactggatccaaagcacttctgatgatgtctagaattttgaatatctttgtaaccagaacacattgaaatgttttcagggaatgtattataattcttttaaggttcttgtttagggaccatattttaaaggccacatttatgtgaacagttttgtattctttatcactagtgaaatataatactcaacacatccccataggggagctcatgtggtactttttgttcaagtttgtaaacgttatgaaatcttcctgatgtctatatgttttaaccttgggcaattattaatcctctgtagctcagtttcttaatctgtagtacgtagggagtcatcccagctctttaggattccgtgatgctgtggtttgatattttactatttgaaaaggatagtgaaatataaatatgtgcagttgacactttgaattccacagtcaaaatttataaaagcattctctcatcatttccacttcacattttcttcctatatctaacatagttttgtgcttgtgaaaatatgtatttctaattccatgtttacccaaaatttatttgcacagttattgctatgaaactttctcaaaagccttttgaaaatctgaatagattatatattctagttactgcatttgcagatgcttctttaatgccacaagaagcctagatagagaggctcaattcaccaagtgggcaaaagcttttcgtgtatcttcctgttttatacatattcccactgtttgcctttggttacaaaggctgcttctaaaccccttttttgggggaatttggccacattgccaatctttcagtactttgtgaaaatggccattttaagaacaagttagtttttctgagcacagttttacttttgattggtacctatttgatgctagtgacttatctgcagctagctttttaattaagaaagacttttgtatttgccactgttttaaatctagactctctaaatttgtatgcttcaaaatatatttgaggcatgagagtctccaagtgtgtgtgtgtgtgtgtgtgtgtgtgtgtgtatgtatataaatatagatgtgtgtgtgtgtggtgtgtgtgtacatatatatcttttgtttttgacctagaacaactactgtttgaatttccttacttgttactagctgactgattctctttggcatacaaacaaaacaacaaaaaacaaaaaccgcatttggtgttggtgtcccttgcaaatttgtcatcatttttcttatttatttatttacttagttacttacctttccaaatatctaatgtcttttctttcttcctttggatattttttaactgtatactccagtgggcaatccacctggatttccccttagacattccactatgtgatctgccttctctcatatgagtgatcttttcattttaaaaatggtgttttctctcatgtttgttaattttgtcatttaaaagtaaaggaggatattcttcattccaattctcttttccctcatgtcaattttttttgtttattaacattttattgaggaaaatgtttgaagataagccttatacaacctgtgtggtattctgttttaaaaacactctttagtgtgtttgaggttagctgttcatctctaattgtcattagtgctcattaggggaagtgagaaatcacttcagtttttcttgggtttctggaaggaaagtagttgagacattcagagtatttgtgaattttaatttttggtcaccttaaaacttggttatatatagtttggtcccacactatccaggaataggaaaatttatgtgtgaaaatctaagtacagtgttatcacttctgggtaatttatgaattctagctatttctcctgaagtcttcaaaatgcctattattactttctttttctttctttttttttttttctgagacagactctcactctattggccaggctggagtgcagtggtgcaatctcggctcatggcaacttcttccgcttcctagtttcaagtgattctcctgcctcagcctcctgagtaactaggattacaggtgtgtgccaccaccctggctaattttttgtatttttagtagaaatggggtttcaccatgttggccaggctggtctcaaactccggacctcaagtgatctgctcgccttggcctcccaaagtgctgggattacagacatcagccactgcgcccagcccaaaatgcctattatttcaagctagggaaaggtaactaagatttttaaatccgtaagaaaaagactgtattctgctctgaataagaaaatctcacccactccagtgcaagtgttaattttgtgctccagtaggaagtcaccagctgatttttgtcttcattaaaaaatttttaaatgttgaactgttactagattttatggatgaggatagtagatggagcattatgaactgtttattactgtcacacaaagtaagttacaggaagtaagaaaaaatattacaaaataaattctttagacagtaatcatgatttctccttattggattttgcctggagaatagcagatccacaaaagagtaaataatcaacataaattgatagtgaaaattcctgaagtttttccctgaaaagggagcttgacaaagcaaatggctttacagctttaaggaaaatctcacttctgaaatgctgtgtattaataaacacagatatttgtgtagagacactcaaatggagatgagttcatttttagtacaatgtgtggggagtgacatgcatggaattccattaatagcaatgtatgttgtgttcttttcatttcattttgctaatgaatttagtattagattgatgggtgctaggaaaggaagacttaatttgcagaataagtagctggaacagtgtacacgtcccagataagagctatcaaagctgacctccattcatcctggaggacaaactctagatacaaaaggatacttagaaacacttgcttctcatcagatatgagttgagctagcaaccttttgtctatggattcatatttatctctagatggtgataactcctcctaggtagcatttaaaatgtgtggttgtcacgatgaaaaggaagcactactggaattcagtggataggggaaagatatgatgttaaatcctgccatgaatagctgaaattacttagaaaagagatttgcccagtcacaaagccaatagtgtttctgtagagaaatgctgttagggccataagatagatgttctttacggcagtggttttcatacattttcctaataatccacagagataaatgcatttaaatcatgacacagtctacatgcagtcatataattaaaacaaaatttcataagacagtatttacccttcctatgtgttgcattttccattctatcctctagtatctcatcccatcccatcctatcctactttatcttatcctattttatcttatcctaactttcctttaaagtctacagcccactatcttaatttcaagagcactgacagtgtgacctacagtttgagaaacactgttttagagctctttaaattttctggtgaagataggataaaagagaaaataactaaagagttgcctgcagtatgatttagtttccttataacctaagcagaacacaacattttcatgtgtaactattgtccaaattttgttttggaagaggtgtggacctgtatgccagcagtccaggcataaagcctaactgccacctttgccctctgttgccatgataatgagggaagggaaacagaaaactctagcccagctcactcacagaatttggatccaaaggctcaaagctgcctctatgttgctggaacagtgtacattgttgcgtattaggaaccatgtggcattatgtcagtatgaacaggttcactgagatgagagtgaaacactttgctcttcctgtcaaagtgagtcatccctaagctgttcgataatgatttggtatattaggcctctccgttacatgttgttgattgaggaaaatgcagagtcaaatagcctgcatgttttggtgtagtgcccaatttatcgtagttgtataaagttaaccaagattcttggatcctcaggatatttccagatatagcttgtcaaaatgtttgtaaatgcgtacttgctgatggcaagcctgccattataccttaattttcttcaggtcatccacctacttcaaactgaagtgattatacaaattaaatctaatctatgattcccagctgagggagggaaaggttatgttgaaaaaagcttccctagtgatttcagtatgtcttcctagttgaagattattattggcctatttccaggatgtctaccttgctgtcttaaagtctaagtcatcagaagacctgcagaacagggtttggtcacaaaggggtgaactgaatgtgggggattttccgctgtcatcttccttgtttgtgggttattgtcttgagtatttgtccacttgcttgactgaaaaggccaggttttaactttgtcccctgcttttgttgtgttgtcccagtgacaattggaaaataacctgagtagtgaattggaagtttattttgggggaacaagatcattcaattcagctcctgctcctatgagctgagtttgattagcatttttttgcatacttttgtcaatatagcatgtgtttatcttgtcgttagagaccttggtattattttcagtagtagaacatatttaatactaaatctttagcatgatatatgggtgtttcagatccatctattaattaaaaccatcactatttggcaccaaactttagatttaaacaattgttagacctagtatgtcacaaaatttgccttttccttttccattttcactaaaacctcctggttattttccacttatattgctctatctatgaaaagtggccatttctttaaaaacaaaacagaataaagtacaccccccacctccatttttttgtttgtttgtttgttggtttaaccttacccagaagaactgattccctagaaagccaaagtcagagaggtgatggagtggcagttgtttttccttttcctctttggagctatcatttctatttgaagatgatgacttaccatcatcttcccttacagtgagaaatatcttgcatggaagacatctctgtggatgatttcaaggttgagtactagagctaagatgatgagaacttggcccacttcagttgggcagtgtgaaaagaaacagtgtgatttttgtcagtctttagagagtggttgtcattaagtcagtaaagcaagatcagaagacctgcacaacagtgcagctaacaagtgaattcaattcaggggttaggaatgatgcaaacaatgtggagagaaaaagacaatttcgtatgtgctctgtaaacagaactcaggcaactgtgttttgtttatattgatcctcaaccacttagtgcatggatagatatatctgacttttagctagagtgttcaggtatacagcagaaggtgcagctatgctgtctctgtctactgccatttagtaacttgtccaagaatctctggagctggagttatcagaattctttcatatttataggaggtctaattgtgctggtttatcctgagttggtgaagggctcaaagcttgatctccaactttcagggcaccataggggcagtagtgcccttcacctcaggattcacctgctctttgtggggtagttgcatgggatgacacagaacttcaaagttctacttggcagacaagaagtttcctttagaattactattcaccactctgtgggcagataagctttgtcagcagcaatggcagctgcaagtgaagacacctttgtttacctttgttccttggtatcagcaagagaaacatggaatctacctagcttcataagatgttgttctagccagaactcaatgaagttttatgttcccctgatacttcccttggaagatgagtggcctctaacagtatttgcagttgagtgcactttaggtgccccaaaccttatcttagcttagaagaaaccagtgacaattcaactttcacttattctcagtgttctcattgaagcatgctggcactggccctgacacttaaactcacactgcttagtcgaatccttcttaaagtaaaaaacactttctcagataatgctatctaaggtaggactttcttactaatccataccatagtaccatgtttacttcctatttagcatattttgctatctgtaagagtgtgtgtgtatatgtgtgtgtgtgtaactaaaatagaaataagaaggacacattaaacttatttcagactcattacctgatttcttttaaggattaatatgtagtaaaaatctaaatatttttatagctacctacctaccaccttactgattttataagaaaatattggttttctgtttgttgaatcatttcacattattaaaagggccactttctgatttttgattattttcctaagcaagtaccacgtaccttttatataagattctaaagaattgataaatggggtttaaaaacaaatatttaaagcaaatattcagcttaactgaagtcaaaactatttggattacacaaatatttaaacaaagtaacaagcctgtttcataaaagtatgaaaactgcactttcacagtgagatcagcagaaattcatttctataaaactttcttttcagtttacatcttacaaagatttgacctcccccattctcagctttctgcctctgctgatatgacttatctctgaagaagtaaccattactcttacgaaaactgtagttggctatatcaaaaaaccttactcatgttaacctaaaaatttggtaaggaatataatctcttaaatgctgttaagtttctgaatgatcatatgctctctcttatgaagctaattttttcagttctgtttttactaattatatattagtctattactgagagaagggtgttgatatctccaaatataattgtagatttttccatttcacctttcagttctgtcagtttttatgtcttcatgtattttgaagctctgttgttagggcatacagatttagacttattatatattactggctaattaactcttcaacattatatgatgtcctttgtatcactggcaggtttcttcactttgagatctactgtgtccaatattaatatagccattccagctttattataattggagtttgcagcacgtacacttttcttcaaacctacctttttcattatatttgaagtaaatttgttgaaaacagtgtataattgggtcattaaaaaaaatccgttctgataatctctgtctttaattggtatatttatgccatttacatttaatgtaattattgttacatttgaattaatgtctttcattttatattttgttttctgtttgtttcttctgttttcctttgtttttcattttctgttttgttttgggttatttgaacattttttagcattcaatttaaatttatctattgttcttctgacgatatttctttgtatagttgtttttagaggttgttctaaagttgttcaatatacatatctttttatactcttcttagaatcaatattttagacatttaaatagaatgtagaaatcttacaaccatataagtccttttactctcccagttttgcattattgttttgtcatatattatatctacatacattggaagccccgtcagataatgttgtaattttgcattaaattgtcaaacatgttttaaagaacccaaaagaataatcgtttcttatatttactcataggtttatcactttttttcctcttccttcattcctaatgttcagtgtttatatcagtggcaatgttgtatcatttgtcttctgtctggagagcttcctttcagcaaatgttttagagcaggtctcttttatacaggatatagaattctctgtgctctctcagacctttaaaaaaggggtgccatttccttcaggttttcatggtttctgatgagaattccacagtcatttgaatggtgtttccctacagataatgtgtgattttctctggatgctttcaagacagttttccctgtcttcaatttccagcagttctattttaatgtatccagagattgattttttttttttctgtttggggtttgctgtacttcttgactctgtgggtttatgtatttcacagaatttgagaattttctagccactattttgtcaaataccttttcagaattataatcttagtcaattttctgctgctataaaagaataccagaaattggataattaatacagaacagacatatttatttggctcacagttctaaaagctgagaagtctaagatcatgatgctagcatctaacaagggtgatctcatgatggaaggcatcatgtggcaagaaagcacatgacagagaggacactgggccaaactattctttttatcaacaactcactcctgtgataactaataaactcccacattaatgacattagtctatcttacttacctcttaaaggtcctgatactcaacactgttacaatggcaattaaatttccacatgagatttggagggggcattcaacacatagcacactctttcttctctgcttctgttaatataatgacatgaatgctagacttcttgttattgtcccacaggtttctgagccactttttttctttattgctcatattgcataatttcagttgatctatcttaaagtttattgactgttttctgtattatctttattttgttggaaaccatccagtgatattttgttgtatttttttaaaattttatttttgagttttaagcctgtttctcattgcttgtttcagcatttttagaatagtaaatttaaagtttttgtcaaacaattccaacatctgtgtcattttaggttttatctccattgattatgttttctcatatgagttcacatgttcctagttcttcttgtgcctggtgatttaggattatttcttagatattcttaatatcatgttatgagattctgagtcatattgaaattctatggagaatgttgacatttttgttttaaaaggcaattgacctggttaggttcaggttgtaagatacaagattccttctgtggtttcaatatcagttttgcttacggtgcttttcaggtctgtcctgtgtgtataccagtgaacaatcttggatgtagacattggtctatctgttaatttcattcttaattgtattcatatgctgattaacatcagatccatgcatgtacagctaaagatgagcccagaattttgtaaccctataagatcactttctgcagcccctttttctctgtgctctcattagtattttttagttttcctggagctcccctttatgtcctccagccagcaagctggggctttatttacctcatatgcacatttctgtgactatgcccatatttaaggctaagtagcaggaaaacagagaaaaaaaaacaaaagcaatggaaattcttatggtcgcaattgtttttaaagataatttttaaatgaaatattttagtgcaggaaaacagttacaaattcagaaattataaaaatataggtaagtgaattttcacaaagtgaacatattcatgtaagcagcaccagaccaataaaaaaacattagcagaccacaaagatccctttatctatctttccagtctctacttcctcaggataaccactatcatgacttctaatattagtttatttttgaaaaatatagaaatagaatcatgtgattatatattcttctgtatgtggcttcttgtgctcacattatgtttctgagattcatttatattatgttgcatttacatgtgcttgcagattttaaaactattttattgctttataatatttccatgtattaatataatcacaattctattattattattttcagctcttctactatagatggacatttggcttatttccagtttgaagccattatgaattgtggtggccacatgcatattctactacatgtcttgttttacatatttaagcattcttattggatatatgctgaggagtgatattgctggtgtgcttatgttcagctttagtagatagtgccaaataattttcaatgttattataccaatttacatgatcagtagcagcacagtaatgcccctcccacttgattcatgatttcagttttccacagtttcagttatccgtagtcagctgcagcccaaattttatcatctcatatcatcacaagaagggctcacccttaagtacaaaaagatgttttgagagggaaatagagagagaagaggagggagggagaccacattcatataaccagtatagtgctagaattgttctattttatgattaagtatgttgttaatctcatactgttcctaatttatacattaatgttaaataaattaaatcttaaataggtataaatacgttaaatcttaaataggtatttatgtataggaaaaaaacatagtatttgtaggattgggtactatttgcagtttcaggtattcactaagggaggtggagtgtattccccatggataaagggggactactgtataagagagatcctattgttctactcgtcgaaaacacttggtcttttttcattttagtttttcaggcatgtgtgacatggtagcccatgatatgatggctttggtttgcatttctctaatgattagtgaaattaagcgtcttttcatatgtttattttccacttgggtatcctcttttgtgatgtgcatgttgaaaggtattgtccattttccagttgggtttgtttctgtttttattattaagttactgggatttcattttatattctgatatatacttctttgtcagatatacttattacagatatctacttttattctgaagcttatgtttttactctcttataattgtcttttttttcttttttgagacagagtcttactctgtcgcccaggctggagtgcagtggtgcgatcttggctcactgaaaatttgcctcctgagttcaagcgattctcctgcctcagcttcccaagtagctgggattacaggcttatgccaccatgcccagttaatttttgtatttttagtagagatggggtttcaccatgttagccaggctggtctcaaactcccgacctcaggtgatctggccaccttggcctcccaaagtgctgggattacaggcatgagccgccgcgcctgaccttatagttgtcttttggttacaaaagttttttattttaatgcacttcaatgatcaatttcttcttttagtgttagtattttctatcctgtttaaaacaaaaacaaaaaaatggaaaagcttttgcctaccttaatgtcataaagacatttcctttgttatcttctagaatctttattgtttgccattaaaatgtaggtctgcattttacctgaaattcatttttttgtgttaggtgtgagatgggggcaaggatggacaggattcattttttctttttaaaaaattgatcaagtgccatttgtcaaaaatactttccctgagtatgttagcaataactttattataaatgtactgcctacatattcatggacatatttctggactcttattccaggaatctatttatttacccttgcatcaatgatgcatgactaagtagtgaacatttagaagaaatcttaatatctggtagtgtaaatcttttagctgtgctcatcttttagattcttttagttagtcttgttcctttttatttccataaaaatgttagaatctgcttgttaatctctacaatatgtaatttgctgggattttgattgagatggtattttgggaatactgatatctaatctataaatgcattataattcatacttattttattcttctttaatcagtaatattttatagttttctgcacagtggacttgcatactttttgttagattcatttctacaattagattttttaatgctcttgtaattggtatcattttaagttttattttctaaatgtgtattgttactatataagaaaacaattcatatctatctatctatctatctatgacacagagagagagagagagtcagaaagagagaggagagagagagattcaccttggccaggaatcttgctaaatttacttattaattctattagactttgtgggttcttttgaattttttataacacagtcatgttttctgtgaataactacagttttatttctaccttttcattccatataactttaatttataagtgtttttgacttgttgcactagctaggaccacttgtgtgcactagctaggaccactagtataacatttgttctaggtttggtttttgcttttttgaaaattgtaaatttcctgtatccactagagaatttctcttcaattcgtgagtttgctgagttggtgttgttgttttatgtgtgtttctgtgttgtctgttttgttttttttttaaatcataaggaatattcacatacatttctggatctattgagatcataggatttttgttatttaattaatttatttttgaatgttaatccacccttgcattcttagaataaaccctacttgatgttatattatccttttcatagagaatttgattttcttaatattttctttaagatatttctatttgcattcaaaagagagattagcttgtaattttaccttctcttaatgttcttgtcaggttttctttgcatagttatattattctcataaaatgagttcggatgtattccctctatttctacccttggaagagttgtatatgattggtgctatttttttttcattaaatttttgaaataatttacctgtgaaactatttgagtcagaaagttttgtggaaagacttttttattttatcttttatttgtgtaaaattatggtgtacaattgtaattttgttacatagatatattgcatagtggtgaattcagagctttcagtgtattcataacctgaataacacacatagtacccattaaataatttctcatatccacccccttcctcctcacccttcccagtctccattgtttatcattccaccctctatgtcaatgtgtacacattaggtagctcccacttataagtgagaacataggacatttgtctctgtttctgagttatttcacttacaatagtggcctccacttccattcttattgctgcaaaagatgtgattccattcttttttatagctggatagtatcctattacatatatatttcacatttttaatccaatcatccattgatggacatttaagttggctccatatctttgctattgtgactagagctgtgataaacatatgagtgtaagtatatttttggtataataatttctttttgggggtatatacccaatggtgggattgttgggttaaatagtagatctatttttggttctttgagaaatctccatattgttttctatagtgattgtagtaatttacattcccaccaacagtgtataagcgtttccttttctgcaattgcttgccaagatctgctgtttttggtctttttaagtaatagctgttctgagtagtctgagatgatctctcatcgtgattttaatttacatttctttgattagtgatgttgagcttttttttttatatgtttcttggccatttgtatgtcttcttttgaaaaatggctattcatgtcttttgcccacgttttgataggattatttgttttgtcgttgttatttagtttgagttccttgtaagttctagatgttagtcctctgtctgattgatagtttgtacatattttctcccattctgcaggtcatctgatcactcttgattatttctatttctgggcagaagctttttagtttaattaagtaccatttgtctgtttttgttttggtttcttgtgcttttggtgtcttattaatgaattctttctctagaccagtgtccagaagagttttccaaatcaaatattcatgtcttttaaaagacgtagtactatgaaggatttccatttcttcttgtgtccattttggtaatatgtgtttttcaggggatttatatgtttcatcaattttttcaagtttattgatgtaaacttgttcaccagatcttattatctttgtactatgtctgtagcatctgtaacaatactccattttttcattcctgttaaggttatttgtcctttttcatctttgaaatttgtgtttctagaagactactgcttatatttgtctttctttaccaaaagaccccaatttttgacttttatcaagtttatctattgctttatttgaaagtatttgatgtattttataatacttatttgttattaattttgagcttaattcaattacggtcagagaagatattctatatgatataaatactttgaaaatttattgaggcttgctatatgactcagtttaaggatacttttggtgcatgctctatgtgcacctgcaaatatgtgtactttgttgctattgggtgcaggattctgtacatataaattagatcaaatttgctaaatcttggtgttcaaaacttttatttatctaccaactttttaccaagttctatcatttactgagagaaatatgtcaaaattttctaacttgattgtgtatttgtttatttcaccttttagtttggtcaatttgtacattttaagcttatgttattggtttgtacaaatttggaactgtgatatcttcctagtagattaactagtattatttaatgctcttcttgtactatttcttttcattctacttagactgatattataatgtatagtgatattagccttcttttcgttggtgtttggtaaattttttttagcacttttcctttcacattttctgtatacttacttttaaggtatgtgtcctgcaaatagcatattattaatggtgatttttaattcaaagtctgacattgtatttcaatgcaactttttaaatttacattaactgcacttgctaatatttgttgatttaattctatcatcttactgtacttttctattttttctaccaattttatgtttcccatttcttctgtcttaactttttttattaatcaaccttgttatttcatttgcccctcttttaacttgctaattacgtatttttaatttttcttagtggttaccctaatgagctctactgtaacttacaccttttatctcttttcaatgaataattatatttgtccctctctcattttttgtcttatcattgtcctgaattataattcttcaagtgctctaattcctaaaacattatttttattatttttctatacttatacgcatactaatcttgtctgtgtactttattttttgcatttctctatcattgtctgagatgcttttccttttacttgaaagatacctattagtattctttatagtatgaatctttcggtgaaatatttccgcagttttgtttttctgaaaatattcttattttgactttttaaaagaatactttcattggttagagaattctacgttggtatttacttttttgtgtatatatatgttttgctttatttttattttacttttgattgacaattatatatatttatgagatacagtgtgatgttcagtatatgtttacattgtagaattaataaatcaagctaattagcatccatcacctcaaataattatcgtgtttttatggtaagaacatttaaagtatactttcagcagtttcaaaatatataatacactcttataaattatagtgatcatgctgtgcagtatatctctaaaacttattcctcttgtctagctgaaactttgtgctttttgaataacatctcccctttcttcatcaccatccaacactcagcctctagtaaccaccattttactccctgtatctatggcctttttggatttcacacttaagtgagatcatgcagtatttgtctttctgtgtctgccttatttcacataacatagtatcttccaggtccacgtatgttgttgtaaatgacaggatttctttattttctaaggctgaatattattctgttgtgtgtatttaacacattttctttatctgtttttatgctgatgccacttaggttgcttccgtatcttagctatcgtgaataatgctacgatgaatgtgggagagcagatatctcttcaacatactaacgtcagttcctcaggatatatatcctgaagtcaaattactggatcatatggtagttatatttgtagtttttgaagaatcttcatattgtttttcataatggctgtacccaatttgcattcctaccaacagtgtatgagagtttcattttctccaaattcttgccaacccttactgtcttttaactttttgaaggtagcctttctaacaggtgtgaggtgatctcattgtggttctaatttgcttttccttaatgattagtaacgttgagcattttttcatatatctgttgaccatttttatgtcttcttctgagaaatgtgtgttcagatcttttactcattttttaatcaggttatttagttttttgctgttgtttgggtttcttaggttggtagttactttttaaaagcattttaaagatatcatggctttgttctctggcttcaattgtttttcatgagcaatcagttatcagacttactaatccttacaaagtaatgcatttttatttttctggctattttgagattgcctttttgattattgtttatttttaaatagttttacaaacaggctttttttttttttttgtagttggtttctttgtgtttatcctgcttggggttcttagacattcttgaatttgtggcttgatgcttttgccaattttggaaaattcttggccattattgctttgaattttgcttctgcctattctccttaccctttccttctgggactagagatatttgtatgttaaaacattttttaaccatgttctatatatctctaatgcttcttcttttattatcatccttatttctctctttgttttattctggatattttctattaacctattttcaagttcacaacttggatcttctgttgtgtctaactggctgcgattgagttattaattttgttttatttttagttctagaataatctttgggtttttaatataaatcccagttctctgattattctcactcttttcctttacctctgaaaccatatttatcactgtttttaaaagactatatctgataattctttaatctgtatcatttttgaatttatgtttttgtctattattttttctctttgttttggttctttgattctacttcctagcatgcttgatgattttttcatattaaaaatttagagtgttttgtatggtattatatttttccatggggatttaattttctcctcacagattattagaataaaggtaatttacttaatcttatcagggattaagacaatttgaagttgggtttccatctttgtgatggctactctagttatggttttcccttagttttataaatagtcatttagaggttcaaataaaattttggagtgcttttcaagtagtcactaaactccagtttttgcttcgttggtataagactactgaatattctttttaatgtcctagtatttaggttgctgttttctgcttgtttctcttttgattttctcactccaagaaagaggaactggaaatgttttaggggttaaaagtggaaaaagaatacaggcctcacctcattgcatttacagtttatccaggatcttgattcttcatgtcttggctgtgctgacagctccaaagtgttatttgtgccctcctctctttacaagacttcttaatgttctaatctggagctttgtgctcagtctcgcattctgttctacttaggaaacagcaaatgccttgaatttgaaaagtaataaacaacatagggcttactttaacgtgtttacttcctttatagactattgagttttaaattgaaattactttggttggtgcctggtgccttcaaacagtttttaaaataatttcattttattcatctttaatagtttttctcaacgagggggtgatttgatataagctactctatcacagtagaactggagttcttcttatgatgctaatttgattgacatgatatttgagggagggtggtagttgagcactatgtttctttacaaagtaacttctgcagacatacctccttttccatatgtgttttatactcccctctatatgaatttcttacaaatatttgaatgtatatattattctttaagtatttaagagtacaaaaagtttatttgccttgtataaattgattaatctttatttgaatgcttatagtaatttctctagccaaaactatactgttctgatattgaaaaatcaccaaaaataacattatttataaaagacagttggttatccctgatacaaaggaaattttgtaatttacatgattacatgcattctgagaatccaaataatactgatagactaggaggctataacgaaattatttattaaactgtgactaatgcttaactgtgtcataatggtgctaggttcctttcacaaggggtaaaggaatttataaggggaagtcagtattatttaaaaactctgatttatgtatatcttgtgatagtagtgaataactaggcatagacagtacttttgtacatggggtataaacagttttcaaagttattttgatttgttaatttttttcctgaaatattgtcacctccctgggtaatgtgataaaccatgtgtaatgtaatatttggttagtaaaacaagcatcagcagataaatatcagtgtttgtcttaggagatgcaatactggaaacctggataaaacgaaacagttttaataaaacttgaacagtgtggacctgggtaaacacacctatttggacaacgtagagattgatttattgttactaacaatctattatattttacattggtggtagtatcaaaagttaaacactttctgaaacaacaaatgaaaaataaagaaaactaccaatttattattccagaagctatagagtctttagatatcttttgacttacattcacttttgccctgctcatcagagacatatctttttttctaacatctcaattgtttattacatgcccgcttaccaggtgtctgttatggttggtgaaaatttacggtcctaagtgtgttttaacagaatttaggaaaacattgcaaatcatgaattctattgatttgaaagcattttaaaaacctgaagtaggagtctagctccagttaaatgttattgttgggtcagtctcttctttgtactctaattttctctttcacaaaatgggacttgtaaaacatttatgttagtttctcaaagtcattataagaactaaatgaagagtagtatgtgaaaatcttttcccaaggtaaaaactgttatgtaaaggtagcagattattattgttatccccatcattattagtgctgattagcagatgactttagccctgcacagatgcatgaaacagttttgatgaaacttttctctagttttccaggtgataaatatgaggtatgccctcctgtctgtaacttactgacatcctttgtatttttatttttgttattttatttctttttaaaaatgacaccaaattcgctctgtggattttaggagatcaatctggtaacgggcttggattaattccttcatcagtaacaatgagttataaattcagtgaatttaacaaaccgggaaaggattccatcttattaagaataggcaacctaaggtccctgaatgcatttctttcattgttgagtagaggagcaataggctcctttggaacaaacttactgaattataaagaggaaatggtttatccttgaaccattatgaaattcaggcaatggatgatatttacccaaggccaatattgtaacataaaccgaaaatactaactcctttaaagcaatgtgcattattttaattcatgtaatcattaaattaattacttacagatcacagatcatttattgatggattttaaaggaaaagaaatatgcataagctgaataagaagattaagaagataggtatgcattatatcagaatgtccttcaaatagacctggaaaacacgtttgtctaattagggtgcatgacagcaatctatgaaactagttcttttaagtaaatagaggtctaccctgagagggtttggcaaactatagtaggaatgggatactttccaaaaaaaaaaaaatcagaaatgaatgaataattcctcctttcttagtttatatgaattaatcaaattgcaattacattgtcacttatgtgcatagtgaagagagtctgaaaaggcaatgaaatgcactgtatttaatggacaggtatctttaggacatgggacatatgggcttaaattatgcactttctataaacaattctagaatagagggccaaaacataccctttctcattttacactgtgacctttgatttgcttgcacagtacctggcatatggtgactctcaaactgtttaatcacatgttgaaaaaatgaatgcactagtgaacacatacttacatacacagaagatactccttacaatgatggtgaaacacctatactgaatagtcatagaagagcatatgaaacatcagttttcatttaaaaacccaatgctacaatgaaaataaaaacattcccttttcctttcccatctttggctttgttcaatgttatgttggagccatgaagctgttttccagaatttgtttttagagactgggtcttggtgtgtcacccagcctggagtgcagcggcacaataatcactcactacagccttgaactctgggctcatcgagtaatcctcctggctgggcctcccaaagtgctggtattgtaggagtgagccaccacacctagtcccagaattattaagacagtattcttcagatatttttattgtcttctttgttttctcttctatagcttcatatttcccctgcttacttcgactctaaatcattttaactattttgcttttttgcctttttattttgaatgcttccttccctcagctaaaggtcataaattttaataaagaaaatttggaaaattcaaaaatgcaaaaaaacttcctattactaccatattggtttattttctgccagtcttaaaatatgtatcttttcaaagcttttaattttaaaagttataccatattttatctctattttcaattttacttaaaatataagttttccattgtaatagccacagcatttttggtaaagtagacatactatagctgcttaatcaatccttatgcttggacatttaaattgtttctatcctttcaattattttttaaaagactgcgatgagcatctttgttcataaagctctttatcattattattttggtatttagattgcttccttgagatagattcctagaacgggaataaaatcatatgtatacaagtgtctttctcagctctgttttcaagaggagcttttgtagagagcatagataattgacagcctccagctgctatacctgtggatccaccacaacattcaccctgaaaccatccttctttggggctgcttccaccgagtgactgaacatgtcaggaataccagaacggggacatttctgcccaatactagattcttctaatgggtaactctggttcagggactccctaccaacatggctgagactttcttttttgtatggtttaaggaataatgagaaggaaaaaactctgtacatgttcagtacagatgcaacttctttttctagaattttttttttattatacttttaagttctgggatatgtgtgcagaatttgcaggtttgttacataggtatacatgtgccatggtggtttgctgcacccatcaacctgtcatctacattaggtatttctcctaatgctatccctcccctacttccccaccacccgacaggccccaatgtgtgatgttcccctccctgtgtccatgtgttctcattgttcagctcccacttatgagtgcgaacatgcggtgtttggttttctgttcctgtgttagttcactgagaatgatggtttccagcttcatccatgtccctgcaaaggagatgaactcatcctttttatggctgcatagtattccatggtgtatatgtggcacattttctttatccagtctatcattgatgggcattaaagacttagacgtaagacctaaaaccataaaaaccctagaagaaaacctaggtgataccattcaggacataggcatgggcaaagacttcatgactaaaacaccaaaagcaatggcaacaaaagccaaaatgacaaatgggatctaattaaactaaagagtttctgcacagcaaaagaaattatcatcagagtgaacaggcgacttacagaatgggagaaaatttttgccatctatccatctgacaaagggctaatatccagaatctataaggaacttaaatattttattttatttttattttttttgagatggagtctcactctgttgcccaggctggagtgtagtggcacgttctcggctcactgcaagctccgcctcctgggttcacgccattctcctgcctccacgccattctcctgcctcagcctcccaagtagtcccagactacaggcgcccaccaccacggccggccaatttttttgtgtttttagtagacatggggcttcaccgtgttagccaggctggtcttgatctcctgaccttgtgatccacccgcctcagcctcccaaagttctgggattacaggcgtgagccaccgtgcccggccaggaacttaaacaaatttacaagaagaaaacaaacaaccctatcaaaacgtggctgaaggatatgaacagacactgctcaaaggaagacatttacggctggccgcagtggctcactcctgtaattccagcactttgggaggccaacgcaggctgatcacgaggtcaggaggtccagaccatcctggctaacatggtgaaactctgtctctaataaaaatacaaaaaattaacaggatgtggtaggatgcgcctgtagtcccagctacttgggaagctgagggaggagaatcacttgaacgcgggagccggaggttgcagtgagccgagattgcgccccggcactccagcatgggcaacagagcgagactccatctaaaaaaaaaaaagaagaagaagaagaagacatttatgtcaccaacaaacatatgaaaaaaagctcgtcatcactggttattagagaaatgcaaaccaaaaccacagtgagaaaccatctcaagccagttagaatggcgaccattaaaaagtcagaaaacaacagatgctggagaggatgtggagaaataagaacgcttttacactgttagtgggagtgtaaattagttcaaccattgtagaagacagtgtggcgattcctcaaggatctagaaccagaactaccatttgacccagcaatcccattactggctatatacccaaaggattataaatccttctgctataaagacacatgcacacatacgtttattgcagcgctattcacaataacaaagacttggaaccaaccctggctgagactttctcaggactttcctgcatgcagatctcttcctaccaaatgcttccttgcctttctcctttcagagatgtcagaattgcatcatagtctgagtgctctccttacctacacctcttcccctttatcatgtatagattctaccccaaataattatctcacatacccaattcaccttggcacaagaggacccaaactggcacagtacataatcatgattcaggcccttgatacatagtgcttaatggtactaatgtacactcccactgcagtgcctcttccaacactgaatttttcttttattgactttaactgatctgataggtgaaagactagtatctcacttttaaaatttctattaccttcatcactagtgagattgcacatgctttgttttccatttatatctattaaaatttgttttactaatttatccattcattaaaaaactttacttataattaatagttataattataatacttctttttgtggcatttttgaccgtgtatttgaatgagggtctcattcaatacttatctaccagtgtttggagtaaagtatgtatgtggaacaaatgtaatgattactcatttactcaggctaaactaaaaccctggatggtatttatgatttgccagcagcagtagtggcagaatccacatctcctgactctcaggaaagacagacagttttaacatttctgtaattatattgcatacgtgtgtgtgcgcatgcatgtgtgcgtgcatgcatgtgtgcatgcatcagtgtgtgtatgagtttgcagtgtttttccaatgagaggtgaagcttaaaattccttaagttgtattttattaatttcttttaacaatcttgttttttttcttctgtatttcctccattattgtgtttcctccactattgtttttccacctttatttccaaggtgtcctgatcatctgattcctatcaggtatttaaattatgcaggtgccagtctctgtgtccccaaacacacatagctaatcaagaataaagccatttattgtaaatttacctctagaatgagcccccctttctctgattttgaggatggatagatgctcattatgatctggtaggcaattataacatgcacatttagagtgtagaagagtactctgtgttaggtgttaagacttttattttactcatttaaagacaaagatttaaatgtgcttgtttaaattcaacaagcccttagagccatgaggccttgggggtaagaggtgcttaaaaccaaatagcacaggagctgaagaagtaattatatgccagattgaagatggagctgaacaaagactgagctgatctgggaacaggggatggcaaactgaattatgtcccaggtatccacaggccgagaaagcagactggaaaacatgcttcttcatacattttaccaaagtttacaaaatgcagtaattttcagatggtttactaatcttatttacccttcttttctgcatttttgctttaacctaattttttttaaaaaagaaaatcttaattggaaggatgttttgagtcaagaatacgacacttcataatgtaacatatattctggattcaaggtggcaggtaataaaaaataattggagtggaatttcaatgtctttatttccctgaagaccagccttgaagagcttcctcaagtgtgtctcctcttcctaaaggtaacatggtggggaagggagaaggtaggaattactctgacaagattttagttgttctaaatcagtgtgattaattttatcttaaagacttaaaatgtcccatattccctagttgccaagaacatggtagggaggaggcaaagtacacattctttgtttcaaagtattttgcagacagtctggtctattaagaacaaattctaggactaggtagtagggcttagaagttaccatgacccaaattgattttttcatttctcttaaagttgatggttcattttttgatgaaagtagcaatcatatctataaaaaccaattttgataggcctatcaaatctgaccataaaacagaaagctattttacattctacaaacatattattaaataagctcactgtgagtatacaagtactgtatgcatttttacttatgaaaatctttttaaaactgaagaaattttgaaacttttgtgatgataattaacaattatatgttaaaagccagtatggaagcctattttgtcataacattataacaaggcaacaagttttaactgaacaatggattcctgagcttctaagcaaatgcattttgacgtgttatttttcactatatgcaaatttagaagagactcagtttatcatgacctgtatgatacctcttagaatgttaaaaagaaaaaaaaagatagaaagaggaagggccacagtacacataaatcttgcctgcagcttccactaaagttactctggaaagtaacttaaggaaaagagatgattaattaatttatttaaatttggtgctatttgttaatccacagctatgttctaggcacagatactatggttcaaaaatatataaggcaaatacctgatttggaggagcttattttcagtgggaggtaaaggaggaggaaaaggatatcagaaaaaggaatgagcgatttcagaaaagagcaaagtgctgtggcagaggtaagcatagatttgaggaatcgtgggcagcaaagtaaagaaggctttcctgaagaggtcgcaggtaagtggaggtctaaaagatgaagaggactctgccagggcagagtctagaaatggggaaagttggggaaggtacattttaggcagtaggaacaatgcttggtgcaaagatccataggtgtagggtttcaacagatctataactcgatgagattcatgcattagggacctaagagagacagaaaagggcaagtacataatgggttcttgtattctaaggtggggtattccagagatggagaggtgctggattaatgctgcatttaccttgaccctttcctgtggtattagtagggaaggaaggaaggatgattctgaatgcagtgcaatggaggtagcaaaaaattgatctgatgacctttattttctcattgggatagagagcatattgctttgctgataccgaagggggaggggtaggtggaatagaagatttaataaaagtgggaagttttgaaatagatgtaaaatatactaaagtaaacagatgattagggaaacttggaaggattattaagtaacatttgggacccagctaagtttgggagctgtagatgtgtagtggttataatctgtgagtgtatgtgacccactttagctgttgcagttctaggagtggagaaagcagatagctggactgctctaggcctgggttttcacctatgttgacgctcttcctgtttccttccaccactcacctcttgtcacagaagactgcttattcctgatactgtgactgtctgcctgaaggcattttttgtgtgtggctgctgagcagatttggctcacagtgttgggcaggcttaaagtaccaaatagttactgtcactagaaaaagacttaagcaaataactgttagcaagtgggtggattacactatcatccttacccttcacatgggataactgtgaggcatgttctttactgttttccagagtatcccagaaggactaaactcatttcccatagcagtaacttgtttaataattgtacccttttttggctttgtccctgtttcatttatggctgtgtaacaaactacccccaaatacagggacttaaaacaacaaagatttgttattttttacaaatctttggggtgcccaggcttagattagtaatagcttgggtcactcatgtagttgcacttgactggaagcctgtctgggtcaggaatgactatgatggctttacttatgggttttaggcctcagtgcaatgtatagaatggctggggtctgtctgggcctgtctctccccattgcttctcatcattcactaatctagtctgagcgtctttacatggtatctgcatctaaggaaagcaaaagaagaggctgccaggactcttgcagccttggcttagaactagcatagcatcacttctgctgcaatctattgttcaaaaaaagggtgcaaggtcagtgcagattcaagagtgggggaaacaaactctgcctcttgatgggaagagcagcatgctagagcaaggctttgaggaactattgatggttatctttgcaaacattctatcttatttcccttttctgccttccatcctttctcccttaccagtgtttcatggggttgtttccaaaataaattatttgtactaaaattctcatcttagatctgtactaagacagcttggtaagtgagataggaaaaccaagaagtgaactgaaagtatttctaagaaaatagagtgatgacttatgtatgggctctgtgctgggtgacaaagacaatgtaaaagaaattgcaagagcagaaagctagagaggcctagggattgataatatctgtgatgtcaaacaattgtatatgataagtttggcagggtgagaaggctggtaggaaaggagactatgattctaggtccagcagtggcagaatgtaccttgggagactccaagaagcagaaaccatggatcaaagacaagattttgttgatcagcctgtggacaggctactgctatcaccttagtgaggctcaccatttttgaaataaattctgtggattggatattaggcaaacactccttcagcttgctgtacaggttacaggtggttacaggtgatccataaccctacatctgaagaggaggtggccattaacacaatcagtgcaaaggccctggcaaagtcaagttgcccagaaacagcttcagcagaatttcctgcctaccagatctttattcctaaaaaaattatacttttaaaatctaggacttcaacaaaaataggatgtctaggaatgaagaaaagcttcagagtcagattgcaatcaagttgtgctaccagttaggtgacgtgtggcatcacaaaagcataaggattttcgaacctcacttcttttttgtattatatggtgttaatacccatttgatttaatttaaagtttttgtattatttaagactttcaatgggtgcttgcagttggttgacatttttgaaaaaatcaagttgtaaacttttattacaaattaaaagtgaagtgcttaaaaatctcaacttgacatatgaaccaatttaaaagcttttaaaggcatgttgagaaaaaccaaactaaaaaaaaaacacacaaaaacaacaacaataaaaacctttgttattaccaaaaagacatgtctgtaggtaaaaataattttaaaaaccccatgcttcgtagataatgcaggtagttctggtttctgatcaatgggcaaaaagcaagcacttaaggtcttcagcatttctttcctgcatttctcattgctgtaatttcatattcatttcttcttgttggatgattaaactggatgatggtggagatggtaaaccggcatttactcaaccttcttctgcctcgggtgcagaattcttgactggtggactggctgctgttgtctctttgccatgttgtggtttagggttttctgggagtctacatagataattggggttttagcagcaccgatgttgaggtcgctgctgatattgggtctcatcttgattttctttactctcttcactgccgtcctctctaggctggctttggcgatgaggttccctgaggaatcgtggtctataaaccatacaaatatcctgcctcactggcctaccttgtgctcctgcaccccagttgttagcaccctccgtcgctgctccctgcaaggagggttagaatatggtggtcaatttccgtagggtctctgcctgtagtaaggcaggaaccttcgcctgcagcagggccggcattgttgggccgagcctaagggagcactctcccgtccttcgttcttttctccactctcactattctggtaattctactggtaattgcctgaggaccacatggatagcgtcaatgatggttaaggtcagctgcatacttactgctatcaactggactctacaggggcctgtaacatttactgcctccccacccttttctgctgcaacatcatcaaactccacagtctctccgtgtcctacactgctaaggtacttcctggggttactcttctgtatggtattctgctgtacaactgcatcttccttggtgccattcgcatagatgaaaccatttatttcttacattgaaccattttactgttcccaaaatcttccttgcggtgatcttatccccatcagcaggcgccgcctgtgaggtcgcccttgccactgctccctgcgccgctgcaggtggtgccggcttggggttggctgccttggcgtctttgctcagggttgtggttgctgtgatggtgacctgctggctgcagggttgtggctccttctggggtgactgtaactaggccgggggcggtggtggggctgctcagggctctctgggttccgctcgccgctcctgctaccgattgaactcaagtttcaattaaataataaaacattgtctaagtgcctagcacaaaataggatataagggaatattatttcccttttttcatttttttctcctttataaagtaagatttataaacaagatataaggtacctcgtctttctgctgttgtagcttgtttctgaagaagcgcagcacatgtttttcagtgtaccgtgccctggtgacctaaagttcgctccgtttcccttagctcttactcactacttagtagtcacttagtagtgattgcccaatcttaggcaatgtggtgttttgtttgttgtttgtttgtttgtttgtttaaatggaaggcaggatttatttgtgcttggaaggtatttggcattcatatggattttggcaagaaacgagcttcatctgaactctgttgtactcttattcattttgttaaaactgatattcaaatgattagagttatattcaagtaagaataagggaaacttctactatataatttatgtttgtagaattttgtgaatcgtaaattaaacttggaagctcttggctaaagaatttgtcttttcatttcaaaggaaggagttaaaatacttattcttgttattagcctgatgatagattaattcacttatattgccttttcaaaacaaaatgaagaccagtgacacccaattccaaacatttcacaattaaataaaacgatttagaaagcatgcaactcagtttgcacatatgaactatgtaagtacctctttatgtgatagaagttgtaagtaggaactggaatgtaattttgtccttatcttcaggtttaatttagcctgccagaatctgtagactggtagaaattattacattttatagtaatttccttttatattgacatgatcatgagatgggaaactagaagaaattcagaattccttcatctatagttaagctcttgctgtgttgtcatcttggaattcccttcttcccacagcagaatactcacttcctttctctcctttctcacctcccccagttgcacagaatcacccttgggtcctggccttctgcccagtagttggaccctattttccaggtaggaacatattgaccttcaaccgactgctagttttctaggtccacctctctgcttctgttttttcaggctctcttaaccatgtagtagtcttttcttccctggatagcactgatgcactgcatactgtgtagttggccacctcctgcagtgtgattcgaaatagcttagtgccctgcagggagcaaggcctgaggcacaggactttctgtgtccctctatcatagtacttacctcttcctgcaatgcattatattatttatgtatatatgccttttagtatgtatttattctggcatattataaactcactaaagcagatacaaaattcttttctatgagtgtgtgtctcacagaggacagtacaccttgtaccaactaagtgcttaataaatgtttatctgagtgaatgtaattccagcaagttggaaagagcattgtattgtttatcctggtttttgtttatttctttgtttctaagtggaagtttttataagaagatagatctaaagttctcagaatcctaaacagtattgcagcatctttttcttgaaatttacagcacatttctcattgcttaattctcaaatttgaaattacttttaacctaccattcacaaaattatctcactcacctgaagtacagatgtaaacaagcttcttaactctgtaggtaagacaacatcagatgtcagttgatgatttgcttgagattgtgtgtgggagtctacatttttaatttttttgcacttgcgtgaaaggcataatgtatctctcctgaaatattttctttgggcctgagatctgaggaatttgccaaatttattttttagaaattaaacaagaatctttccatcattgaagaaccttgaggttctccatcattgaagaaccttgaggttctccatcattgaagaaccttgaggttctccatcattgaagaaccttgaggttctccatcattgaagaaccttgaggttctccatcattgaagaaccttgaggttctccatcattgaagaaccttgaggctgccctcagtgactgcagccttcgacttagaaacggctaagcctgaaatgatggggtgtgccccggatgcctcagacgacagataaagctactccagccaggaagacacagaagtggaagacggagataaaactgcatgaaacgaagggataaagttatgtagttatagaattttacacctggaaagcagaaaccatatgttctagcctcacatttcacatgagtaaactgaagcctagataggtgaagggacctgtccaaagtctcatagtagcttaatggtggaaccatactttttgagagttaattgagggtgtttttcactataacctaatagtgttacatccaggggtatatcaaaggagaaaacagtttaatgaaattatttaaaatgataattttcttacagagattatattcttactgagttttaaataagagttttttccttgctgtttgaagttaccatgtcctataatgcatcaagtctgaaaatgcatttataaaatagagaggtatggactatatttttatctataaggtgaatgtgctttagcttcaggtttttttaaattttacacttggatgtgtgcttatttttaatttagaaaatataatttggttggaaacttaattattgccagttcttgagagagttcttcaatctttgagatgtggtatgcattagtgtaaatcttggcataactgtggacataaattcttcaattgttttttccttctttggttctgggatctgatgaagagtgttggttttgaaacttttgaggccaggtatggtggctcatgcctgttgtgaaactaaaaaatctgagacaggtctcagtcaatttaggaagtttattttgtcaacgttaaggacacatgcccatgacacagtctcaggaggttttgataacatgtgcccaagacagtcggagcataacttggttttatacattttagggaggcatgagacatcaatcaacatatgtaagatgaacattggttcggttcgtaagggcaggacaacttgaagcaaaagcaggacaactcaaagtgggagggggcttccaggccattggtagattagaaacaaatggttgcattcttgagtttctgattagccttgacaaagaggcaatgagatatgcatttatcttagtgagcagagggatgactttgaatagaatgggaagcaggtttgccctaagcagtccccagcttgacttttccctttagcttagtgattttgggccccaagatttattttcctttcacactataatcccagcactttgggaggccaagcagggaggattgattgagcccccagaagttcaagaccagtctgggcaacatagtgagaccgtatgtctacaaaaaataaaatagaaaattagccagatgtggtggtgtatgcctgtagtcccagctactcaggaggatagtgtttgaaatttcagtgagctatgatcacgtcactgcattccagcctgggtgacaaagcctgggtgacagattgattgttagacaatatgaactattgactaacattttttctgcttccaaaacttttgggtatttgttatatataaattttacttgcattcttacctatttgatggcatatatttctgtaaatgtacttattacctactttattgcctcttcatctgcctttgttcagccctctcctagaagcaggagacatttttctagttttttgtttgtttgttttttattcaatttttatttgtatctcttggtacttttttaaagccttctgttttctgtttctctgtaaccttctgttctcaggattagtaataatacaagagttttgcttcttgtgtggagaaataaacttccaaaaaaacaaccagcctgcagatagtagctataaactctggacaaaaaccaaaaataaaagcaaagcataacaaaacacaatacaactctgtaaaggttttggagaatggataagactagagaaatattagaggaggttcaaactttgtattaagcaaatgtcatgagatgaagtgagtttcacatttctgaggctttttctgagggcatctccaattgcagtggcaacatgggacaatttaactccaagagaaagcccttgctttctctgtaggctgtaggaactctgggaaggaacggggatgtcagagaatgaggaaaaacataggaaagtaaagagacagagatgggatattgtgtgtataaattctgtcttaagtctttgtctgacccctgaactgcacatgcacagggcagactgaaatcagtccacactgagatccaaaaagcacaaatttttcaatatgagattagccaaattaatgtcccatgagaacaaagatattagcactctttggctcaatgtaacacattgtccaagttaaggactccaagtctggagtatccacaattaacattgacgatgtctaagttaaaacccataattggccaggcacagtggctcacacctgtaatcccagcactttgggaggccaaggtgggcagatcacgaggtcgggagattgagatcatcctggctaacatggtgaaaccccgtctctactaaaaatacaaaaatttagccaggtgtggtggcgggcgcctgtagtcccagctgctcgggaggctgaggcaggagaattgtgtgaacccaggaggcagaggttgcagtgaaccaagatcgtgccactgcactccagcctggcaacagagcaagactccgtctcaagacaaaacaaaacaaaaacaaacaaccaaacaaataaaaaccccataattacttcaacccagtaaaatgttaccctttcttaaggataaagaaaatcaacagatgacaatcttaaaatcacccacatgttggaattactaggcaaaaaaattaaagcaggtattaaaactgcgctttaagagatgaaagggaatatggttgaaatgaacaaaaagataggaaatctcagcagagaaataagaaattattaaaagaaccaaattggccaggtgcggtggctcacacctgtaatctcagcactttgggaggctgagggggcggatcacagggtcaagagatcgagaccatcctggctaacgtggtgaaaccccatctctactaaaaatacaaaaattagctgggtgtggtggcatgtgcctgtaattccagctactagggaggctgaggcaggagaattgcttgaacccaggaggcagaggttgcagtgagccgagattgcgccactgcactccatcctggcgacagagcaagacttcatctaaaaaaaaaaaaaaaaaaaaaaagaagaaccaaatgggaattttaaaacagagaaatgtattatattaaataaataaattagtaggattaacagtataatggaggaggggttgaaggaaaagtcattgaacttaaagatagatcaatagaaattatctaatctaaaaaggagtgagaaaaaagagtggataaaaaataagcagtatctcaaaaaccggaagtacaattttatttattttttatttaaaaatatttaattgacaaagattgtatatagtgaaagtgtgcattgtgattgttttatgcatacatttctcagtgattatcacaatcaagttaattcacacattcttcaccacccattctgtacattagatccctggaacttgttcaacttataactgaaatgttgtaccctttaatcaacatctccttattttctccaccaccatcccctggcaatcatcagtctttctgttgcaatgagattcacctttttataagatttcatgtaagtgagatcacagactatttgtctttctatatcttgcttattttacttagtataatgtcttacagattcattcatgttgttgaaaatgacaggtttgattatttttatggcaaaataatatttcattgtgtatatgtaccacattttctttattcatttatccgctttacccattgatggatacttaggtagtttccatcttttgggtattatgaataatgctgcaataattatgagggtacagatatctcttaaagatactgatttcatttcctttggatataaacccagaagtgggcttgctggatcatataattattctattttaaatttttttaggaaactccatactgttttccataatggctataccaatttacattcccacctacagtggacaagtgttttcgtttctccacattcttgcagatatttatctcttagcccttctgacaggcatgaggtgatatctcactgtagttttgatgtgcatttccctgatgattattgatgttgagcactttttaatatacttcttgcccatttgtatgccttctttggaaaaatgtctattcaggcctttttcctatttttaaattgagttattgttattatttttttttgccattgagttgtgtgagttctacatacattctgaatatcaacccttcatcagatatatagttgcaaatgttttctcccattcagtaggttgccttctcagtttttgtttcctttgctgtgaaaaaggtttttagtttggtgtagttctacttttttttatttttgcttttgttacctgtgcttttcgtgtcaatatccaaaaactctttgccaagaccaatgtcaaggagctttgttttacagttttggatcttacatttttaaattaaaaatttaaatctttaattcattttgagttaatttttgtgtacagtgcaagacaaggatccagtcttattcttttgcatttgagtatccagtttccccaaaaccacttattgaagagaatttcctttccttattgtgtatagttggtgcccttgccaaagattagttaaccatacaagtgtgcatttatttctgggctctcaattctattccattgacctaagtgtctgtttttatgctggtaccaaactattttgattactgtagcttcgtaagacaaattgaaatcacagagtgtgatgcctccagctttgttccttttcaagattgctatggctatctgtgatcttttgtggttccaaacaaatttcaggattgttttgtctatttctgtaaaaaatatcattataatattgatagattgcattgaatctgaaaatgctttaggtagcatgggcattttaaaaatagcaattctttcaattcacgaacgtgcaatatttttacacttgtttttgtcttcagtttctttcatcagtgtctaagagttttcagtgtaccaattcttcatcaacttggttaaatttatttcttagtatgttattgtatttgatactattgtaagtggaatcgttttataatttggatatctgtccccacaaacctcatgttgaaatttgatcccaatgttagctatcaggcctaatgagaggtgtttgatcgtgggggtagtttcctcataagtggtttgatgtccttcttgatgtcttgatgtattgagtgatttctttctctattggttcccatgagagccgattgttataaagagcctggcagctctctcttctttctctcttgccttgtaatctccacacactggcttcactttaccttctgccatgagtggaagcagcctgagctctcaccaggagctggtgccatgcttcttgtacatccggaaaagccatgagccaaaaaaactttttctctttataaattacccagccttaggtaataagcaatgcccacagactaagatggatctttttcttaatttcttagagagttctttattaatgtagggaactgcaactaatttttgtatgttacattgtatcctgaaactattgggttcatatatcgtttcaacaggtttttttttctttttttgctgcagtcttcagggtttttctacatataagattatgtcatctataaacagagaccatttaacttcttcctttccaatttttttcttgcctaattgctctggctaagaattccaatactatgtttaatagaaatagtgagagtgagtatgctttttcattcctaatcttagaggaaatgctttcagcttttcaccactgagtatgatgttttctatgggattgccatatttgatctttattatgttgaggtacgttccttctgtaccaaatttgttgaggctttttatcaagaaagcattgatttttgtcaggtgcttttcccgcactgttatccttcattgtgttaatgtgatgtatcacatttattgatttgtgtatgttgaaccatccttgcatcccagagataaatcccacctgatcatggtgtatgatccttttaatgtgctgttgaatttggtttggtggtactttgttgaagacttttgtatctatattcatctaagatattgctctgtaattttcttttcttgtagcactctttatatatatatatgtgtatatttattatactttaagttctagggtacatgtgcacaacgtgcaggtttgttacatatgcatgcatgtgccatgttggtgtgctgcacccattaactcatcatttacattaggtatatctcctaatgctatccctcccccctccccccaccccaaaacaggctctggtgtgtgatgttccccttcctgtgtccaagtgttctcattgttcaattcccacctatgagtgaggacatgcggtgtttggttttttgtccttgcgatagcttgctgatggtgtatatccataaagcactcttatccagctttggtatgagggcaatgctggccttgaaatgagttaggaagtgtgtcattcttgtaaacattttggaactgtttgagagggatgggcattaattttttaaagcttggtagaatccgctcatcaagacatctagttcttttgccaggcacggtggctcacacctgtaatcccagcaatttgggaggctgagacatgcagatcacttgaattctggaggttgagaccagcctggccaacacagtgaaaccccatctctactaaaaatacaaaaactagctgggtgtagtggtgggtgcctgtaatcccagctacttgggaagctgaagcaggagaatcacttgaactcaggagatggaggttgcagtgagccaaggtcacaccattgcactgcagcctgggtgacagagcaagactttgtctcaaaaaataaaagacatctagtcctgggcttttctttgatgggagaattttttattactgattcaatctccttacttgctattaatctgttccgaattttattatttatgatgcagtctttgcatcttatatgtttctaggaacttattttttactaagttatctaatctgttggaatgtaattgtttaatgtagtctttttataatcctgtgtgtttctgttctatcattttaattgtccattttccattacaaaattttaaattcgagtcttctttctttttttccttgggtaatctagctaaagatttatctgtcttcaaaaaacgaactcttaggtttactgatcttttctattatttttctattttctatttcatttatttctggtctaatttttaatatatccttattactgctgactttgtgcactttgttctttttttaattttttgaggtgtgaagttaagttgtttgagatttttcttcttttattaatgtaggcattcattgttatgtccttccctcttgttgtgtgcccattttcatttgtttaaagatatgcaagattttggttttgatttcttcttttacacattggctgttaagaagtgtattatttaattgccacatgtttgtgatttttccacttttattttttcatttttaatttctcctttgattgatttctaattttataatgtagtcagaaaagatacttgagataattttagttttttctaaatttgttaagatttgttctgtggcccaacatctgatctatttggagactgttccatgtgcacttgagaaaaatgtatattctactgctgttggatagaatgttctatatatgtctgtaggtctatttggtctgtagtacttttaaagaccactgtttccctggtgatttgctgtctatatgatctatccatttttgaaagtggaatattgaaatcttttactattattatactggtgtctatttttcccttctgttctgttaacatttaatttatatatttagattctctaatgttgagtgcatgtatatgtgcaattttttatatcctcttaatgaattgaccactttattatcatttaatgaccttctttgtgtcttctgatagattttgactgatagtctattttgtctgatataactataaccactcctattctcttttggttatcatttgaatggaatatcttttctcatgtcttcactttttggctctgtatcctttcagctaaagtgagcctcttataggcagcatattgttggattttacatatttgttttctgttgagccactctttgtattttgattggagaatttaatccatttacatttaaagtaattattgacaaataaggacttactattgccatttgttaattgtttactgactgttttgtagttcttttttttttttgagatggagtcttgctctgtcacccaggctagagtgcagtggtacaatcttggctcactgcaaactctgcctcccgggttcaagtgattctcctgcctcagcctcccgagtagctgggattgcaggtacctgccaccgcacccggctaattttgtatttttagtagagacggggtttcacgaacttggccaggatggtctcgaactcctgacctcatgattcactccccttggcctcccaaagtgctgggattacaggcatgagccaccatgcctggcctgttttgtagttcttttgtttctttcttccaatcttgctgtcttcttttgtattttattcaatttttgctttgattcatgtctctattttttgtgtctactagaggttttttcctgtggtcaccttgaggcatatataacacaccttgtaatgacaaccatcaaatttaaactgataacaacttaatttccattgcatataaaaactctgtatcttgcttttcccccaggcccccactttattgatataacattttatacctttttatattgtgtatccattaacaaatattctagctatagttgtttttgatattttttgtcttttatcttttatattaggcttaaaagggatttacaagagagaaattgtccatcccagtggttggaactcaagtatcaacaaacttcaccactatgggctaaaattctctggggtcctaaataaactttaaggcagtctgagccacaaggactgcaactcctaggcaagtcctagtgctctgctaggcttggagccagtggatgcaggggtcatatgacctagtgagacaccagacagggtggccaagggagggcttctgccacccctcctctgacaccaagcaatgcaattggtagctctgaaagagactcctttattccacttgaggagaggagtgaagagtaaacaggactttgtcttgcaacttggatcccactcagccacagtaggatagggcaccaagtagagtcttgaagcacccactttaggcactagcttccagataacatttctagatatactctgggctagaagggaatgtgctgccttgaagagaaggacccagccctggcaggattcatcacctgctgactaaagagcctttgggcctttcctaatcagcagcaatatccaggcagtacatgtcatgggcattgagtgagactctgaaacatgctggcttcaggtgtgatccagaacattcccagctgtggtggctacagggagagactacttctgcttgagaaaaacagatgggagagaaaaggggactttgtcttgcagcttagatgctagcttggccatagtgttgtagagcaggaagtgggctcttggggttcctgaatccaggacttggttcttgaatggcatttggggagtttccctaggctagaggggagctcaccacatggaaggatgagtcccaggcctggcagcattcaccacaagctgactgaagaacctttgggtcttgaatgaacattgacagtagcttgttagtactccccatgggcctgtggcagtggtgtccaagagaagagacttctgtgcttgtggaaaagacttgtcttgtggcttgcgtgccagctcagctgcagtagaatggagcaccaggtagattcttaaggtttcttactccaggccctggatcttagagggcctctctggaaccatctggggccgggggcattcggtgccatgaaaaaaaggacacagatgtggctggtgttggtaactgataattgtagaaccccagggccttgagtgaatgtaggcagcagccaaatagtggttatagtgggccttctgcaagacccagtgctgtgctggcctcaggtcagacccagcacagtctcagtggtgatggccacaggggaacttgtattatgtctctcccagcccagcaccaggcagctaagcacactcacacagagagactctgtttgggagaaagtaatggaagagaacaaaagtctctgcctagtaatccagagaattcttccagatcttgtacaagaccaccaatatggtaattctatgagtctgtaagagcctcagtgtaactgaccctggagtgcccccaatgtagacacagctgcattgaccaaaaatttagtcacaataaacaagtccctttgaatacctagaatgcttccccaagaagggtgggtacaaacaagtccagactgccaagactacaataaatacctacttcttcactgtgtagacattaacagacatccacaagcatcaagaccatccaggaagacatgacctcatcaagcaatctaaataaggcaccaaggatcaatctcagaaacacagagataacgtgaccttttagacagaattattgaggaaactcaataaaattcaagatagcatagagaaggaattcagaatcctatcagacaaatttaacaaatagattgacacaatttttaagaatcaaacagaaattctggaggtgaaaaatgcagttgacaccctgaagaatgcagcagcctcttaacgggagaattgatcaaacagaagaaagaattagtgagcttgaagaaggactgtttgaaaacatatttaggagacaaaaggacagaataaaaaagaatgaagcatgcctacaagatactcaacagggcaacagttattggtcttaaaagtgaggtaaagagagaggtagaggtagaaagtttgttctgaggacggtattagagaacttcacaagcctagagaaagatataattattcaagcacaagaaggttaaagaacaccaagcagatttaacctaaagaagactatctcaaagcatttaatagtcaaattcccaaaaggtcaaatataaggaaaaggattctaaaagtagaaagagaaaagaaacaaataacatacaacagagcatctggcatcagactcttcagtggaaaccttacagcccaggaaaaagtagcatgacatatttaaagtgctgaaggaataaactcttaccctataatagtatacctggtgaaatgtccttcaaacatgagggagaaataaagactttcccagacaaataaaagctgagggatttcatcaatatcagacctgttctacaggaaatgctaaatggagtacttcaattagaaagaaagggatgttaatgagcaataagaaatcatctgaaggtacaaaacttgcagtaacagtaaaaatattattactattacatagtacataatactactggtatgtacgtaatatgtacatagaaaaacaacattataatactgtaatcatatttggaagtatacttgaaatatactgatatcatacaatacagatttcaagacaaaaactacaagaagagataaagaaggtcactatgtaattataaaggggtcagtttagcaagaggatataacaactgtaaataaatatacacccaacactggagcacccagatatataaagcaaatattatcagagcttaacagagagatagaccccagtacagtaatagctgaagacatcaacatcccactttcagcaatgaacagatcatccatacagaaaatcagcaaagaaacattggacttaatctgcaccatagactgaatgaacctaatacatatttacataacatttcatccaacggctgcaaaatacgcatttttgtcatcagcatatggatcattctcaaggatacctaagactacaaaacaagctttaaaatattcaaaaatttgaaataatatcaaatatcttctctgatcaccatggaataaaactagaaattaataatgaagaattgtggaaactatacagacacatggaaattaaacagtgtactcctgagtgatcagttggtcaatgaagaaattatgaaggaaattttaaaagttttttgaaataaatgataatggaaacagaacatatcaaaactaagagggaaatttgtagtgacaagtgcctacatcaagaaagtagaaaaactttcaataaaaaaaccaacaatgcatcttagagaactagagaagcaagagtaaaccaaacccaaaatcggtagaattaaataaataataaagatcagtgcagaaataaatgcagttgaaatgaagaaaataatacaaaagatcagtgaaatgaaaagttggttttttgaaaagataaacaaaattgacagacattttgaaaagataaacaaaattgacagaaaaaaagatagaagacccaaataaataaaatcaaaattgaaaaaggttaccttacaattgatactacagaaattcaaaagaccattagaagctactataagcaactattaatacatgtaaataaattggaaaacctagaagaaatgagtaaattcctagacatatacaacctaccaggattgaaccatgaattccaatacctgaacagaccagtaataagtaatgagatggtagctgtaataaaaagtccttcagcaaaggaaaccctgggacctgatcgctttactgctgaattttaccaaacatttaaagaactaatgccaattctactcaaactattctgaaaaatagaagaggagggaatgtgtccatcttctgtgaggccagtatcatcctaataccaaaaccaaagacacatttaaaaaaaaaaagaaaagaaaacaaagaaaaccacaggccaatatccctgatgaacattgatgtaaaaatccataagcaaatactagtaacccaaattcaacaacacattaggatcatcatgaccaagtggaatttatcccaggcctcaatgattattcaacacatgcaaatcaatcaatataataccacatatcaacagaatgaaggacaagaaccatatgattatttcagttgatgctggaaaaaaacatttgttaagattcagtatcccctcatgataaaaaaaaaaccctcaaaaaactggatatcgaagtaacatatctcaacataataaaagccacatacaacagacccacagctagtatcatgctgagtggggaaaaactgaaagcctttaccctaagatctggaacatgacaaggatgctcactttcatcactgttattcaacataaaactagaagtcatagtagtacaattagagaagagaaagaaataatgctcatccaaactggaaagcaataagtcaaattttccttgttgggagatgagatgatcttatatttgaagacttcaccagaaaactattagaactgatcaataaattcagtaaatttgcaggatacaaagtcaacatacaaaagtcagtgacatttttatgtgtcaatggtgaataatctgaaaaagaaatttaaaaagtaattcaatttataatagctacagataaaattaaatacctaggaaataactgaagaagagaaagatctctacaataaaaactataaaagattgttgcaagatattgaaagggacacacaaaaaaatggaaagatattccatgttcatgaattggaaggatcaacattgttaaaatgcccatactacccaaggcagtctacagattcaatgtaatctctatcaaaataccaattacattcttcacagaaatagaaaacacaattataaaatttataggaaaccacaaaagacccacaatagccaaagatatcctgagcaaaaagaacaaaactaggaatatcacctgagttcaaattatactacagggctatagtaaccaaaagagcatggtactggcataccaacagtgtatatagcaatggaacagaatagagaacccagaagcaaattcatacgtttacagtgaactcattttcaacacaggtggcaagaacatacattggggaaagggcagtctcttcaataaatggtgctgggaaaactgaatacccacatgcagaagactgaaactagacccttctctctcattatatacaaaaatgaaatcaacatgaattaaagacttaagtctaatacctcaaactatgacactactgaaaaaaaaaacactgaggaaactttccaggacatttgactgggcaaatatttcttaataccccataagcacaagcaaccaaagcaaaaatggacatatgggatcacatcaaactaaaaagcttctgcacagcaaaggaaaccatcaacaaagtgaagagacaacccacagaatgagagaaagtgtttgcaaaatgtccatctgacagtgattaacaaccagaatatataaggagttcagacaactatatacaaaataatccaataatccaaataaaaaatggggaaaagatttgaatagacttttctcacaagaagacatacaaatcgcaaactggtatatgaaaaagtgctcaacatcattgatcatcagagaaatgcaaatcaaaactacaatgagatatcatctaactcccgttaaaatgacttacatccaaaagacaagcaataatgggtggtggtgaggatatggagaaaagagaatctttgtacactgttggcggaaatgtaaataagtataagtactatggagaacagcctggaggttcttcagaaaactaaaaacagatctaccatatggtccagcaatctgactgctaggtatatacccaaaacaaaggaaatcagtatattgaagatatatatgcactttcatgtttattgcagcactagttaaaatagctaagatttggtagcaacctaagtgtccattaacaaaagaatggataaagaaaatatggcccatatatgcaatggagtagtattcagccttaaaaaagaatgaggttctgtcattcttttttgtgtgtcagtgaggcacagaaagacaaacttaacatgttgtcacatatttctgggagctaaaaattaaaacaattgagctcacggagatagagagtagaatgacagttaccagaggttgggaagggtaactggggagtaggagccggggaagtggggatggttaatgagtacaaaacgatagctagaaagaaggagtaagatctagtatttgatcacccaacagggtgactagtcaaaaataatttaattgtatattttaaaataactaaaagagtgtagttggattctttgtaacacaaagcataaatgcttgaggtgatggatactccatttgcctttatgtgattattaggcattatgtgcctatatcaaaatatctcatgtaccccataaatatatatacttactgtgttccaaaaatattaaaataaaaagtttaaaagtatacctaataacaaataataaggagacaaataaccctattaaaaagtgatgtgcgtattaccatttcagtattagagtattctgattttgactatatgtttatttttaccagtaagttttattctttcatataattttattttatcatctagtatccttttatttccactccaagagctttctttagcatttcttctaagtcttgtgatgacctccctcagttttcctttgtctggttatgttattatccctccttcatttttgaaggacagcttttgtggatatactgttttatttggcaggtttttttttttttttcttttagcactttgaatctattattccattccctcctggtttacaaggtttttcttgagaaatctactgattgtcttttggatgttcacttatatggaacaaggctcttttctttcactactttcaagatctctctttgtctttcacttttgacaatttggttataatatgtcttagagcattcctgtttgggatctctcttggaagcctttatgctgcttgaatctgaatgtccatatgcctcccaggatttgggaacttttctgctagtatttctttatattagtttttgtcctcttactctgtctgtcttctctgggaattcctaattcatatttttgtacacttggtattgtcccataggttcctcatactttcatcatgctttttcagtctttttcttgttgttcctctaggtgggtaatttcaaattacctgtcatcatgttcatcaattctttttctgtatgattgagtctgctgttgaagccctgtattgaatttttcacttctgtcttcatacttttcagctatagggtatctgtttggtcctttttttatggaatataatatttaaactaaactaattttttaatgaattattttcctaattatattttgtggtttatttgtgttttctacatctcattggacttattgaaaatcattattttgagttctttttccctgtgctggcaggactgctctgagagagcagccaagaggaactggagctaagtgggagctcccttttaggatcctcagccaagacaaatgactgtcacctgaggcattagtgtgcatgacttcttccaggcccctttgtcgatgtttttgatacaggatgttggagctatttccatgtctgaagctgggaccatcattggcaagtctgtcatgtgggcttgattctaccctctcaaaatggccttcttaggtcttgggtgtcactagtgttcacaaccccctacttgagccccaaagtttcaactagggcacttttttttttgggataactagaaaatttttattgctgtgggggtatatgtctgagggacctcctgttctctcatgtagggtattgaagaacaagaataggacagagaaaatatttaaagactttaagaagaaaggttaaaaattcccaaattttgtgaaagacatgaagcttagtgaactctaaacacaataaacgtgaagaaaacaacacttgggaacatcatagtaaagctgctaaaaaccaaaaattatgctttatttaaaattgggtgaagtgttagggagacagcataatgtcctctgtgaacataattaagaaagatgagtaaatagtacaaggcagtgtttaagtacatggtctttagagtctccctctatcaactgctgctacttattaattttatgactttgagcccatttattttttttgagcatcattttatttatacaattgtgataataatgaaaataaaaccacttatatggctgatatacagattaaataatatatgcaaaactcttatcaaacacttagtagtagctaaataaataatagctattgttacttttctttttctgagtgtcttttggctagcttgtacctcttctaaatcctcaccattgtaaataatttttctttctcataatacctttatctgggtttgatatcagtgttcaagggccttatacaagagttgaggtgctttcctgttttctatggtccaatttttatcacatagacctcaacagatttttaaaggtttattaaattttatatttaaatatatttgggcctggtaatgtgtgtgtgtgtgtgtgtgtgtgtgcacgcgtgcatgtgtgtgtgtatgtttatataaatttctaaccacatatgtgatatctttataattgtcgaatcagagtttctagttcttcttaggcaagttatatttttctacaaaattgttcatattatttcacttgtaaaataacttgaacatttaagtcaaattagcataaagtatttcatagtattcagtaatcacttaaatgtccaaatagatttgttttttctttttaattttatttctatcttcttttttataataaaaattcccagagatttttctactttattagtcatttaaaaaaagcaacacttaattttgttgactgtctttacatttttgtttttcatttcccttatgctcagtattattgttacgtttcagcttttacattttttggttttacttttttgtaacttttctaatgtcttgataattttagtcttgtcttttctttttagcatattaacttaaagttgtactttgctccctaagactgtttagctgcattgcatgagttttgatatatagtcatgcatctcgtaatgacagggatacattctgagaaatgcattgttaggtgatttcatcattgtgtgagcatcatagagtgtacttagataaacgtagatggtatggcctattgtacacgtatgctgtatggtatagtcttttgcttataagttataattaataccgtgaatggagcttgcaagactggaagttgctctgagaaagttagtgagtgagtggttaatgaatgtgaaggcctaggacattactgtatgctactgtagactttataaacactgtacacttaggctacactaaatttataaaagtttcatatttcttcaataataaattaaccctagcttactgttaagtgttttactttataaacatattttttaactttttgaattttttgtaataacacttagtttaaagctcacataaattgtatagctgtacaaaatattttttctttacatctttattctgtattttttccatttaattttttttaactttttaaactttgctaaaaactaacaaaaatgcacacattagccaggtctacacagggtcgggatcatccatatcactgtcctccacctctacatcttgtcccactggaaggtcttctggcgtaataacatgcatggagctgtcatctcctgtgataaaaattcctttttctgaaatattccctgaaggacctacctgatgctgttttacagttttctgaggttttatcagttttggaaaagattcatcatcatttcagatattgcatttttgtctttattttttttcattcttaaatacttattagatatgttagagttttttattttgtcatttatatctcctaatctttttaaaaaatatcttctatctctgttttatggtaggtaaattccttggaattatttttcagttcagtaatcctccctttagctccatttaatatgataaattctcacttcagatattaattttaatgacaattttatttctataaatctctgtatatttatcaaatctgcctttttcatagtttctttctttttttattttggccctcagattagttccctaagattgtgccctattttgaacttaatgcgtacatttcatttaaagtttttcatctgctgactcatttatggatgaacctttcttcggatttgatatttttgatatatgagctctttttcattggtgtttgctttttctgtgagactcccacatgacctgagttgttgaaggtatcctgcaaaagtggatttgtttcttctaggtattccagatctattaggaggttgccattctcagtgattacagttattgcaaactttatttgtacccctaaatttctcaggttattactgagctggataattcccctgggagggttgtggtagaatcatagtaatgccaaataccctagctctatcttcttgatttctaagttcctttcttatgaaacattttaaaacttttatgtatttgatgtttatatattcgtacagaaatgtttctataggacctttatattttaatagaaacatttctgtgtgaatatagcctgacattttaaagaaaagtctttcctatttctttggcttgaatgcctttcgtatacctttatattttaatagaaacatttctatctgaatatagcctggcattttaaaggaaactctttcctattcctttgccttttctccaaggcatttctggctaactccctccttcatttcttttgggtcttcacttgaatgtgatctttccataatttctttgctggtccccctatctaaaatttcaaccccaactcccaatcccatcatttacttttccctttccctgctttattttaattccttagcgcagataattgtctgtcattctatatatttattatcagacatccacaacaaatatatataatctccatgagatcagaaatttccatctattttgttcactcctaaatcaccaccacttggaacaatgcctgtcacatagtaagtactcaataaacattttagaataaatgaatgaaatatccaatggttgtatattgtgtgctttgtcctgaactaggtggtgatgacaaaaaagaaagaaaataaaccagattctagccctcatgaagacgatggtcttgcagggaacatagactactaaaatcacagtttatcacctctgattgacaaaggctatgaattcagatgaactcttgatgagcttattggtaccaggtagatattccctgagaagtatggggatggggtgattacttttgttatgcggtgcatctcagacttgttctgtctgaatattgaccaaataatacacatacacacatatacgtacacagaaaagataacgatttagacagaaaacaattttaatgagggagctgacataagtttgaccaaattagtaagaatactgaaagcaactaagtatgaaaatagaatttccgatgaagtatttttggtaccagttttttcttgcagggttggtagccactgtctgatgagcacaaaatgcaaaaaattagcctaactacattctgctgccttgtaattgcacctaaagagcaagaacacatttgccttttatacttctgcaagtagtacatagaaaaggatatgctgttactttattatagtaaataataaggttcatggctatatttacaaaggttgagttttcagcatgtgaaatgatgtgaagaatgttaaatctctaatacgtgtttaatgtacatttcagttgatttttctccaactataatagtagcaattattttatttatatgaggggaagactgcgtcacctaagggaaaagctaatagatttcttggcagtttttgtatcatgttgaaatctttttccatttctaactgctgtgaaattctcgctactctgtcttacacatttttttttatgtattaaccctaacaccaacttacttttctctgcatttaagcccttatttcatctatgttttcctacctaaaatgtattatcctggttacttgatgaagttttagctcaatcttgttgcagacgctggctggccaaggtaaaggaactaatcaatagtgagccccttctcctaaatgccatagataatgctaatagctacttgtatacatataatctcattaagtcatcataaaaacataaaattttatataatataaaaattttatattatataaaatccccctcattttaaatatgattaatctgaatattagagatggttatgtaagtttacctaggacacatacctagtaagctttaattcaaactcaaaacttctaattgaaagtggttgctgttgttgtgattccattgctttttctaggtactataccttcatcctacctagaattgcttttgaagtttttctgccttgcctttgattgaacagaatttacaataaaagattttctacatcatcaaggcttccacagagttcaaatgaaaacactttttaggggtagctgttaactgcctacttttatagtctcttgattgaaagctactgctctaaatttactgctcatatttttgaactcatgtttgtcttatacatctgacaaatacttattaagtgttgactgtgtgtcaggcactaaactagaccctgggtatagagtagtgaataaagtagtgtggcctctatggagtatacaatctagtgggaaagaaagagataataaacacataagccaataatcaccccaataatttaaactgtcatatatgccacaaaagaataaaatagtggaggtatctgtctcaggaactatagctagaagaagttttttagagaaagtataagaaccacataattggttaggaactgcagaactctttcagtgaactctgtgtaacagtttcttccataccgagtatctgttaacaggtaggatttggacaactcattcttgtccaatgtggggccaaactaacgaggctttctaacctggtgttaacatttgagactcaaattctcatattttaagtttgtactgattaagaggaaaaataggtagaaaaagcacaagaaaatagattggaagattagtcctttaaagattgggaataacttgtttacgaatgtgattccttaattttttatgcagtgtgaattttcttaatcatcaagaatacaagctaacacaattcatgcaacattcctttagccaatatttaagacctacctaccacacattatgtactgtgctaagtaaaaactacagatgtaatggtgaataagatacaaatgctggtccccaagtttacagtcttatgtaaaagacaattccagtgcaataaaatgattattatgacaggattagacacaggatatcagattctggaggagataatatctaaactaagaccccagggatgtatacaagcaggccagtaaaattttcacattttctgagaataaatcattgatttcaatagccataacttcaagttgaggatattttgaaaatataatttttaatattttctaaattttaggttcttaaatacatttttaaattagctcttaaacttttattttaaaagttgtgaagtttaagttaagtcataaaaacccaacagctattttctctagaatatgctgtgaagtgtggattataggacaattagaattattaacacttagtgtattgtagatgaggtttctacttgagagttcaaatttatcatgtttatacatgaaatttgatattaaattctttcattttaagtggcattaattatagaaaattcaaattttgcagtttttgtaaataagctttagtttttcgtggattttatagctttattacagcttatctgacctaaggtctagacagatcaactgtgccgttgggttaacggtgtttaccatatgatttccttttccttctttattgcactttatctgtttccagttcacagtgttgattaatagataactgtgctcctcatacttcctctttcttataggcagatagcttttcaaaatgaagggccagacctagctcagtaatttacaaaataagcataagtttttcaagtctacttgacaatttatagttcttactcttcataggactttctgttgagagaaaccacagaagccaggtacctcaattttcaaaagtaaaattggctttattgatgagtaaagtgtacattttataataaccatataataatgatacaacatccagctctgtagtgggtccagaaggactaaatacatattaaataaaataaaattattttgaattacatagtcttctctcaaaatatcaaatttaaatgtaaagcatgtaaaatagtcctgtggatgcttcctcagtcatgggtgaaattctttttgtttaaatttaggtttagagctcttctatggagtggttgtacccacaggcccaggtgagatccttgttagtactctaagtgaattagcaagtagatttattaatggcttaaggggcatctctagccaggcccaactagtatgaagggaagatgaactatttctgtattctgtaacatagaattggacctatcccactggagaacacagctatgccaacctagaagtaaaaagaacttcaaacaaacaaacaaacaaacaaacactctatagtatatctgcatctggaatggtgctaatagtaacttcacccaatgcgagtgaaacaactctagcaattacatgaactgtgtgggaatctgaagacacgccacttaacaactcaggatctgtgctgtcctttaaatcaaaacacaaataaggactagaacaacatcagtatgcatccatttctgtcttcccagccataagaaaaaaactgactctaacgtttttttttacttagagttgcaaacctcatatataaggctctggtcatctgcaggatctccttagaatacataaaaaggtgataagtgcctacatgtgattgctaagaccattacacggcaccttggtccaattccagttgagtaattatattcattttgtccttattttccttttcctgattgtttcagttaaatgtggaaagtgatccttcatttttcacccagagaagttcggcagtgttgctgcacgtattatttagactttactgcctttcttttcagtcataggaatggagcttaaaagtgctggttagaattgttattgtggctattactattgttgcagtgttgcctgattcagaaatgttctgtgaacatcaagcacatgactggcttttggatgagctgctggactgtagggtgatgtcttcaacaagccttctttatctccttactccttgcctagcttagttccttagcttaaagggacagacatgctttcccttttcatacaactatgatagtactaacagttcccttttatcaaatgcttacctcatggctggcactgtgctagttcctttatatggctataacatataacctgcatagacaacctcgtagggtgagtaacatgatcaccattttacagacagaaaatttaaattgcttaggatcacagaactaaagatggggagctggaatttgattccaggtttgtttgatggcaaaagctaagtgcttaactaccaccctacctcataactctactgcttcccagaactctgagccccagtctatggatcactgatcacacaaatagcttcttaccttctcttagtgtttgtcaccacttcacacagattgaccccattgacctcacattggaataatcctgcagcactggcctcagaagggcattgctgattatgtttacaggccagcaggaaactgaactgctattgagagaatctctatgctgaatcattttatctgcataacaaaagtggtttgctctatcttcttttctttccctggtggtgttgtcataacagtgtcttttagcaggattaaccagtaactaacttatttgctttggtttccaataaataactgcagcctgttaataattgtgcatgtgttttatgtggcctcagataaactgagacaatcttacacatctgcattccagattgggtcactattccttcatacttaatctcctattatgtaactgtccattaacaaaaaatagatcacataaggaaaaaacttaaatacttaatttgctagtgcattaataagtgatactaatacacatgactttttattgttacctaaagataggtgtttgctcagaaatataaaaaataaacctagtgtatgttttcttgctttaaaatgtaccaaatctgtcacaaatgctttgaactgtattgtgtttacttcttcatgtgagctgtgtctaaacattttttagtgtttttaaattgttagctcaatgagggtaaggtgtgtcctaatttatctgttagcacgttgcagtgccaaacacagcaccatgcaggcagtagatgctcactgaatgtgattgaattagtgaataagttaggctgtgctaggttgaagagatttgaagtcctaaattattcttgccatcatttcactctgcataataagtaaagaagttttactaagatgatttaaaaatgtgttattgaattacttgtgtagattccaaagcactgggataaaaaagaccctggctatgcccctttgaggaagcagtgagggtgtttctcactgtaggcacagttactgggttttatttgtgactgaattaatttatttctcttaggaaggttacatttatgaattcaatatagcattttataactttttccttttacccctaccctacctactattattttttcctattataaaagtcatgcttattgtagataattaactatatatgaaagtaaaaagaaaaaattaaaatcatccaaagtcttattatccagatataatcactcttaattctttgttttgttctttgttttttcttattcacataatttcatactgtccatgtaattggtagtctacatgtttatataatattttagcatcataatactataaatttgcatttttccgtaaaatttaaaatattctttaaagtaccttgttaaattttgccaaatattcctttatatagatgtgctatgctttatttaattatttttctattagatatttaggttgcttatagttttttactgtcataaaaattatcttttttacataaatttctgttggttttctattacatttgattcctgggactaaaattactgagtaaaaatattgaactttgggttcttgatacatagtactcagtgggtttctagaaagtcttttgtaatccacattcccatcagaatatacgaagatgttgttttattgagccatcatcaaaattattacctctatatacttttaagcagtattataaagtggacttactgactataatgtgttgctgtaatcgactgtgctcagaagaactatataaattaaacatgtccgtttgctttcaaaaagaattttttttttttttgagatggagcctctctcttgtcacccaggctggagtgcaatagcgtaatctcgggctagtctcgaactcctgacctcaggtgatcagcccacctcagcctcccatagtgctgggattacaggcgtgagccaccactcctggctagaactaggaaatatttttaagagtaccagtagttcccaggctgtatgttgcaatacagtttccacctaaatccaaatgtttttcaggtctaattgtaaactgctacttttgtttaatgtggacttacatagtcttctgtatcaatacctacttcgctggcagttttgtcaaagtgtgttgagttgaggcattttgcattatatccgacgtggtgttagcattccttcttgtagcaatcaatttcatttctatttgctgttgtaactcaaagttaacgaacattcaaagtttactttcatttattcatgcatttttttgtggactgctctacaaaagcacctttcttccttaacaacattctatccaaactgagtgcagatgaatctgagtagtttcattttagagagcagcagtcatatttgtattaggaaggcaatagtcttggaagaataccaaaaaaaaaaatcattttaaagtgtttgcctcgtcctctagtgaaagcatttgagtttcagaggccatggtgagtcagagtcccttgctagtgcttatgatacactgctaagggactctgtgtgtgtgtgtgtgtgtgtgtgtgtgtgtgtgtgtatatattttcagatatatgaaatatcctatagggaaaatattgataaaaaataatttacctctttatgcactgaaacttttcctacttctctgcaggaattgttgcaacataaatactggttccaacttagtaaattaatttttacttatatatttcttttacatttcagaattgatgaattgcaagtttgtgccccatagctgcacaggtatgtatatgaattacctataactatgtaaatctatatattaactaacaagttataatatttttatgtattaaaattgcttatagatttcataatgtaaaaatgttaattcttgattacttacagataatgacagcttcaaaggatagtacattttatacatatattttattttattctattgtaagaatcaagtaaacatttctaagatttgataaggcaaataattttaattacaaagcattcatctggtgaagagattattttatggaattgtactattaaagtgaacggtgatgtggggtcagaccattgcaaaaccacagttttgccattattgttttatttaaacttttttttattttgctgcttttgagtttattttctgtgatggttgctttaggtatggagtggttgcagatgtactgtctgctccactgtctcaagcactagacgaatgggaaaaaaaaatgtttgcacctgtttaaaatctcaaccatgcagtgttgtggttcctgggcaacaggcaggaattctcaaaagcttggttgcacctgctcaattgttgcttgcagctgtgtcatatgagtgagagcacagagaagcttgttagcagtgtgcttgtgctcttacgtgttttgtgtactctgactctgaaagattcttacttgatgtagaccttgaactgttacattggtttattctaaaactcactggttttagcttctgaatattttctttaaatcctctgttttatgactcaaatattttttttttagtagctgttgactgccctagataatgtgtatgccaacttctcgaaagaatatctgggagagtagatctcttcagataactgggttgataataatttttgtcctggtagagacattttgtgtttggctcaatttcaccgtgttggcagccccactatgtgaggctggatgtagttattgatccatttagctgaacagatttgaaagcatttggctattagtggacacatggggcatattcagaaaatttaagggtatattgtaagataattccttaatttgtgcatgtgtttctgttgctgttggggtagaagtgagagagaaaaaaagtgaagattaaatagtaattctaaaagaggggctaaaatccagatgtagattttatggaatattattctttaatttaacaaatgctagatgcttggtattttttcacaaatgttactggtaatgatattaaatgtattttagttgtggctttgtatgttttctgacagatatctatatttttgatatagacaagctattatagattgtatattttactaataggtaaagttctataaatgcaataaaaagctgcaactcaatattaaagatatttaattaatttattcagtaggctcaaatttctcatattgaaaacatccaaatgacttgcattactctccttaatgtattcttttaaatgctgaggagtttccgtcggtatttagtaacataaatctggtcttagagttggtgtgtcttttccttttattggcccatttggaatccttttttgtatttttaacaaatcactttggtattaatttaacctctttggaagtaggaaacacagtacaaaggtaagtagaggattgccacagcctcttatacaatgccttgtacatagtagttgatcagtaaatgttgaatgaatgcatttatgaataaaacatttctggagttgtattagaaatagagggattgtgtcctaaaatcttattacttgttatacagtttagataagtcttgatggcctttagttctcatactgccagttacatagatatgagaatactgataaattctgtccttaaaatgagaaattaatgtataagaactgatcctttttgactattttaatgaataattgaaataacactatttgcaatgtgctttaaactaacttttacttattacaagaagtctgtatgttattcccattatacacataaggctgaggcattaatggctaagttacttgtcaccttggaaatactttgcagcccataaataaacaaatctatgttatatggttaatgcctcgtctttcctgagcactggcttatgcttctccctccctatctctatctcactaaaacacaaaaataaaatgtgtgtttaattcctttgggtcagttaagatcagaatattaaaaaatctgtaattatttttctaagcaaaagtaatggaccctgtgtttactgtatacatgtttataattatggtctctatgactcactaaattttaattataaatagaggtaaagccaagcaagagtagagtcaaaatagaacagttaagacttgctttagatagatcattctaatgttccgttttgtgtggcataagcccgtcacataagattggcacagtttacataataagccagttatctattgcattaaaaccttttgtttaggcttctcaaattttagtaccactggtttatgacacatgtacttttaggcatggaactacctttcctctgggaacagtttttcttttacctcagttcacaccagtgtgcaagaggccaatatcaaagacatcggttttttccagtgaatcttagtgtggtagattgaactctatctctctgttagtctcaatattagaaattaggagatgagccaagaatatatatttgctagaatattaatcattaaactagacagatattagcagctttttgagggtcctgtgtcaggaattagcctggaatctcaaagagggaggaattcctatgccctaggattcctgagcattattgcaggttcccctgcgatttcagggttaaggaaataaagaaagaaaatccacatttattaagaacatagcatgactagatataatttcttttttcccccttctttccctctctcctttcctcatttccttttattctgcatggtgaatggatgtctgctgtttgctagaaattgtgctaggctagatgaatacaacaaaatctttgttctcaagaggatacaggctagtgagagacaaagatatatcaatagagttctttttgacttcaccacttattattagtatggtctcaatcaagttacctaatgtttctgttcccttgtttactcatttgtaaaactgggaaaataatagtatctgttgtctgagagttaataacacactacatgtaagattcttggtccactggttggcacatagcaagtactgaagaaatcttagctatgctactgtcatttctatcactaccagttccctcgccatcaccactactgcagtttagactctgaaaaaagaacatctaattgcctgggagcagggatcctggttgggcattatcacatagattgtactcagaggttctatacaaagttacctctgcttccctggccttagaagatattataaaaatcatgaagcaatgtactgaatctaaaagaccttcatgtgatatttttattattttccccaaatttttgtatttgggaaaaatacacacaacatgaagtttactatcttaactattttttggtatacagttcaatggtattaaatacatttatgatgcttgcacagccatcaccacaatacatctctatataacactttcatgttgtaaaactaaaatactatacccattaaaatataacttcccatttccctctgcactcccacccccagcctctggcagccaccattttagtgtctgtctctgtcattttgacttctctatgtagttatataagtggaatcatatagtatttctcttctcgtgtttggcttatttcacttagcgtaatgtcctcagcattcatccatgtggtagtacatgtcaggatttccttgtttttatggctgaataataattaattgcatgtatataccacattttgcctgtccattcactcatcagtggacacttggattgcttccatgttttaattattatgaacaatttggctatgaatataggtgtacaactatctctctgagaacctgctttcaatgcttttgagtatatacccagaagtggaattgctagattgtatggtaattccattttcatgtgttcttataataagattaatttcatttaaattgaataaagccttttaggttgtgtttgtgaatagcattgatttcctcataaggagaataagttgagttaggtttagcaagaacacatctactgcttatgtgagttcaaatgctttcaacacgcctgtgaattccttaaataaatcaccatcttggaacccagtgatgcacttaggatatctggattgtaaatctcatgcttgagtttgaatttaggagctttggattccctcccactgacctttaccaaaagtctagctccattattcagtagctgtgcgacctcatcgaggttggcagagcttactaagcctcaagctttcctatgtatagtatggtggtaacaacacctacctttttaatggtggatatgtggattaaagtaaattaggtatacaaaatactttattttgtgcaccactaccacctatgtattattgcatagtagtctctgtgtattattttttcctctcttctcttgacaaaatataaaaatttttataatcagtagtataggaatttcaaggaagtgtgggacacatacattaagaaagttaactttggtccaattatggctcttgtgatatctgttgcttatctcagttcaacataattagactcataatttctaactatacatgccacatttctatagaaggctagggctgtttaaagaaaaacttaagatggggatgctcacattcacttcaatgtctgttgattatggaggtatgtcttgcaatagaaagcgtgttgacacaacccagacaactctcatccctcttctgaaagtcagatacctttaaaagcagtctcttgcaaaggatgaagaacccatgcttgatgagttactttcatatgcatcaaaatgacttaaaagtggtcctgttggtaatctaagcagcctcaggtttagtgagcatagttgtcagtgcataaatcgctgtgtaaggttttattttttcttgagaaggaaattagtgtggtaagattttctgatttccttctatgcaaactcaacagtagaaaagtggatttatgaatttatatgtatgattttcccttaattatctttaataataactagatgatcttaattatagtaaaccattttcctctgccaggctgtttatattgcagcagtatcttcttgtacagcaatcagaaaaggattcttttaaaataatgaaaacatcactagataatatatatagaattgattattactcaccagaggtaatacagacctgcctaatatcaaatgtatagtttcgaccatgatgaatcaaggtaaatattgatgattaatggaatttttatttagttgggaatattacaaaggaccacaaacttggtggcttaaacagacatttgttttctcacagttcagaagtctgaaatcaaggtttattagccaggttggttcttctcagggctgtgagggaaggatctgttccagcctttctccttgacatatagatggccatctccttcctatgtctctccatatgtcttcctctgtcttccctctgtaagtatctgtctctgtccccagatttctctgcttttataaggacatcagtcatattgaattcaggcccaccctaattgcattattttaactcgattacctctttagagacctatgtccaagtaagatcacatttggaagtacttggggttagaactccaacacatgtttttttttggaggggttggggaacaaaatttagttcatcataactgggttaatgatagttaacatttattgagtgactttcatgttccagatgctatatatatacatatgcacatttatgtgagtgtatatgtatatatatgcatgtatgtatatatagatatgtaatatccaatatatgtatgcatatatgttttatgatccttgcaacagccctgtgaggaagatgttatttctcccattttgcaggtgagaaaacaaaatgtcagagaggataagcaatttgtccaaagtcatatagcttgtaaatattcaatgctggtatttgaacctagcatcccgtgctgcttttaaatggataaacctgataaaaactcagtcaaaagcccaaagatactttgaacatttaaggtttttgtgttttgttgttgttgttgttgttgtcattaggacttgtgtcaagggacattttatctatcaaaaatggtgcataaatgcctaatcactgactgccgacgtgtttactcctgaattttttactgacaattgtcttcgaaggcttagtgttttagcgctcctgaacctgataaagcttttggacaggatggaatctgaacatagactgcaagcgttgattctggcccccatttgtatggatggcactgagagacaagtcatgcccagagtctgctactcagcacttgtgctttctactctccttttctctcactccctccccttcctcatcttttttttttcactatttaccaggtagcttgtgatttttttcttttatccagtctttgccataagtgataaacatcaaaaggggatggagtgaagagtcacaaaattgggaacatttctgcttacatgaaagccagttcacttgtaggtgtgttgtgtaccctggccacaggcttattgttattcacactaaagagcaaggcacattgtgtaccttacataagttttccaacttaccaatgaaaacagtttgtttctcactttgaagctttaaagcagaacttgttcatgacccaatttcactaataattctcttaagtaacccttgtactcatttaaagatttttttccacccactgtctgtctagcctggtttaaaatttttatatatgtacttttaaaaaattgattagctggagagctgcccattcctctgtgctgtataataaggattttaaaactgcacactgaattctgtatagtgtaattaaaactgacccacatttggacctgagtacaccaggacttagccaaacttgccatgagctgagttctggtggcagatgggaactaatgaggacacactccactccagaatttcccagctgcttggcccctttttgtacaaacaaggtttggagcgaagtccggatcccaagagcatgttctgtaaatgtgctgtacccaatgatttgggaaatgttctcacaaaattgggctgtttcaaggtatccataaggcctcagtgactttcagatttaaattcaaagaggcctttgtgctttctacaaccaatttttaattttaaagtgaataaaacatcgcattcccccatcttttctcttatgcctggtgatggaatgatcactttatatcacaacctggaaatttgcaggtcattatctcagagacagttgtccatcaggatagacaaagtctccttgcaacctatggatctcttcaactagtttgatgtcctgggactattcaggcagatgtaattgaatcagtttgaagcagctgtagctggcatgtggtctctcagattgctagcacctgcttgtttttttgcaactcactagagtgagagaagtgccaaaaccagcattggtcttggagcagataaagcactccagatcttatatcccattccccttccaacctagccacatcatcactggtgccgaaattaataaaatcccttttcatgattaggtctgaggtatacttttacttctcattcttctctgtattcagatcctgacagtactgaccatgcaaatccaaaaaaataagggagtataatggtgatcaggtggctttggggctctcttatcattagacaactgggtagcctgtggtttgcagaatcatttaaatgaatgcaccaaatttatttgctgttccagcacagtcttattggcacagagaataagcagttaatgtataacaaactgtgagctgttatggaatatgatgaatacacttccttagcaagacggaatgtaaaatggagctatctctctaaaataaggtctaaactaaccactgtggatttcttcaacacttactatgtgcaggaaaatgaagtatactaaaagagagatacaaattttaggacataataagtatgtaaaatatattttgaaatacacagatttggatattttttttttttggagatggagtctcgctctgtcgcccaggctggagtgcagaggcgcgatcacggctcactgcaacctccacttcctgggttcaaacaattctcctgcctcagccttccgagtagctgggactacaggtgcccgccaccacacccgtctagttttttgtattttagtagagacggggtttcaccatgttgcccgggctggtctcaaactcctgagctcaggcaatccacctgcctgggcctcccaaagtgctaggattacaggcatgagccaccacgcctggctggatttttaaaaaatgtttaaactcatttaagaagtagttatcttctctttgtttcattttattatttggcaggtatatatttaatcgttaagtgttatcaatatcctaatgttgaatttgaatctggtcatggtaaagacaatatatttacttacattttatagcttatgttacaaagtttttctaaaatgggttcaatattgataatattttgagagaagctatgacataaatggagttcacaatagtaataagagtgaattctaaaatggtaatttattgtcatcagcaaatgcctatgtttcaaggcatgactacatgctgtgagcatagagaagtattacatgcaagaatcttatgatacttgaggagacatgatacaggttttttaaaaaataaaacaaggcactctcagtgtcaaattgcatgcttagacctggatttggtgtaaaataaatgctacaaacattttttttaagttaggcagtctatttgtgaagtcaatgttctaaattcagcatcccctgtctccccttcactgtccatgaaacaacactaatccattatggctgtctctgtcactacaccaaaacttgacctcagagtccctctgaagacagtactttgacagccataccaattgttggaagtttcatgtaataggaaacccatttgccattgttgaaaaagaatcattaagtgctaaagatatttagtggaggcagagatctctgtgaactgctgggaagaggctgaacttaagctgggccttgaaaaaaacatgaagcataggacataaggaaatagaaaggagaacatcaagcatcgccaagctaagtaatgcatacaagtgagttcagattggaattatgtggcatagtcaaagataacgaatagacctcaggtgtaaataaataagtggttatataattattagtttaatgtttttctcctccgccagactgtaaactctgtgaaatgtgataatattattattatttttcttccttttttattatactttaagttctagggtacatgtgcacaatgtgcaggtttgttacatatgtatacatgtgccatgttggtgtgctgcaccccttaacttgtcatttacattaggtacatctcctaatgcaatccctcccccgtctccccaccccaggacaggcccggtgtgtgatgttccccaccctgtgtccaagtgttctcattgttcaattcccacctatgagtgagaacatgcggtatttggttttctgtccttgtgacagtttgctcagaatgatggtttctagcttcatccatgtccctacgctactcagaccatcctatccgagttagatctcccatgtgtttctgtaggttcttattgttttcattcacatacacaatttacttcacagtttacggtgcagattatcactgccaagattctgtatgaggaatataggggaactcaaagaagattttgttctttttaaatttatttaagaacaataattttttaagaagctgatttttatttttataaatactgtggtgctttcaacactggcttggaggaatttctattttaactgcagtatttaagaattttactgttaatacatatctctggtttcagggaataaagagacaatataatagagtagaaagagtacagggtttagaaatagaagagagggatttaagtttctctgttatcacttattggctatgagatataggcagctcttcgtgtgcttttacgctcagtttcctcatctgtaaattagagatgacaacataccaaagcactttaaaattaaaaacatctcttcttcttcctcctctcattagtcatcataatcataatgctattctgaaaccatgtaataaaatatggtcttctgtatagatccttttttttctaccacttattatttgctctagttattgcagatttactctacaccttgagtagagcattatactaatctaaaaagaagcaagaattccagaaacaccctataacctagtcatggctaatatttactgttgagttatttgcacctcaataacagttctctgtcatttgtaatataactgcttaatattaataatttatgtattaaaagtaaatgttttataccaatcccaaacagtgcctttttatgatttattttttattcactcattcatttaatgcaaattattgtagctactgacacaaatgtattcactttctacctgattatataggaataccctaattatctatattcacatcttattgaacttataaagtgttaggagaccagtgtctgagaaaaaaagtcaaatataaatagattcatctctgagttgtaagaaccttttgttcccacctttagaatatttggtgactaattaattactaatagtaattaatgcacaactcttaagttaaaaaaccaaaagaaaaagaatttgatatttgcagttttctaggaagttaacgttttcattctttcctgctttaaacatgtaatatctaatagttaatatctgcatgtatcatccttatggttttgagagtctttaagggaaattatgaatacaatttctatttttctaaacgaaaggatttctgtgcattagggtaaaaatgtgtgaatagatatttcacacattcatatttgtgtaaaatatattttcaaaatatatttcttaagctatttaaaaatatatttttaaaagtatttaaactttttacactacatttcattgttatattttgttaagcatatcaaaagaagattataccacaggttatgactttttaaaggtaaaaaaattaaataaggtaggactatctgaaagttaagatttaagtgtaagtacataaaaatatgcacagaaagtaaatagagatattgaaaattaactaaaatgttgcttctataatggcttaaatttgtgtagcaaataggatagctgagtttagtattacttaagaaatggttaattttgtatatcaggagacaattcaaacataatctttaatcatgctgatctgatgcctcaagccgtgatctgtatacttattagggtctttgccaagtctcatgatagtatatactctagaccaaaataaaattgattttcctctatgtaaatttgttactgatattatatttaaatttccattgatgaaaaataggtatatttactctctgaatcaagttcttcaggaacataaataattttttatttgagaactgatttatgtccaattaagtaatttccagtatacttttgctattgatcatatatcattgtaagatattaattatttacatcaatataccacttggatttttaaaaatataaaggcctcactttgtcacccaggctggagtgcagtggcatgatcatggctcactgcagtctcaacctcccaggcagtcctcccatctcagcttcccagtagctgggactacaggtgtgcaccaccatgctcagcagatgtttaaattttttttttgtagaaatgggggtctcactatgttgcccatgctggtctcaaactcctgggctccagcagtcctcctgcctcagcctcccaaagtgctggatttacaggcgtgagccactgcacccagcctattaattttcttttctttctttctttctttttttttttttaatgaccaattccacgttaagatcagtttctggcttgcttgaaaggattggatcagaagatgttgcatcacttttggagggcatctgcatttgatttaagagggaacagctccaaatagagggcagtacatttcgtttgaggcttactactaccagaaaccatcactgcaacctcttaagttttctcattgatttttatttgtccttatgtgctcctatcaattgggggctttgagatcactatttacacttataaaacttctgtatgtcttcctctgttttagtcctagagagtacagggaaagtgtactagttacctatggctgctgtagtaaattatgataaactgggtgacttaaaaacgacagaaatttattctctcacagttctggaggctagaaatcagaaatcaaaatgcagcagggccacattccctctgaaggctcacagtgaaaatctttccctggctcttccagcttctgatggtcccatttattctttggcttttggcactatgacgtcaaactctgccttcatctttacagcaccttcccctctgtatgtgtccctctgtgtcctctcctcctattaaaagcatatcagttattggatttagggcccaccttaaatccaggatgattttatctcatggttcttaattagttgcatctgcaaggaccgtatctcccaggaatgttacattctgaggttccaggtgaacatgaaattttggggactctagtcaacattcaacctactatagagagtaatgttattttttggtagtaaatatctatggaagacttatttacacactgctatggtttgaatttttgtcccctccaaaactcatgttgaaagttaagccccagtgtggcagtattgagagctggggcctttaagaggtgggtcatgagggcccatgaatggatgagtcttttcttgggttaatgaattactgggttatcatgggaatgggactggtagctttatagaaacataaagagagacctgcgctagcacagtctgcccccttgccatgtgatgtcctacgttgtctcaggattctagagtgttgtcacggcaagaaggctttcaccagttttgctccctcaaccttggacttcccagcctccaactataagagataaatttcctttcttataaattgctgagttacaagtattccgttataggcgacaggaaacagactaagacatatgctaacatgttaattatttttcccctcggtatttgacaaagtttatcctgtcctctgtttttagaatacttgtagccttagcaccttggtattttttatgaatttcatggaattatgaatcattttctgtcatacttttttaaactactgaaacttctcattatagatgacaaggttgaggcatagaataggtaaccaacagtcactaactctgcagatggactgcagaactaaaaactgacattggtatcatccaacttttctgtcaatccatgtgtgttgagatgccaaatatactcttatagtccatggtactttcacataactttacttgtgacctaagtaaatcaagagttgcagaaaatgtttttcgtaatgatctccagataatataagccaagtatacaattgaaatttagtgtcgtagatggacaaaagtattgtgctggatgactgcatgttgagatcacaatccgtctaatttctctgcttagcatcggccaggtctttattagagaactatggatatggccatacgtacaaatacacatccattaaatgaacactggaatcatgaatatccaggtctagattaaaagagcaagcccaaggctcagaaagttaatttctaactttaaatagctagtaaatggctgacacaggactaaactcagctctgctcaactcagacacctgtttttctatttctcccaagttgattctcaaactgcaggaaatctttgtgttttccccttttaagtaaggagcagaccactattagggtgagtgggtagagggagcagaaggtgaagtaaaccattcctaaaataattgggatataattggaagcatttgctgaccctttccacctcatggttgtaggatattacaagtatgttttctttaagaatgctcaataagccaacatagataaatttgaattttaaacatagataattaatagagtgattatattaattaatcagaaccagtattataggtctcatctactgaacatttcttttaactttcagctcttttggtgcacttctgttctggataaaatataattgtatgctcagaggacagaaaaattttacaaatgagcttaggcttccctgccagaaaagaaaggatgaaatagaaatgaaaatgaaaattaagtaatccctgaaatgataatatagttaaatgtgaaaatatgcctttgataataccaaactgggatttgcacccaaaacacattaattgaattaacctgttttagtttgtcttgtatctgttgccgaaaaaaaaaaaagaagaaactattattttgttagatagcagatttctttctggtgttgattactcttctatcatgagtaaataattacaattcagttgatctcaggcactagagacagagctctgaactagaagaccgagagagagacactaaacaaattaacatacaactacaacaaaaaggatgaagaatggctggtaatccggaggcagggtgtaggtgtcctttctgaggaaataaagtttgaattataagacttgaatgacgtgaaggagccattcaagggaagatcttgtgtacaagaaatgcaatctctaaatcattacaggttacacagagttgtgcatccaaggtttgtgtgtattagagtagctgtggcaagggaggagtgttctgtcaactattaacaatgtacagttgggaggtctgcttcttcaggggcaaccagtttatcctcctctttatcctggtactaaatatagccatagtaagcatttgggaatggattaaaaatgcttaaccaaatctccttaaactttgccatatcctataaattttaaccatatctcctgaaattttgttatttctgaaagcagaactaagtttggccacaaagggagggattgaattcattgctactcttagctctccctagcaatttcattgtctgctctggtaccagggtttgttagaggagctacaggggtttttgagccatcatttctccctttcgcaaatcacttcttcaagtagtagtatcagcccttttcctccttttctgtatatcaagactgaaactgaaaatgaagggttaaacttatttttttttattagtctcataggagcccaagatttaacatagaactttttcggaatatatagttatctctccatttgaggtgagcacaggatgtctatttttctcatttctactttcatcttgaaacagaaatttcaccaaaagcttcattcaaaatgttttattcatagctaagcaaagatgtatggtagtaaatcattgaaactgatgatctttgattgaattttccttagtttaatgtgtctaatcaactgttcattcaccacattattttcccattgctcgatgttataccagataacagtattaccatgacccaggctgatactatgtgaaaaaatgcacaaggaagtaggccgtctactgtgaacatttgaaaaacacagtcagatgacagtttcagaaattgtgaggtttttagatgtgagaatctaacttttttcactacagatactaaaaatctatcaatatactttttagtaggctttagccacatcctaatttacaaatgtacctatggtgtgtgattaagaacacaccggccgggcgcggtggctcacgcctgtaatcccagcactttgggaggccgaggcgggcggatcacgaggtcaggagatcgacaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcctgccactgcactccagcctgggcgacagagcgagactccgtctcaaaaaaaaaaaaaaaaaaaaaaaaaaagaacacaccattcttaccagttataccccttgaatcttaccaaggaaattcccatggttctgtccttatcacaatggaacccagaaatgaaggaatgaactacttgctttcttagaaataccacagtgcagactttgctgtatctaacagatatgaccatataatttgtcatctgaataacgatcgagagatttttgctttaaaaatatataaccaaatgataggaatattaagtcacaatggaagaaggccattattatactgaagcctcaagtaccacaaattaaaaacaagatggatattactattttaacttgtgagcatgcactatcaggttatccaatatcaaaaacatattaagagtgcttgtggcaatatatacctgaattataaatgaatgttgatattttgacattattttgtatatatgagagcattaatcaaggttagattcaacaagtcagcttcgtggttgtggctttaagttggcagtgaagtatgtaagtaatacatttctgatcagttttgtttgatagtcttgtttcaacaccttggcagaactaaaccattgagacccagaggtacttgtgcatggggatggtctttaagataatatttagtttattcaatgagccaaaattttcagtacatttattgtttgtttttgtcataaagacatggctacagtctacatacaaaataccaagtagagatttgtttattgtagtaggtacaggtgctcaaaattgatatttaagtctcaaacatatttttccaccattctgtattggattattaacacatgaaaatatgtactgttagaactataaggtaacttacagattattctttgagctaatttaattattattttacaaatgaggaaatgaaatcccagtgaagttgaatgatttactgtgggactagagaagtctagaatgagaaatttaacagtgcagtactctttacttccatgtatatacctttcaccatttaccattacactgaacaatctttctgctatttgtatttttaaaatgtgctcacagggttaaaaaatttgaatggtacacaaggatataaagtgaaaagtatgtctttaccgactgatagcactattcaccagagataaaaagtttcaactgtacttgcgtagagaaatgtgtctatatacctttaatttaaaaacagaaagggaatcatactgttcaaatacatttgtacttttttcttaatgccatgtcttagagattttatatattctagaaattttatagtgtttatattttggtatattatattttaccttttcctctttttaaacagctacttaatatttccattttatggatgtcacaaaatgtatttaaccactgcctatttatggaaatttggttatttacagtttcttcgctgtttaaaaatattacaaaacagctttctaaatatatccttgtttttattttaatatccacatagcatactttcttagatatgtttatataattaaaattttgatgcctgttaaaaattttccttcaaaaacatttttctgacacacacatgtaacaacattatatgagaattcctgctttctcacagcctcatcagtactgggctttagcaaatttttcctaatcagaaaagtgaaaatgatatttcaccattgttttgatttacatttctttactcaggagttagattaaacaacatattaaaatttcactggccatttacatttttgtttacttttttgtgaattggctataatacttttctgtatttttctattgagtttttaaaaatattttattggtttgtatagcctctttgtatattatggaaaataaattttctgtagtatgtgttagacatatttcttggttattaatttgctttttgagttttgtatatgtagaaaaattttttatgtagtttcattttttcaataatttcctttatggcttagaaaacttcttacaccagaaaaattactcagattttcttctagcacatttatgatttagtctcttaatatttacatctttgattcaaccaaaacttatttttgagaatgaaaataaagtttaattttatcacttgaaataaaagcaccaatttttttaattctttgaaatttcatgaattttagatttttctgaagctttatgaactttttaggaaggcagcgatcatcactaaggtaaaaagaaagcatattagaccaagaaatgtaattttaaaattgacatttcttattacttatcaatccctgatgtctattcttggtgacataggaaaatcccaagaaaacatcttctttataaaaatatataattatattttgctaatttaagcaatgattaaatcagtgaaaccatcatagaataaatcaaacccctagtgagatacttttaacagcaaatccagttcatatggtaatactaattttatttacttaacaaaagcacttacttatcagtaagaccctatatctgtacaaatgaaatcaaaatgtgaaagttgtaatttaagcgggacacaatagcttggtgataaatagatttatttgtaccttgaaaagttcacttcaagtaatcattgttattaaaaggcaattatttcacatggtttttgtaagcataaaaagcagattggagactctttctaagagttgtgctgactgacatctttgtaagatttgtaaataagtgaaagatccattcagctagaaaagttgaatattcagtaataaaagaacattgaccagtttaacatctattatatttacatctgtagttgacaaggagagaagtaaatataggtgaaatgtgaaatctaagtaggagagagggattaggaaatgtcatttaacttttttcctactcttcattttatttttaatatcatatttatatttcctttctaaaagtagtacgctatcagtgtaaaactatttggaaaacacaaaaagacagaaagaagacaagaaaatcaccattgatattactattaccacttaaagaaaaagttattcttaatattttggtgtgtatatgtatgtgtgcatgcaacaacataggattatgcaaggttatgattctgatttttcaactagcaatatattatgaatatttgtttctgtcaatattttttgtgacatgatttttttaattgattatatagtattccatacaatggatgtgttataatttacctagctgatctctaatttttggacatgtaagttgcttccaatttttctccagtaaacatgaattacaatgaatattattgtgacaatcttttttataaacatccctgattatgtcatcaggtaaatacttaagtgtaataattgaatcaaagatatatgtattttaagggttttgatacatttagctataccatttacacattgctgtgtctgtcccagcagtctctgaaagtatctatttgttcatatcctcatcagttcttggcataaaacttaatatggttcaaagaaaaactctcagtggtctgggaagaatgaatacaaagaggtgggaagaggtcaagcagaggtaagtgatgtttttgtctaagagatgttgcaggcagcctcaggctatggagaacagctttctccaaagcaaacttgcactttcaaaggcggcccggactctgcgtgctaacttggcacagttgagatgtctctgtttgctttaaggcagtggcctgacccttcaagcacaccccatgtattcagtgatcgagaccacttactcatactaatcattgcacacagaaaatacataaaagatttgtattcatcactcaatatattttgctcctcaagtgtcatgaaacattcagggtacattaactggcaaatgcacacctggagtatgttacttagctttagaaactgctaatttttaaaaaatcaaatatttaattttgaggaaaaaaatcagttttggattttgagcatatatatcatctttcattttggcccaattaacccagcaggtgtgtgtaaattaggtcactactttgtcaccgtggtaacatgcattggggaggtggatcttaaccacctccagcacaggtgatgttggctgagttggtattaagaggtgctttagaaacaaacaaggcagaatttaatatgttagagtgtagaaaataggtctgacgtcggataccaacagataattctatcacacaaaagcaagtactgcctcaaatccgtataaataaggaagatctaatgagcctcagaaacaggaattgtattgtaaaacttactgacaatctctgaaagaacagacactatagcactcaggaggcggtagtctcatttcctcatggagcaagggatttgaaggtcagggtcaggttctctgcaatttaaggctgtttttagaactaagccgtggttttcggaggatcaacaacttcctgactactcattccagtgactagattttagtcactactgagggtttttttttaaagtgcagtgtctaattatttcttttaaatgctgtttggatcattattcataattgtttatgggttaagaagttggcagagttggtttatgccagcactccagcactcatacagtccccataactcaggcttcttctcaccaggtggaaaatcagacatgcttcaagatcgctagttgagattgtgcaatctgtttggctgctaaaggttccaaattatgtgggcattctgcagccccacagagtggtagaatttcttcacttatcactgacaagttcacacttctttgggtcactaaaattgtaaatttgcattatcagatgcagaaaacaggccaaattaataatgttaaatatatgtccaaggaaatgcatctcccatgaccatttgcagcacccagatacggatgataattccatcgaggctttggtgccaattcgtacctggctttataattttcagtttgcccttatgtcctgctttacatttgtatagcttgttataatcttgaagcatttttgtgtaccatatttcttttttgtgtgttattttagacatggcatttcagaaacttgaatgagcctagtgtttattttcagttggttgtgaccgcagctttattagttattttgtgtgttttcaataattgttaatatttacaaaacactgaacaaacctcttcaagattgctttacataatctccttttccatgtgtcaaggatgagagctacagagagaagagtcatagtgactcaccccgtatcacagagtatgtgaatttactttcaaaggagagtcaagggtccctggttttcagttcttttttttttttttttttttaattctccaagagtcatgcaggtttggagacttacaaagggatagcattgctgagtggagaaacatttgactcaagtactcttttacccctaacatctattttaccatttccctccctatattcaagtcttcttttccatcatctctccagtagatgctgaaaaccatttctttttgaagagctggttcatatgataaagacccaaagtctcaataaaatctattaacctgttaagggtaagtgtatgcattgttcactggagagcatgatgccatattctaccctgtctgcttgggaacaaggccgatggcagcacaaattagcatcagaacagagctttatcgcagtggaatcccaggttgttttaggaatgagacacgaaacaaaaatagataaagggattaaatctatcaaatataatagaggaaattgtagtagattcagggaacttggacccctgaattgtagtaaccaaactggagaggaaatggacagttaaacaaagtagggctgtttctttttttcattgtttgatgaaataatttttgccccttttaaatggtatgttaaaagagaaagagggagcctggtatatctgaaacaaagagcttacacagtcaccaagctggttggtttttataccttcctttactgagtattgtccttcagtacaatacagagccatttctttgttctcacaagctagcagttaaattgtatgtaaatgtatgcaaattagatgctgtctaataaagagagtcattagatggaagaaatatttagtttagaaaaaaaagcaggtgtattgtgtaaaagaaaatgtaaggctacaaaaaaagcccaaacttttgtggacagttatagaaaaaattattaaaatagatttttaaaagacttacgtcttcctgacctttcttttgtgcttatatatatgtgtgtgttttaaaaatatttacatataaaactaagggattggcttctttcccagaattactggaagcaccttcaccaggaacatttggacttgaataatctccacagcagcattttccttcttgaattaaatgaattgtaaaatgaatgatttgcccaagaacactgactgcttatttgggttcctttcccgtaggttgatagaggcttagtggctccatgatgtgtatcttgctattttaaggtttcctttccacactactccactccagcctctctaatatgaacttcttaatagagacctagactataagctccttgagaggaaccaacagttccttttaaactttatcaatgctgtattcagtgtttagcacaatgcctagtatttactagcacttctatctattttttaataaatgaatggttggttttaatggttgattaagtagttatgggtatgtcaaacacctttgtattctctagcatatagttattgaaacaatttctcaggcttgcatttagcaattatatagtaaatgcctagtgaaaaaaatagtttaccatccagtttccttaagccaactgtaacaaaggtgttgagtgttcaccactacattatttattgtggcagctatttctggggcaaaaatgaataggcagcatagttctgtttaggagcagctaatctactaaaggtatcagatagatatacacatatttaataaatagtacactgtactatggaagcatgagataaaatattatggaagcattagagagaaagagagaatttccaatctatgggtatcataggtggtttcttggaggaaagtggaactgaactaagcctcgaagttggtaaggaacagatggttggctatggtagggtggagaaaagcagagttgcagaattctcttatgttgtagtcccaaattaatagtaatgtactagattttcttctcctctcttgtgaatttccagcaacagcttgattttaacctccacagaaacacaaatgagagctgtgatggaaacaataattactagagtccagttttaactccaagtcaaaattttagtcacattcagccctgaataagaaataaggcaaagcatgcaacaggactttataactttttaattttaaggcattataaatataaatttttattttatcttatttttttagagatggggtcttgctctgttgcccagacaggagtgtagtggcaccttcttagcttactgcagccttgaactgttgggctcaagcgatccttctgcctcagcctgctgagtatgaggatgcaaaggcataagaatgacacaatggactttagggaccagggggaaagggtgtgagggataaaagactacaaattgtgtgcagtgtatactgctcaagtgatgagtgcaccaaaatctcacaaatcaccactaaagaacttactcatgtaaccaaacaccacctgttccccaataacctatgagaataaaaaattaaaaaaaaaaaaaacaaactacaggtgcatgccaccataccccgctaattttaaaaaaaattttgtagagatggggatcttgctgttttgcccaggctggtcttgaactcctggcctcaagtgatcttcctgccttggcctcccaaagtgctggggttacaggtgtgagccactgcactgagcctaaaatttattattcataatgtataatattgtccatggtgtgaaataaaatttgggggataggagatttagggacctagaatggaatacctcatgtacgtaaagtgtcttgcagttcacaaagcaccttcctaaattattattttaattacagttattgaggtagcagaactggtgttattattttaattttgcagatgagggaactgaggttccaaaaagttaaatcacttagccaggaaatgtcatagccaggtttttctgataggttgtccagttctttccacatgcctcattgtcacccagaagcaacacaagggagggttatatagttctatataactctctctatgcttctatacgcatcatatatcttgttttctaatgttattctaaatatttttcattcacttggttttatatccccattttctccattttaacatgggtaaaatatgtaagacccaaactgagggagatgtgtatgggtaagaaactgattattttggtaactggtatggatatgaaaaccataacgagtctgtggattgcaagcattttaatttattttcttgacttttgagttaaagaaaagatttcaatgtgaaggtgcaaaatatgctgcactgaactaatcttggaggtaaccaaagggctgtgggactaacagcttttgatattacttagtgcttattattgttattattattatttctttttaattatgcaaagtgctaatcagtttgattatgcacagtgctaatcaggttaattatgcaaagtgctaatcagttcttcttgaagcacacgaggagagcagaggtgctggcggtgaatggcatagctagatgggggtagtcacggcagtcattccttattaagataggagtagacaagatagcaagggggatttatccataaaaataaataggaaaagaaagaggactatgagcacatgaaagattgtagtttgggcaggacattgcttacacatagaaagctcctcccccctgtagcatagtttggttggatagtctctgctatattttgaaggcactcatttgaagccaaaaagactgtagagggaaggaaacagagtattgtatagctagacaagttgtcaaaacaacttattgtagttggcaagcaccaattcctgggaggacagtaaaggaagtagaatctaatagacctgtacatgaaaaaggacatcaataaagagaactgaaaaattaagggagtgccattctgataaaataaacagggccatctcactgctgcattgttactgggacggccgtctgtgtagcctgtttcctgaggtgaactgagggctggcttcttggtgctggcagtggtctctattgagagtggtgatgacgaatatgacaataagggttttatgtaatagctcctagttggatcagctttgctgctgctgaaatcaaagtgaattttaatattaacttgcaggtctgtgcttattaagctgtgtgacttcctgtgaagatgagtttatagcaatatgttcatatgtttttacagaacaatcatgatggtgctcccttaagaatgccctttgtattctgtcctcctgttctattctgtggtttgataagctatcaatgaaatgctgtgatatctacttgtttgaatgtattcagagagcaaaaagcatttcaggattgtttagtgaatattcatttttttaaaaaatgttttcagtccatgagatttttcctttactctggagtttaagcaaatgtatacgttatttataaaagggagggtctgcttccctctatataacctgacagaatatttatttaccttttctttttaagcctatgtctaagcacagctcatcttcacaaactgaagtggatcttgatttctggaaatgtccaaataatggtaagagtgctacagaggcaaagtcattgatgatacctccagaataggatgtattcataagttatttgtccaggcagtgttggttcttggataaagacaggctttcagttttcataatttctttaacctggaacaatttcattttaaaatatgaagagaatgacataaatctttggtttccaaggagagtctggaaagaaatagattgttagaggacagcgcccacaaattgagaaagcctgttgggggccctttgggaatttggctggaaaattatgttataagcagtccttctgctcagcttcatgggaacatggttttagaaatgaaatattgcttctgtgttccccaccccccaaaactaagacaaagatgaaatattcatattatcctttattttcagaaccttttgtgttatttctcaatatgttaaaaaactttccttaattccttaatgattctgcccaaagggtactttgtaaattctattcattgatggtgtactaaactcttaattcctggtgaaggcatttgaagccaaagaccttgctacataagacatttataatgtcactgggatgtttaaaggagaaaatcatgtgatccaaatggcaaataaaaataaatttagtaacatctaactaaatatgaccagttttccatttaattacatgcttgcacccactttacacacattcacatatatgaacccgttaattccttcactaaaccgtgttatttgagcacctgattttttttaagtgctcactatgtgctagttatagtaccataaactctcctagatactggagatacagttgaccataaaagagacaagatacctggcctcgtggagctcactcacacaggataacatgatagtttctcatgatattcagccttagaaaccaagcttttgtatttcatttcttctcagaacttcttttagcaatctatatgattcaattactgggcctcagtatcttcaattagtctcaaaataagaggtaggacttgatggttctcaaggcaccttcatgtcattcatattcactgtcctaaagtctattagttgattagactatgaagtgaaatgtatccattattaccatatgagcagccttgaaatcatacagagttctttgggactttgatcttttaggaaataagtaatttctagctaattctgtggacactacctccttggatttaggccaaaattgaatttagaaagggcggactttgaaatattccacagtttgaattttggcacttgcagttactagctgagcaagtcataaccaaccactttgatcctctgattcctcttagtttgtacttcaaacagtgagtatgagtatttaataaatactccatagtcagtccttttttttttttatttctggcaactgtaggcttcatgactcttgttaccaaaaatgtcttcaactaattcaacttcctttccccaaacgtcttatttctgcattaagccattacttcagttaactcagtattttctctcccattacatctttacagttttatttcttcctgttctctttcttatgtgcttttacttctctactcaacctgagtcaacttttggctacttaaattatcatatgtaacataatcttggttacaacacaaaatgtgtgcaactataattcaagtcaattaaatagaaatatgttttctacatcagacctgtgccgtagttgtttatatttttgacttactagtgtactggaaacctcttgagtacaagggttgtggttttaatccttgtgttcccagtatctagcatggattctgccagtaagcatgtcacaatctagcaagaagaaagaatttgaaagcagtaggaattttaaagcaacaggatatatgatctgttagtaggaaagtggagatgttgggaaaggctcatggaatagatattgggaaggctttatggagcaaataatatttgagtttgcttatttaaaaagggtacttattctttttttcctggcgggaagtgaaagtaaactctaggcagagagaagatcatgaaaagactcatgcatacataaagttgggaggaactgggaccaggagacagaaacgaagacaagaagggaagattaggagcatattttgaaggtcctatgtgttgtttagtcttacttgaataatcttagctttccaaaataagtatatatagttgtggtatagagagtgtggtgttgcaataagatgatcattagcttttttatgaagaagaaataataagacttagcaactgattaatacaagaaaaaagacaatgagagatcatgtcagaaagaacatctggatctgggttgcagccccactccacacttgatttgtgaccttaaatacttaacttcatcttcctaaaccacatatcttttaagatcactcactcactgattattattgaagagggcccctattccggatgctttggatcccagaggttgagaataattggtgttttttaaggagaaagatacattttataccagtagcacatttagcctaagctggtattagggcatttgggaagatgaaaaggaagacatataaaagcaatatgttctggccagaaaaaggcaaaaaggaccctaaaactaaagtagagttatagcttagagtatctaagaaggcagagatactgaaagatgtatttagcagagctctgcatttgggggtgaacatctatccatggacctaaagagatcatagattgccctgatttgtctaccctctatgtaggaagttaactcctgtgattggtaactaaccaaaaaattaaaagaaaggggagatggggcaggggagataataagagggtatttgccagtggtttacaaagctttgaggtgtacgtgtatgtggttgggacaaggttaatttcatgtcagtagtcatggccttctcctttcttgtatcacagaaaagacttcttcttctcattctcttccatttcttctaagaactctcttcatgccagctaggtgtcaaaacttgggtagtgtggaattgggggaatgaaaaatagaactggaaaagtgatcataggggaggggaactcaaaagtgacaaaatttcacttgggtaaaaggaaggggctagagacaggaaaaatgaggagggaggaaagaaaagtacccataagggatagaagggatggagaaaagacttagaggtgaaagtaagggtagagagagacttttgatgcaaagtggttgtccatgtggagaataaagtggccaagactaagaacagagattttctgtcttattcttcttggtattttcttgagaaactgaatgaaatttgactttttaatatatattgaggggtgtgtgcgtgtgtctgtctgtctgtttctgcttggctgctatttctttggatcaaaactagggattacctgtgcagcaactttgttcccacattcccaccaccatcaccactgaagcaaggctcagaattttcagtcctttttagtcagtagacttctgtgattaatgctccattaatcacttgttcttcgtattaagtataaccccataaaaatatgggattggagggagaatggtcaaccagtatgtgattcatactagatgacagtcctctcaagatggccctaatttcttgtgcatttcacctacatgctgatcttaattcatgtgtttttacttgataggggtcagatgaacaaagtaatttcatattaactatgacaaatttgtgcataggtgaaagaaaagacctctacttttcagacattattattttctggaataatctttggggattaggtagccaattaatcaagatccccataagaaatgttagcaagtaagacaatatccagtaaaacactattagccaacattgttattcaggaattaaagttcaggtaggatagctttggcatcatgagattattctctgtgagactgacctattgccaatgacgtatatgtacatgctttaattgatgtgtgggaacttggtgccaccctactgctgagatttcaaggattgtgtgaagattttgtgacagtaattacacactttttatcagatagattttatgtattatcacatgtccaatttagaaattttcctttgtttttatttttggcattaaaaaaggaatgcatacttcataaacttacatttttgctatttgtttgtaagaaaggaattccaagtgggttatgtaacattaagcatatggctacacaaagattagaaaagctgtggccatcaggaataaatattggtgataacactgatgggatttcacacatatagtttattgtgagaaaatcagaaagacttgcacagaacttagataaggaaataggcttgttttttgatgaaaatataaaaggaagcatttgttattaacacggtaggctttgaaatttggctttctacttccacttaagaggaaacaccttaagtctgatgaattttttcctatggtagacagtacttaatctagtattactagattaaaccccttagtaatcaaacattttaaaccaataaaatatctctgaagagcaaaatgtaccactgctccagattcttccatgatgtcaaaaacatagaagcaacaaatgtggacctgatttagtagtcaagggaaaatatgatgtgatggagaattaataaaagactattttaatattgggaatgaaaaactaccacaaatcttaagggtttacattagcagaacttggtttggtttgagtagacttaaaacaagattttgagcgagcttctaaggagttttgaggatcattttttttctgtcatgaatttatgctacataacaaatgcagaaattggagaagtgtaaatctatcatttcttttgacatttatgtagcttcagtaacctcctaagttgagatcatttgagatttttagaacatggatacctctagaaaaaatgaggaggttccagtagctcctcagaaatagcttagcttcacattgaaggaagattcataaggtctttatggagcaaagatatttgatcagaacaaacattcttatcatatggaacctttttcctgcaaaaaaaaatgactgttagggtaattaaattggttatttgcagcttctctcctttcccctcttccctcttccacctgcacagtattgttatattgagttgccatgataagagtaaaaaataatcaaaccaacctatacacatttttattatgaacaaaaaatacttggaaggattctattgatacaagctaatgcaagataataatttgtttattcaaaagtgttttgaatgtccttttccattgatcatgtgcaactggtataaacaaagatcctatgtatggtagagagcttatatttgcatttctttgtatatttaagcatttttagcagacttacatttctgtttattgagagtactctttagaatttgtgcaatcatatgtatatatcagcagcagacatttgggtaggtagtgaaggtaagttctatagtcagtgtaactagaagattatataaattaattatattagttttgatgctttgggtaaaatcagtgtgctacatgaacctccagttacacaggacaatatactgtgctcaaaagacatgaaggcagactaagagtacagaaaagctgttggttttgtttggggagttcctggctttttatccgcttggggaaggagcaggtcttattgtcagttgccaagtgctctgatgctgagaagtttgtcagctgtggttactttggggattttggcaatgataagcacttttccttgagaaaaatcagcatagataccacacattggaattggacaaattgcttttattttctattttctttaaaaatcaaattggcttttccttcttgtcccagctgttgcagcttccttgttttttagcttagatgatgggagaaacacatgttccctgagatccagagtaaagcttacttattttcttcctgtacagactacgtgaagttacgatactggccccaaatctaactaaacaaagttattcagaagagatttgacagagagggtgtctaacaggtgttgagctggggtaattgaatgggtatttcaaagatattaatgtaactcgcatatattagaaagctttaattgccatctccagcatgtttagacctgaaaacttcagggacctaacctgttccatagagaagtctttttatgcccctatggtttatagctggaaacaaagtatgtatgtaagagttggattggggcaggtgcggtggctcactcctgtaatctcagcactttgagaggtggaggcaggtggatcacttgaggccaggagtttgagaccagcctggccaacatggtgagatcccatctctactgaaaataccaagttagccgggcgtggtggggtgcgtctgtaaccctggctactcaggaggctgagtcatgagaatcgctggaatctgggaggtggaggttgcaatgagacgagattgtgccagtgcactccaacctgggtgatagagctgaattggttgaagtagtacacagtaaggcactaaacaaacttgaccttttctataaattccttcactttccctgtaacctgttacttttcaaagggaaagatcacatctatatttctagtcagcttgctatcatggtaaggaaccaagattcccttccagttagggtagtggaagatgaaagtggcttttcttcttgatatctggatcaacctggttttcctgccatctcttatttcataaacaagcttatcatctgacctagctgcagatcgtgttttaaaatttgcccctacccctgctcctctcttaagagccgagtgcccacagaacattatcctcctcatctggacctatctttgctcttactgaagggggctttttcatcctataattccttttctgttggcttttcttgggaaagcagtttaagaaacattcattaactatttctgggtgtcagaaactatgtactatgtttccagagaattggaactaataaaatgtatacctgtatagaagagatgttttataaggaattgactcacatgactgtggaagctcacaagtcccaagatctatagtcagaaagctagagaccccagagagccaattgcgttagtccaacgtattagtccaaaggcttgagacctgggaaagctaatggtatagtcctagtctgaacttccttaggccagagacctgcagagagctgatgtttccagtttgagtctgaagacaggaaaaaaaaaggaatgttccagctcaaaggctgtcaagcaggagaaattccctattacctgtgagagagtcagcctttttgttctgttccagcctccaactgtttggagatgagggaggccaatctgctttactcagttactgattcaaatgttaatctcatccagaaacattctcactgaagtacaccaaataatgtttgaccaaatgtctgagcaccctgtggctcagtcaagttgacctataaaattagccattacacctccattacctaatttaatcctgaccaaaacacaaccccaaaccccatgaagtagacactattggttattatcaccaaatttaatgactaagagtaaggtgtctagagtgagattgcccttactagaattctgtcttcgccccttactgtataacaataggcaaattactcaaccttagtttcttcatctctaaatctgggatgataacactacatacttggttgagttattatgataattaaatggaataatgcatgtaaaacacttagcatcgataactggaacatagcttagtactcagtgaagaacagctattatttaaatacatgaggaaataaagtttcatagtggttaagatctttgcccaaggtcatgtagctagtaactggtgaaattgggatttgaacttaagctgtttgcctccaaaattatgcatttaattcctctctattaatcttaacacagaagtagaataatgtaatggttaagcctctggcgttggactccacggttcaaatcttggctatctcattcaccagaaggctttaggcaagttagttaacttatctgtactttagtttcttaatctctaaaacagaaatgaaatagtatctttcccggagtcacatagaatcagatcatttctagggatactaccttcatccatgaattttaaatgatataatttaagacacaagatttctcctttttccttcaaattatactggttgttattgatatgggtaagtaagatttatgaaatctagtgaagcactaaaaatatgctaacatattcgtaatgttacagatagcatggctttgcaacaaatttcttcagaaacttttttgagagggagaatgaaaatgatagttttcattcagaataattgtaagtgtcttcaaaatgaagttcaaatccatgtataggaggtggaaggaagccaagaaggaatccattataaggtgaaaatcataagtcctctttttgtgactctatcttgcccgtttaatagaagtgatataagtaagatctgccacctaggaccaaatatttctttctctagtacttaagacaagaagacgcagaatttcagaatactgtatgtgggttctcatctgtcaaccaaaagcagctgaaaaggcgagagccctggagaaatgtttcctacatatgtatttgtttttagacaaatgtgtttgtttaaaagtctaaaaaccatggaaatgggtaccatggaaatgcatagttgaggggtagaagccctagaagtgttgactcaattcttgatccttctgtgtgatgtattaaatgccacatgcttcagtttgctgtgtgtggggtctttcagcactatttataatagatggcaatcctgtgtgaaggacataagaaaatttctgattcgtttttcaagagactaatgagaagttggttgtcatctggctgttgcttatgggaggaaaactccagagaaaattataatgtgtatattactcttccttccaaaaaaattttatttgaggttaaaattaatattaagggcagccgtaaaggggaaacataaaatccatatgcagattgaagaagtgtggcaatgaaggggcaaaagttggagttaccctcttgcctcaagtggttggagaaattgtaagccaattgcatatatttcagtcttaacacttttgtatacttctcaatttcttttaaaatttaactccggaagtcatagttagaaatttgtcttctttaccaacttcctccatgcattacctatcgcccatctacctcctaaaatttggagtcttctcaaagcaggcaatatttgtagatagtattatatgaaaatgttggaatccagtgaaaatttttatggtaaacatagatggaaatgtcctctttgctataagatagtagctactttaagtattttttcctttgaataatgttgttcatgtcaattgccaaaaaaaaaaatccttgtaattatatgaaaataaaaaggaaaaaatacttaagaaataggagaccaggagggaaattataattgaatctggaaaccattttttttaaccttggctaaataaataagaaatgataagaggtacaatacaataagaaatgagagatactgaggttcaagcagactgctttatttaactccatttaattttattggattgaatttgatggagacaatgtcaatggacatatatatgaagattggtagcagaattcctggggctgttttatcattgtcatgaacatgtacaaacagaaagggaatgctaagtaattctgaatgtactagtgatttttagataacagatttcagttttacaaattcactgagccagcaggtggaagcagatctgtcacctgtatctagttcttgatttcaatatactaggaaagcaaatacatcaatatcacatttttttcttttcttcctttgccaagatgtatttaggatgttttctcagcattacagaactctcagctaaaagatacgtttcagtttcatttttagaggaagaagaaaatgttaagtgggctgctagcaatttttaattgctgatagcaattaaacaccaaacttaatgtcccttggcctctttggttttcttatagagtgaagtttatatactatagctgaagaattagtttacaagcagaaatacttgtaaaagctgcattttgtgtcctacaagtgaacccaaaggaagtgatattgccttcaagtaacagaacctctcgggcagattatcagagtaaaataaattcagatatgtatacccctcaacaagctatactttggtaagttatgttttgacagaatttgtttagtggacagaggtaggccatgttattgtcccacagggtaacctcaaatgaggtcattagccctggaagcagtgatttccaattagcccatatgtgatagagttgcaaactcttaccaaagactttattaatctctagataatttatcttctaatactttgtgcccttctttatttcttttttattgtagtggcattattcttgaacttatccattaagagttgtaactaggttccaatttgaagaagcccagatgaagcttcagattgtgtttgtatagaacaagttaagaactggcaatatgaataactaatatagataactcagacatttcagaactaatcatttgacctaaattaatttcttagatattggtcagattctctaggtgattttcagatatcccctccactttatggatatatgttgtaattaatcagtatacttactttttgctataatgtcctcctggctactcagaagaaaaccaagtaattgaagccttagtaaattaggagggtaacatggtaaaaacaaacagaagtcactggttcatagaaaaatcttgcctcataattgcattgtatatgaagatattttcctcttatgcccataaacagtaatttaagttctgaaataaggaccttgtctttattcctagaacctcttccaatacctggcacatagtatgtattcaataaataattgttgaataaatgaactttattgtaaagaggatcactattatcctagatttggttatatattgggtcaaataaaatctcttcccttctcctctgcttccaaaagaaaatgtttaatatgatgcccccaacttacaaacaggttgtgtttcaaaattcagacagtttagttttctggaaccaagaaagcttcccttatttatacacttattgcaacaaataccaactgaaccctcactaccatccaggtatgttataggctcggagcatacaatagtgaataagacaccaagtccttgttcacatggactcgtacactttccctcctagaactagatctcttagaactgtgcctggcacaaggtgcacactcaataattgataactactatttttaaagaataaccctactattttcaaggatgtttattcgagttttgaactgagctatcaggtgacttcatatcccaaaacaaaatttgaatggaagcactaggttaaaaaaaaaaaaacagatgccattttaggtatgttcttatcctattttattaatcttccctgggcatccactttcaaaacagaggcatcttaccactttaaaaaaaattatttaccgtgtggccctggcaagtcatagccatgtgactctcacctaaaaataatgaagatatgataatattctaattcacaaagagaacacagcagaacttagtaaattaatgtttgcacagtgcttagaaatctgaggttgtaattgctaaaagaaatgtacagaactattattgctactaaaattatgatagacacttttttctaccaaaaaaatacctcagtgaattggtgtttatatttttaaagttgtatgccacattaaagaaaatgttctatgtgtatctaaaggaaaaacaaataagaatcatgtccctttgttattatgtgatataaaattgcaagggattcactattttggggaaagtaaatagtatttaagaccttatgattcaccagtttggacagatggatgattgcatcttcttacgtaagtgacaggtggcagctctagtgaaatggcttccaaagttcttctgatttttgcttctctttcttatctgttctttggcttggagcaaagtggcaatgcactccaattacaagagtaaggagagttttggagggctgaggtttcgtttttggggggtgtgtgtgtgtgtgtgtttgtgtgtgtgtgtgtgtgtgtggtgtgtgtcttgtcagcattttggttaactccatctattcagtaatctagctaaatggtgggtaataaatgccccacagcaacaggctgtgatttcaaaccaggtctgaacacattcttcctggaatagttattcttccacatagactttgttaattgtctagaatgtgaagggtcattgtaggtgataccttctcttatcagcagaaaataaggtgaggcttaaactgtacaacttaaaggagaataaatttttaaattttaagtattatttatttgacaaatatatagtgagcacctaccatatattaggcacagtactggacactagcaataaactaaggaataagacaaagtatttggttcaaagaagttaaattttattaggggagacagataataagcagtacataatttccggaaaaaaataaatactatgaaaaataataaagtgagataggtagagtaaagttggcaagctatttcagatgtgatggtcagtgtaagtctcctgaagaggtgacatttgaggagaaaccagaataaagagagaagcatgctaaaccctagaggaagagcattccagtcatgggtaacaaaaggtctaaaggccctgaggtgggacttagcttggtgtgtatcagcaaagaagtacttaatgagctttgaaagtctttacaatactgaaaagccagacatagagggttccattcaatctacacatacttgccttatacaacctgtagggttggaagacatgcttatgaggcgattcccagtttcagatcttaagatgtttttgtgatactcttgattttagtgaaaccataaaaaagagtaaaatgccttctgtcaagtagcacaggactatgtctattctgataaaacctgaactttagtccctgaagatgcttttgaaagagaatgccacaagacagttaaagcacaccagtaagatctccaggatgactgtgagggcaggaagtaaagtgaaagcacagcactgcaggtgctttattttcacctttcttccacttagaaagcaactcttctcacaattatcctatagtgcctcctaccctttggtttaactgaccatgtaagatgcattgagtatgagggctatctgttgtaatgacgtaatctctaatgttattctgcctatggaaatctctgattgttctggtaatgctgacacttcttacattatgacaaccattcttgaagagttttgtgaagattaaaaaaaattaagccacagtgtttgatatactagggattgccatctcccccatgaaggcctatagcaaatcattttgtaaaacacatattcagatcctaattttgttgtaatttcagaattttttttttttttgagacggagtcttgctctgttgtcaggctggagtgcagtggcacgatctcggctcactgcaacctccacctcccggtttcaagcgattcccctgcctcagcctcccgagtagctgggactacagtcacacgccaacaagcccggctaattttttgtattttagtagagatggggtttcaccctgttggccaggatggtcttgatctcctgacgtcgtgatccacccatcttggcctcccaaagtgctaggattacaggtgtgagccaccgcgcccggctgtaatttcagaattatagatattgaatgtccatagtgacaaacacctataaaaatagaaaactctccagtactgtttttggaacctgaaagattgggttagtcatttattctgttttgttgttcaaacattgttttaagcctcagatttcaacctatatatatagaatagcagagaggggatgaggtctattagtgacattgtagttgtaaaagtgcagtttgaacctttgctttatttatgtacatactgtactgtcgtttgctctgtgcctttataaaagtaatcaaaaaaaagtatttcttcactagctattgcagtcttttataaaagactgcctttgcttagagcatgctatatattgcagtgtggaatattggaggccattataagaatgtttggaaatagcttgacccctgaaagatatctataaactcaaaaaaaaaaaaaaaaaacgccataagaagttatctaaatttccccctaagttagcatgatgaatagtaaaagcatgtggattctgaaacaaaaatattattttcttactcaaatttttgcacctcctccaccaaattgaaggaaggaaggaaagaagagagaaactaagggagagaagcacgagaaaagaaaaggaagaaggaaggaaggaaggaagaaaggaaggagaagagagggagagaggaaaaaggaaagaagaaaggaaggaaggcaagaaggaaggaaggaaagaaggaaggaagaaaggaaggaaggaagaatggaaggaaggaggaaaagaaagaagaaaggaaggaaagaaggaaggaaggaggaaaggaaggaacgaaggaaggaaggaagaaaggtgggcaggcaggcagcagaagggagaggaagaattctcttgtcatgtgaaatgctcttgtgaaatttttcaggcattttctgtttttttaaaaaatattttttttctcatcatacaaccttgaaagttgactggcttactgtcagatgcattaactaaatgcaatttctgtttttaataatgatagctcaaacttcatgtgagatcataccagccatacaatgtaattcagtttatggttttcttatatacttcaaatacctgcaatatgtagttaatagtactttttttagataagtagtaggacatcacaacagtgatgttatggtgggctggtatatgtcagtaaagtagattccactaaaaaatggaaaatacaagatattttggtgtaatttgtctaaaaatattcatgacaaagaagtctcttttactttaatgtccaaagtgataagatgctgatgtgtctgaatgaaggaaaagggtgtgaagcaaagactgcactttctaagctgaagaatgtttctgcactgcacggagctcaaatacaactttatggtagggaatgtgcacttaagattagactagtagctcctaaagcaaatatgatgtccatgatttctttcaacatcacacacacacacacacacacacacacgaatacacgcacaagtagaaactgcaggtgcttcctttttattgcactatgtaaagagaaaatgtaaaatggacaagctttcgacaatcatgttctcttcatcaagctgttattgttattttagtgagtccactaaaaagaattatctagagcttcttgtttttacttctttgtgtagttgatgaatatgattaccatttttacctcctgtatttaaacccctctgccataatcccatattctgcctaaaagccatgtctgtgggagcttgttccctgcaatcgtttttagggatataactgcgtttaagcaggtgcagtaaatgcagttttggccatttttactgttgtatgcaagtgaaaaatgcctaatataattaagctgagattaatagagattattagtaaaaataagcttgttttatgaatgaagacctcacactaattcaacatggcctttctttgacaaatgcactgtattcacttatgtagcacaacattgtatgcctgaaaagtgaataaacatttacaaggctaccttccagaattttccattaatcgtcttctaattcttttcctgtggccagcaagaggaatccgattttatttttaagtggaacaaagggattggcctagcaccacaagggacactgattgtcagaagcacaagttatctttagttaattttgttactgaattgttcttggttctttttctcacttttagaattttaagcatcctattcaaaatggccaccatacaggggaggtgggagagaaggaaaataataaagaacagtggcaactgagttgattctgtataaataagcacatttgctgcatctctgttctgcagtttttatgtcccactgatgagagaactggtttgagatgtaaattgctttcctttgattgaaccagggaggagatgtcatgtaactcatctcatcagcatagagcattgtgtgcctttggtgaattataggataacggcgctagtaagaattccttaacctctctccgcagccctgttccagtgcttaataaccaccaaggggaagtacttccctacagttcacctgactaccttctgtggttttagcttatttattcatatcctgtccttaaatattttgtaaaggatcacgggaaagtgccagtgttttaccgtgccagatacaccctgcacattaaaatataaaattgcgaggagttttaatgtttgtttgttttaggtagagagcacttagaaggtggctttggaaagatgagaaaggtgatgaagacgtgatctcaaagcaatatttaccatttatctcacttgtcaagatttaggataaacctgtagaagcagctatgcatgaaaatggaggatggggtaggagtagaggtagaagtgggggtaagaactccctgtgatatccatgagattatgtgctgtatgagaaaagaatcaggaagtggaatgtgaaacaaaagaactggaaataggcctgcaatcaatctagcttggtatctcaacaaaccagtgacttttttttaatatgtaagaaattcagggcagatattacagccctatcatgacagcacggccttttcttcctcctcttctattaaatctacattttgaaggtggatggtgctgactcataaattaaattggagtaatacatacagtgtatatatatttctgtcactttgtctcaaattaaacacgaaccttctcccctgacaagatgatagaaaagttaattgctcgccctggctttaaattggaatttgaatttgcaaaatgctaaaggtttatgagatctaaatcatgaggagcttaaattacattcctgtgataaaatattaataaatcaattaaaacataagccgagtataatattactttttttttgtaagaaccttgaacacaataattcattagggtgtagtgcagtaacaattattgtatctttttttaattttctttttattagttttttttgataaatacatcatcagataacattccacatggtggattatcattaccccaatgcagcttccagaaattctgttgtacccctaaacaagagctcacaggctgaattgtctgctcttatttatccttgttagcatcagctgcttcttttactgaaggggtatttgcctcttgggaacatctgttcaatgccaactctgccattttgtggtttctgaatctctcttccaaaaatgggcataatcataataatactacctcagaactggcatgaagatcaaattagataatgtatgtggaaatcatttgtaggtggtaaaggaccatcaaatgttaattattattatcatagattggggaattttttatctctagaagggctcttagacgtcacttagtaatcaaccccctcattttaaatctgaaggatcagagaggtccagagaggttaagccacttgtctaataccacacagccagaaagtgaaactgctgaaactgaaattaagacttgtaaatcccacctcagggtgtttttcactctctataccctaacgcctccctaaaataatgctaggaaggtcacgttaagtttgggttatttactctcgccacataactttcgctttgaagctgctatttttctgttgttgttgttgttttgactgactaaacattagttattttagggataattttctaaggggcctggtggcacaaacacatatccccacagctgtcaggaaaggttcatttggctaaggaggcactgccttctcctgctgctccccaaatgaagactcagcagtgtatcttcctctcctacagggttctggaggaagcctcagatgaggagaggtagtagctttcctttttaaatacttctgtcatgtaatgacggatgaggattcacccaccacgaattttatctcctttacctccttcttgctctctggccctagtttttggtttaccttcccctttctcccaagttccaggaatcactcggacattttatttattttgaacataaagagaaccatctccataataccttttccagaaaataataattggaaatgaatagatgtttcttcctttcatgctaggaaaacactagctcaacagactatcagcagatcagagaataagagactgtgtgctaatcctgtttttcctggtaacatgggatatatctgacaagttttcatcattctgtctttgttttcccttcccaacaatagaaataacaaaatcaatctatactagtagtttgaagacctccattaaataattacgaaaggttcacaaatgataaagagttatacaaatgctatataatagtaatctgtgatcttctaggaataagctaaggcagagtggataagttctatgagatctataacatttacatacttataacacacacataattattgattgatagtgatgtggtttttacagaatattcgatgcattatggccaaagaagatatggtctctgtcgtaaagatttaagattaggataaattattttacaagagaaaacagaagaagtttagacaaaagaaagctgattgaagcagagaaactattggaactataagattagtcaaggaaattaacaaaaagtagattttaaggaagctagagtctttggtgacatttagaaaaaaagtgaaatgattcattgaataaaataattactgatcagagtgcagcaatgtatccattgtcaaatgtcataaagcttcaattaaaaacacagaaataagcaaaatatacttttaagaaggcaaatgagatttgatgaaatccaagaacttcacatattagatagccctgcagggtatcagtgattaaattcattttatggataaggaaacagattcagggacgttaagtgatgagcacaaaaacacagtcaggattcaaaccaggtctgtctgactccaaagctgctttctcttttcattaccctatgcaatcttttgcagccaatttaaagccacagaaaacataccaaagaaacaaagacaaaaactatacaaatgtactggagaagaggaggcgggaaaacagaaagtgttttttctagaggcagactcactgatggcaatgagaactgaaatagaagtgagtaccttggctaaacaactaggaaaaaacacacaaaagaatcatgaaagtatttatataacttccctgttagcctctattatctttgatagtagtgtaatattttatttggattatcttttattattaaggctcttatcattttctagttgttagtatacaaagtattttgacacatattatgtcattttccactcacagaaaacttatattgcaagaaaggaagtattgctattcctgttttacagatgggagaactgaggcttgggtgggctaaatgatgtgtcaaaactttattaataataagtaacagaaagaacttaagaatctggaactactcactccagtacatttctaccatatcaagtcacttatttgtttcagaaaataggaactcattgtaaagattttcatcttaaagtttaaaagaaaactgcttaaacaggtaactagaaaatttacttacaacaaatgcctcattttcctattactcttctattatagaaaacaatgaagcattgcagaagctaattttaaagattaaagcaactcacacataactttgctactcacatgaggtcattttacagatactaattggggtcctctaacttcttttccacatataccatgttatttgtcattctacaatcaaagttttaatttataacttcatctggtagtctaaagtttagtttagatttttaaaatctcctatttaaatgcaaatatgcttatgaggggaaatataaatggtcaatgaatgtgaatgctgtagttgacaccttacaacaggacaccttacaagggattagtccaggggtttaaggacaaggacgggcaagcacttgattgagagaaggattggagaggagctaataagtgaagttttgtttttgccatttaggaggccacagatgaaaaactaaatgcaacactgtcgcatatgttgctgtgcaacaaacaattaaatagaaaatgagatgcatataaaaaagccttttcttacagaaggcaggtacactctcaaatcagaaaccatgggatatttcgaaatttagaacagggacaatgtcgagagtattttaaatataggcagcaggtagaacatccaaaagttgatggacacatgctccagttacttacatgcaacaggaaagtgtgaggctataggtggtctgcagaagggttgctaaggcttgttctacaacagatgataacagaggaggtggcagtgaatgaggaatgacaccagcctgccacatgtgccaaaagcaggatgcatgggtggcaaggtggagaagataaaccacaccagcctttgccactgttgatcaccttcaggagaagagaaataaggaaatattagatcatgacttggaaaatgtatcaggcaggactttgtgcaagccctttggaactcccgctaatctaaatggggaagacaagacactgagaacactaagcagatccatatctcttgaacaatgtgcacggtcgagttggtgagaaaggtaaaacataacaggaaatatggtaccaaaaagaaactccctgaagtcctcagtttactgtgccagcctctttcctgcagcaaacagctgatagaattaactcagtgaaaaatgaaaactaatcagaaaggaacctgcattggacccagatttagctatcagctaagcaaagctaatagctttaaacaaaaacaaaagcaatacaaagaaaccagatcaaaacatataccacaagaagaattatacaagaaaataatatctattttccatactagcaaataaatagaagacattgtggcctccttaaaataaaaggtcaaggccaggtacggtgtggctcacacctgtaatctcagcagtttgggaggctgcggcgggtggatcagctgaggtcgggagtttgagaccagcctggccagcatggtgaaaccccctctctactaaaaatacaaaaattagccgggcatggtggtgggcgcctgtaatcccagccactcggtagactgaggcaggagaatcacttgaagctgggaggtggaggttgcagtgagccgagattgtaccactgcactccagctagggcaacagagcaagactctgtctcaaaaaataaaataaataaaataaaataaaataaaatgaaagttcaaaaactagataaacaggattgaataagtgataagacaaataaggagaaataaaattgtctgtgagagaacaagaaggaagtagaagaagaaaataaaactctaatgggaccaaaaaccatataggaagcaaaaagctgggagaggaaggagaagaacttctactgatattaccacaattgtgaataagaaaaatcaagcaaataaaaatttaaaaaacagtttttacatgatatgaaaaagtgatcattttgattggcaactcgtatctcagacaaaaatagtatctccaaaaaataagagctcctgcgaattgataagaaaaaagaccaataactttttaaaattaattttttgcttaagaggcattacagaatttacagaaaataagtatgtatagatatagataaaacagtgttcggaggaatatccatatctttaaacatgactattacaggaaagaaaataattataaacgtattaccattcatctcatgaagttggttaaaagaacaaaaaacaaatctgcaaagtagaaacaaggaattgattaaaaaaataaagtcagaagttaaggaattagaaaataaaaaagagacacactaataaatcaaagagttggttttttcaaagagaataacagaacaataaacaaaccaatatcacatgatttaattactaaatgagaaatcccacaaatgcacaaaattggaaatacaatggggaaataaccagagaaatggaggaaattaaaatgattataatgaatactttatatatatatgtgaaaaatttgaacataagggataaattttaagtaaatataaattacaggaaaagactcaagagaaatacaaaagaaattcagaaagtttctgggctaccactaaaataaataaattgtgtgtatgtgtgtatacctgtgtgtgtatctactaaatgaataaatcagtcaactttgtaaagagacaattttatttcttcttacctcttaaatgtgttaccaacttttttccattagcattgaatagtcaagaaaacatcacactagatttctgttttttcttgcatgagtagatatcttgtctcattgatttgctttactgagtcatgtggagccaagtagagaaacaggctgactcggcatccctcacacagatttcttctggctttaagggagccacctaagagagtttgggtagacaggataatgaaaacagccctggtttctgggcttggttctttttatattgcttccttaaaatatgcagcatttacagccattgctttgtggctttattttttttaatccctcaactgagacatttagactagatgagtggctcatttcttttcccagaaaagtgtgcctatccacaaaattttgaggctacacagtcttcccaaacatcctctctccacctggagctttaggccatgggttagatcattttaaattacttcagctctaacattctacagcctcagggaatatacagttttaaattgaacacaagcttcagaaagagtgatcgttattatgagaagcagaacacagtgattacactttgactctggagccagaccaccttagttcaaattttagcccctttatttacataatgcagggccttgggtaagttacttaaccactctgtgctttagtttcctcgtctgtaaaatggagaaaataatagtaatcactgtaaatagtagtcactaaaaaataaaggttgttatgaaggttaaatgggtgtatacatattaagctcttacagcatacctcttaatgaatgtgagggattactatgtttcttactagttaagatgaagtatctcagcacagagatgaacacaccacctatctcgctatgaacacaccatctactccctatgaaaaatcctgtttatattttggtcgtggctgaaatatcaactttttccatgtgaacctgtaatcgggtccattattctgccataaagtagtagttatgagtgttgctatatacaggatgttttgggaaagatttcctgattttggccgggcgcagtggctcacacctgtaatcccagcactttgggaggctgaggcaggcggatcactcgaggtcaggaattcaacaccagcctggccaacatggtgaaacctcgtctctactaaaaatacaaaaattagccaggcgtggtggcgggcacctgtagtcccagctactcaggaggctgaggcaggaaaacagcttgaatccaggaggtggaggttgcagtgagccgagattgcgccattgcactccaacctgggcagcagagcaagactccatctcaaaaaaaaaaaaaaaaaaagatttcctgattctattgccttaatttggggctgttattaagaatctcttatcagatcctcagtagaggagatgattaaattaaaccaggggttaacttgatccaagctaggcaattattttttcatattttccttgtttttgtaaagtctttttgctatgcatgtgtatataatctgtgacctagggacaactactttctttgaaaaccataataacatgataagtataaaattatgtatttacttaacaatacaaagcatatatcattttccttgagtggcaaagttgaggaattaattaaaaacaaatagtagtttgataatttagtgtataaatatcaactgtcaattagaaaacaaaacacaaaacaatcactgcatacagtttcaggtaagacttatagtttgctatgcctttattctcattggtagaaagcattttaatgatttactcatggtcacagaggaagtgtatccaagttacaattaaatttcaaaatattgaactagcttatatagagccaattttatcttgaatttaaaaacagttgtatagaatagagtcacataaagtatcaaagattgccttggttgtatatggaagataaaagccaggttcttacacttaaaagaaatgttgatttatgttgaatttcaaaagaaatgattagattatccctgttgcctagttagcacaattgtctcagtgctctgaccttggtttgttaaaaaaaagaaaaaagaaaagaaaacagtgctttcctagggaaccagggactctctcaatacttaccatgtttatatttttacatgaaatttaatattttgaaaatgtatgaacccaacatgactactctgtctacaggttttatgttggactgttgccatctgtggttgtgaagccaagtgttctgctggggcagaataatcaaatcaaagttaatggggtgaccatctaagcagggctctttgtcattaaggtccactcttgtgatagtagcacattatcctgctgattggatttgtaggaaggcatccacctgtggcccacattggcagagaggagacttactgcagaggcagccctggcgaaggagaagcaggaggtagccgccctgggcagcagattcttttgctgaaaagccaaagcgtgcaggacagcataagcaatattagtagatgggtgattgacatagtatttggttgatttaggtcccaaagtaaagtaaccaaaggcagaggattagaaactgtatcattagagaggaatgacttgtcttgagcagggaaaaaacaactacatgtagagacactgagccagctgatcagacaaaatttaagcacgtggggccctttacctccatctcaggagtgatttttctctgtttggacgagagctattgtaagaatttccatgtctgttgggggcacagaggttctcacagactatggtaaacatgatttggctcacacgctctcataatcaggctgacttgcactgaaacagagagtgctctatagcggtgccaggcctctagcagtaccaactgttaaataataaacaggccctgtttgttggcagcctcttcccctcctgccaacatggagtgcccattttctgggtttacctgcccgcatgtgttcagacactcagaacagtgtgtgtgttgtgtgagttggtggtggcatggaggcatcagtctacatctaatctgcttagtttattattctctcaggacctcgggtgagctagcaaacacgcggggctctggcagcacgaacaatggctatgctgtcattctagataatattacaggctttgcagagtgcatcagctaattgtttttcttatgttcatttttgtttcttcaaattctctctcttcctttgagctggtttgtaggaagtggggattaggaggcataagagtggttctgtcaattagatgcattacttcctgaaagctagaaagtatttgggttgttggattttaatgcagtatgtatatagttaattcacattgatagtgagccacgcattcagtcaatcaacaagtgcttactgaaggcccacagggtgcaaagaaccctggactaagtgcttaaacttgactccatgtgccttactgtgttattgcacaagtgctggagtaaggttggagttttcccagattccaggtacccaatgactacagtagattatgaaagagcagttcaggtgagagccaagctagaaacacacacatgcaaacctcagaaaaaaaaggattcccaaaagtcctctattttgtcatggagacttttttctccatttcactggtcccacgaaaaggcccttgataatctgagttttatattgcatttttggccaaaggaatttcatatgtttcacagatgaaataattaaaaatagactctcttaattcctataaaccctcttcatcccccaccctcccagtaaagcccaggataaataggccgtgttaccatttccaggaggcttttggttgatcagtgtaaatgaggcatattcaaagttggtgatcagggatatgtagtgttaggtggggagggtaactatgaagcatgtagtgtttctttttttttttttctcatgaaccaattctaaaggtaaggtcccaaatctgaagtaatgacggtatccctggagtgactttcttccaaggtgaccattgtgaaaaatagcccttgtgagaagcctatagatttgtttaaaaaattagtccgattcctttataatcatggctcacacatgatgaagctattaattggttgtggtactaaaaccatttgcttgagtgaaatgaaacttctcctctctcagatcactaaatatactttaactgtggagtaatcattccgtttcttggactaagatatttttagatcaagagtaaatatttgaagtaagaactctggtgacagcgctgggagtgtttcagaaagttaggatggtaatctcatattcagtctaattttccctgaattcatgcctcaacagtgtgtaatgaatacacttatggtggagtcattttccttttatgagaaatgcaaggccccatcttcttattatcttttaagaaagatttctctggtttatagtgtcagaagtggttttaaaaatccaggcagtattgaattcacacagaatggttcagaaaagcctggtagtaaaattcatagagaaacaattgtttaaaatgcaactagcattgtatagcaaaataatgaatttgtattctctactagtctcctgttggatccatatcctcttgtcattgagttctcaaaggtttcatccaaaagaactaggctcagattgattacccttcatccaagcaattttgcctgtttgcactaggcctcctcctaactagcaggtctcagtgccctcaccaggacactccccagattggctctaggagagctctcatttctccctgtgtcaggctgcttgcagctagcatcaaacacaagctcacctatgctctcgagttttcagcatttagtctgttgtggatggaaaagtagatatcaaactctttagaattgtatctaaaaagaataaagagcctttgagtgagggcctgaggagcaagctctctgaggaggaaagctcatcagtatggtgaattctctcagctgcttgaccgctttgtcttcagtgttccagtgaattgcattttgatttcatacacatgcatacaaacacacagacacacacattatataggtatatgtaggtgtgtatacaaccctattatactctctataatgtgtatgtctctaacatacatatctcttgtgtgtttatctaaccacctatctatatctctggtaattgtcattgttcccagtgatttagacattaaaatctatgaaaataagcagcatcttttgagtacctatttaagcacccacatacctggaagtcctcaaggtgcttataaatttccactagactcttaattcatatggtcaagacaagtgcagttgagcaccaatgtagcatattaccttattactcattaaaaaatcactgcccaatttagtgtttcgcataatataagaatgtatttgttgtatataatagaaaatatgtatataattacaattgacattggttgttggtaaaatgggattgctggaatagcgcttaaacaaaacaaatagtactgacctattagaaaaattaattatgaaagaaaagtaatggattatagttgcagataatggttttggggacactgctggttgaaattcatcctgaggcttatttacaattggcacaattagagcttttgagaattcagcagccttgatttatttgcaggggttcatatagcacttgagtcacgggcgaggtgaggcacagaggtgggtaggggacttactgctttacatttaagttctatggaatttcacatttctattttggggaagaaaggattgtctctagagagagagcatcaggttctttaacaagatttaataaatttgggtccttgtatcgatcaaacttcatactagatcagataacaaaaaattgaatatggctttgcactagaggctattttattttctgtgctgccaatgaactaagtttctataattttgctttcactatttgaaattttaatttatccatcagatgtttattgatacctaatgtgtattcagtactttactagccacttgggatccatcagtgaaaagataagtaactcatgtagtatgttaggagatgattagtgcacaattcatttatgaatgacccataaaagaataagttgataaattagatttcatgaaaattaaaaaattctgcactttgaaaacattattaagaaaatgaaaaggtaagccacagactgtaagaaaatatttgcaaagaatatatctgataaagaacttatatccagaaaatacaaagaacttcgaaaactcaataatatacaacatattatttaaatgggcaaagatttgatcaggcacttcaccaaaaaaaaaaaaaaaagaaaaagaaaaagatggtatatgatgagcacatgaaatgatgctcaatatcaatcattgttagaagaaggcaaattaaaatcatgagacactattacacatcctttagaatgactgacatttaaaagactgagcatagcaagatttttgaggatatggagaaactggaagcctcataagttgctggcagtaaagtaaaatggtacagccactttagagacagtctgacagtttttaaaaagttaaatgtatgtttaccatgttatccagccatttcatgcctacatgtttacacaagagaaatgaaagttttttttttttttttttttttttttttttttgagacagggacttgctctgtcaaccagcctggagtgcagtggcatgatcatagctcactgtaacctcaaactcctgggctcaagtgatcctcctgcctcagccttcccagtagctgggactgtaggtatgcaccaccactctcagctaatatatatatatatatatatatatatatatatatatatatatttactccagtaattttcttatgcaaccatagatctattttccatcactacacagtagcttacatttcctagaattttataaaaatttgaattctattataaaaatagaatcttctgtacttgttttgtccttctttcactcagtatattgactttgagatccatttatgtcatagcatgtatcaataattcaccatttttttcgctgcatagtattccactgtatagacatactataatttgtttatccattcacttaaggatgggcatttagactgtttacaatttttagcaatacaaataaagtagcaatgagcatctgtgcacaagtctttataaaaatatggccatgtgcggtggctcacgcctgtaatcccagcactttgggaggccaaggggggtggatcacctgaggttaggagttcaagaccagcctggctaacacggtgaaaccttgtctctactcaaaatacaaaaaaaaaaaaaaattagccgggtgtgatggcaggcacctgtagtcccagatactcaggaggctgaggcaggagaatcacttgaacctgggaggcagaggttgcagtgagccaagattgtgccactacactccagcctgggcgacagagtgagactccgtctcaaaaaaaaatatatatatatatgcttggctggccatgggggcttatgcctgtaatcccagagctttaggaggctgaggtgggaggatcacttgaggccaggaatttgaggccaacctgggcaacatagtgaaacaccatctgtaaaatatatgtatacgtgtatatatattcaaggtagaataaatagatgctttggagccaactgaccagaatgaagacctagctccccatttactggcttgaaatcttgggcagatttgcgtaatttttcagatgatttttctctactgtataatggagataatataacttagagtcctgaaaaataaataagacaaggtacttatagttctttccttgccttcaaatctggactcagggggagatagattaagggcctgcctacatggtatgagttgagataggtgagagtaatgttttctcttatacttggatagtacttgtattagtctattttgacactgctataaagaactacctgagactgggcaatttataaagaaaagaggcttaattgactcacagttctgcacagctggggaggcctcaggaaacttataatcatggcagaaggtgaaggggaagcaaggcacgtcttacatggcggcagaaggacagaaaaagagagagaagagagagactgccaaataactttaaaagcatcaaatcttatgagacctcacttactatcacagaagagcatggggaaaatcgccccccttgctccaatcaccttccaccaggtccctgggattacaattcaaggtaagatttggttggggacacagagccaaaccatatcagtactagtgcaggaattccacagtttgaggagattcattctttttggatcaaatgttgcaaattctgggatttcttttttgaaaaatacaagaggatggcacactaacctatacgtttccattacaattttctaaattcgttggttgaatcagttttcctccttgcaacagtggccaagacagtcaacttcaaccattttttagatcttagttgaaatattacttattctaagaagtgttccttaacctcttcagtgtaggttaggtatgcccttggtgtctcctggttctacactcctctttcttaacttttagtgcattggttcttatgtctgccattttactactgtgtaagctccgtgaaggtagagacttggtgtggcttgttaatttccatatccacaaattatcttaataactaattattgagtaaatgaacaaaagtttttaaagaaggggtaaggtagagatgagggaggttggaagctctaagaaacagttctgccactctcgagttttgcctcaggttagcccttctgtcctttcatcagttccagatggagaaaatttttaatataatataatgcaaaaaaacttcacccctctaaaatgacacctaggcaacagtccaggctaacaacaaagaagaagctataaggagctaatccttgggagtagagtaatggcatggaaagaaaactaatctggaaataaagagatccatgacctcaagcctaacctcttgaaacctagattatttttatcttcaagaagtcctgttgcccaccctgcttatcttataattttgtttgagagtcaaaagagagaagagaagtgtgagccctgaattgctgtagaaagtgagaacttactatgaagggggttgtataaagtctcattagaggcagccttgctagtcttacttaacctttgcagtactaaagttgatgttctctgaactctctcttaggctctctcctcacattgggcagtcctcccaggcaatctcattttctcccataggtttcattagcatctgcatctgaatgaccaccacatatttctccagctcaggcttctctctgagcactgccttctagacctcttctcttggatgactcacagacacctcatactcaacatgttctaaactcacctctttgccccaaacatgctctcacctccagtattgctacataattgccgacattagaaacttgacattaccttttccatatcctgtactgttccacatgcagtcaatcacctggtacttttgatcttcctcctaagaatgtccttaatctgttcaatcttcttcatatcagaactactactctcatccagggtaccatcttatctcacctaagttattgcaacagtattctgacttccttaatattaatcttccagcctggctcctgtctcattttctagactgattcatgcccctttccccctagcattctatgctctagtcatactaaacgtgttttcatgccttcggtgcaccatgctcactctcatttctggtctttgcatatgttctactctttgttttgaatactcttcattactcttttcttcccccatgtgctcacctccactgacataaaaccaatcttgcaagtctcaatttaaagcttattttctatggaatgccttccccgattccctaattataattgccttacattgcattcctgtaatgtgcactttattatcattgattgttttgcctaaattatccttaaggtagggagtagtatgtcttattcaaggctgcgtctttagtgcctaacacaatgcctgacatttactaggcatttaataatgcttgttgagtgaatgaataaaaaataaattacaatagctacaaatgatattatagctaatttattacatattttactttttaaaatttttaatttttttcaaaagtttgttgctagaaaagtaagaaagatcggttcttgaaaatttattttactttcatttatgcattttgaatagctctcactagagcctcaatttagtattaaggagttattccagaataagagatacctaaactgcatgattcctatattcttcctctataaaattattgtgagaactacttttttttgtctgttttaatgtcagggataggaaggtatcaatggtgggtatgaatttgactactctgtcctagaaattattatgcccttgtcaattttctgagactaacatttaggagaattctgtgatcacaattttgactctatatctgacttaagctcaagctagacgcaaacattttctactaatactctggctttttcattatttctctattagaaactatggaagatattacagatgagacagtaaaagaacagactgaatatggttccactgacaaccaggaaagttatttgaaatgacatgaatagtcaggttgtaataaaggtttgttaaaacatttggtattgtacaactagtttccacattaatcaatcccatatgttctaattaataccttgctaaaatgtatgttgattttcaaggaaaacaacagtttttaacgtctgtagacatgttgcacatgcgtgaatttatcattaacaggttaattgagtactgaattgagcagaaataacatatcacacagcgaccctgcaagggaaacttaccatcattttactaaagaagaacctgaagatagagatataaagtaacttgttcaaagacacacaattagtatagagaaaccccaggtctaaacctaaatctgtctcactcaaaatgtttttttttactacattgcattacctctctggaaaacataattacttgttctgggtgtattaatttactagggttgccattagaaattagcacaaacttgatggcctaaaacagcttaaatttagtctttcccagaattggaagccagaagtctgaaatcaaggtgttggcagggctacactttctcagaagactctaagtgagggggaatcattccttgcttttccagcttctggtggctccagaggttccttggcttgtggctatgtaactccagtttgtgcctctgtcttcacatggccttctgctctctctgtcttctcttttttctcttataagaaaatgttattggatttacggcttccctgggcaatccaggattacctcatctagaaatccttaacctcattacatctgcacagatcctttttccaaataaggtcacattctcaggtttcaggggttagaatgtgggcgtttcttttggaaggtcaccattagatccaccacactggatattgcagaaattgttttgagagattcctctattatagatatatctgagatttcctttctttctctctccctttctttctctttctttctctctctctttctttctttctttctttctttctttctttctttctttctttctttctttctttctttcagacaggctctcactctgtcacccaggctgcagggtggagtgcagtggtgtgatctcagcttgctgcagccttgacctcctgcacgcaagtgatcctcccacttcagcctcccaagtagctgggaccataggcgcacaccaacacaccaagcacagttttgtattttttgtcgaaatggggttttggcacattgccaaagctggtcttgaactcttgagctcaaacaatctgcccactttggcctcccaaagtgctgggattataggcatgagacagcgaggcaagcctatctttgaactatttaatggtcaaagttttgctaatgtatatacagggaggaaaatggctggttcatgctgattctccatcagggctatcagtaaaagagtgagtgacactgtaattaatagaacaggaatgataacatcttataggggtgctgttcctgcttttggaatggcttctttaaatgtgggatgcatctaccccatttggttgtaaatggaaacatcagtaaataagtttaaagacatccttgtttgcctctctgatggcaaactccaatccatacatccactacagtctattttggtatatcttctatgaatttctccaacttcttacttaagttttgctaccttccaaggcaggcattaaaaaaaaatatggaatagtgctttattacctgaccctatttgtacttttctgaatatgaagtttgacctctagtattactattctaggatttcatgaataattctatgactaccctctgcctaaatttcataaccccattacatattagatcagggttcagtgccctgtcttcttttaacttttcagagactttccccccccagtcacaccatggatcttcaattccagggctctacacatctctctccctttaggccctcatgattgtggagattgcaaatgcatcattatgtccattcgaagatgtcaaaactttacataaatatatggaaagctttctagcctattttcagtacacttgatgagttccaaaattttattagtctttttggttacagtctcatatttaagctaatataattaggaaacaattgaaagtggttcttaaattcttttttgagttaaacctgatgtatcaaataccatcattataaaaacatgatttgtgttattttccctaaaaatgcttcccttgcatttatacttattaagaatagataatagctaacatctatccactgcctttgattcatgaggccctcacgaattgcctcattaggtctccgacagtatggtacaactactctttatattttacagatgaagaaactgaggctgtactgctactttctgcttacacatcctaatgaaaccttcctactggggtgatctcttttggtttgaatgtcactacttgagtgagattttattcactactttttcttgatcattggcaaaatgtccaatggaactaattcatgagagagtcattttttaaattaatttgtttactgaaagtccgaaatttttctgaacactaagaatgtactggtaagcaattataataggcagcttctaagatggccccacctgatctccacatcctctattttcacctgcttgtctaatttcctctcctttagtattggctggacttagtgactcatttttaataaaggacagaagtgataggatgtcacttccaaggttaagtttttaaaaagcttgtggtttttctcttgagtccctctatcactctctcccggattgctctccctgagaaaaagcaaagtccaagtcatgaagtagccctgtgtgaagacccctgtgtgaagaccttcacatgtgaagacccccacatggcaagtctcctcctcttcagtcgagaattcagatgaaaccacagctctagctgacagtttgatcacaacctcatgagaaactttgacccataggcacctacctatactgagcccagattcctgacccacagaaactgtggaatggtgtttgcttttttaagttactaagtttgggggtaagttgttatgctgtaatagataactaacacatccaagaacctcatcctcatggaatttatactgtaatagagattatgaacatacaggtacatgtgcatactcacatacatacaggatgtaaataaggaagatactagtaattagttctaagagaaaagtaaagcagggtagaatgaattggggatgctttggctatcttggccacacaaggaaagacctttctgtggagataatatttgagctacgagtgaagaaatcagtcatgcagagatgtaggaacagagcagtctgggcagaggcaatatagctagaccagggctaataggaataagattggcttgttttagagacagaataggcaaagaagcacggtgaacaaaggaaaaatgttagaagatgagaacagaaagatggtcatgaacagataatggagagacttactggtcatggttttgaattttaatttcttcttattgcactatatataacttgtagaattttaccaaaggaatgatatcatctttcctgcatttcaagaattctagcttctgtttagataatggattataaggtgcaacagtggaagcagagaaatcagttaggagaccagataagagataattgtgatttttgttcgtgatagcagagatagtgaggaatggtcgggtttgggatgtacttttgtgtttgggttaatgcggcttattgatggattagatgtggtgggtgaggcaaaaagagttgctgatgtttggcctgatcaactgtcagggcagatggtggcacctttcactgagacgagagaagtacagttagattagaggaggaagtggcaacatggataatagggaaaccagagttctgtttggggcataaattagtttacagtatgtagaactaacaagaaaagtgctcattattgctattctatgttttaagccagttcttgctttggaaaaccatttccaacatcttgtagcatcttgtttccatatacttccattttttaaaatctttgtggtggaattttttcagaggctatttgagaatttgtaagtaatatatactgactcccacttttcaatatagcaagttaatcagacaaaatatctcttatagaatgctagaaaatccactgaggaaaaagtcagtgtagtattttgattataatttattaaaacacacatatcaaatacaagataacctttggcctttccttgagtcagactttgttatagcttctaatcatgtcttgccctattcattagcagctcattcatttcccttatgccacctcactcaccttaaaatttaagttttagcagctttgctgtaagtcttataagtgcagtggggcatttgaatggatcgttgtttcccttcttctagaaactctgcagtgagaataagtagtaagaataattgtggctacataggtgcatttgttccctaagacaaagtgatcagagaactccaggggaaatgctattaataccaatattgttttgtaatgaaagggttaacagctgtcaaactcaatgtcttaaagatttacaaaaaaagaaaaaaaatgtcatctaggctgggcaaacatcagtgcctggcatgaggaattagcaaaaaggtctttaggtatctatggactaccaaatatgcatgattctctagtccactagaaaatttagaactgattctcaaatactaaaatatgaaactgaggggcttatacttgatctgctaattctgaaccaatgtattgcaactactgtgcattttgagatactattatgaactggcgtattataaaattaaattgtattgtatagttcattgtattgttccatcagattttgatatcctcactttaaataattcatgggaagaaatgatcacttcataatgccacaaactcacagcaggcaaaactaattttacacaatatgaaaacagattttatttatttaaaaggaatattaaaaaaacaacttttttgacaccagctgctgggaaataaatagaatactttatgacaaaaaaaaatccaaatctataaaagctcttcctgggagatcaagttgagaattgtaaagatacatttaaattccctagtcaatgctataagccttattttgagggaaaaagaactctcccatctgcttactctgtggggataaagcgatactgggagaaaattgactttacaaaagccctcctgaaacctttagcaagctttaggtgtcacttcagagaccccctattagtataaataacatcagtgggtaaacagtagctggtgtccttaaatacaaagtagaaattattgtttagctttgtcctaaccagaccttgattagaagtgggaaagagtattttggggtgaccacaacaactttcctttcactgtggctttaagaatggaatgagaaaatacggtgaaaatataatgaaactgttttctttgggagagtttattagatgaatattttaatacaaatataacatattttaataccaaagataaaaaaaatccaggctttcttttcaatgtgataacgactccatatctaactcaatcagacacttgcttcagacaaagaacgggactcttgccatgggcgggtctgggtttaatctcaggagcgtgagggtccaggcatccagacagtttgcagccctcttccctgaggcttcagggagagagagaacaagggtggaaaggtgcaaggattggagcaaaggagctaagaggtggatggaaaagagaaaaaagaacagcctaaaataaaatattttagcaccaaagcaatgaaaatacattctgtggataatgtaaatgctatttattgaatttttacttttcaaaaatgtttaacttaaaaattcttgctgacagtgggaatgtaaatctaagactaagagacgaacttaccagaagaagtttattattgtctgataacagctgaattccggtcttctttgggtactgtaaaatggggcagatttgtatatctgtgatgtcataggcactgttggaagggcttgtctctggttttgtcataagtttcctacttgagcagttataagccatgaattagaaattcattttagattttgaagagttacaaatttggaaggatctaagttaggctctattattctttaactttttaagatataaaatattaatacagtgtagcagagatttaaaatttttaataggtattaccaaactgcttcatagcattggtcttttcagtagctatttgtattttctaaggcaatagcaatatacacagaaaatgggttttctttgtccttactatatcagtgcaatctaatacgtacattagttagtgagattgctttgggaaaaatagaaagaacattgagattctaaaacaggatgtctatgttcaaagtctggctgaatttcacttactacttgttgaacttgtacaacttattttaacctttccttgccttatttttaaaattttgcaaaatggtgttaatattacctatctataagaccctcggccaggtgcagtggcttatgcctgtaatcacagtacttgggagaccaaggagaggattgcttgagctcagaagtttaagaccagtctgacaacatagtgagaacctgtatctcaaaaaaaaaaaaaaaaaaaaattagctaggtgtagtggtatgcatctgtggtcccagctactcagaaggctggggcaggaggattacttgagtccaggaggtagagactgtagtgtaccaagatcacaccattgcactccagcctaggtgatagagtgaaaccatatctaaaaaaaaataaacaataaaaaaaattctcttgttactcactgaaataatggaagagtttctgggataagcttagagagccataaaaatgttgatttaatcctattaataaatagtatataagttatgttcttcaaaggcatttgtattttaaagtatttaaagtgttgcagttgtattgttgcattttaagggatgactgtacagatgctatgtaatatgtgtaaaagttactctctttcttctgagtgttttgctgtaatacaaccagagttataatgcaaacatttaccaaaacaacgctggtatagcaatgttagtattcggcaacctgagttgtactgtaataacttttcaataaatcaaaatatgtgaaccagactattttcttatgtatagaagagatatgttattttagaatcctatttaaaatataagaaatgaatcaaaaacttccaaaattttaatttctttgatttttctaggatttctaccttctagaatataaagctcttattctttttactgaaatcttagctttacttcagcatcaagctgcttcataatgcaagggctaacagttaaaatgagagttaaatatcatttaaagagaattatttaacggccgtgttactgttatgaaattgtacatgttccaaaataagtctagtcaccttcacacctacttagactgattccataagtcaatcaccaaacacaaaattttggcctaaaatattcgttaatatttatgtactaacaggaatgttcacgtctaagcgggagaagccaggttcactcaattcacaaatttagtatctaagatttgaaatatcatagctttttgtgcatttaaaaaaattagacttacatattgactttgagcctagagaattttagaaatagaaaatataacgtttcatagcttttagatttacaaggacatcatttttatttatagaataatgcattgtgcttaattacaaaatatcaaagtttttgtcattagtgaatttagagtggctgtccccttgttcccttgtggaatttactttgttagaatagattgccacattctttgaagacaattgccttgatactgataccagtcaccatgccttcactagatctggggatggacaataaagtatatgaggagtactggcatactaagtcataataaaattagctaaatgttctatatatcaaagaatgaggtgattttggtaggtaaaaggtagtccaacctgcacttctgttgaaaaaaaatgactgttgtatcaacctggtattccatccaaacctgaatttgagtttatccaaagagctgcactgaaattcagcaagatagcatggactgggccaggtgttgcaggcagaggacaggattttactggcttggcagagtaggactttaggttatttcctccaaagtgacattaaattcctctctgtgctatcacaacaccttttgttttttcagacctgtctatagactctcagaggcttattctgtttcgtgaaaacaatgcagataagctgattgaaatgtcaacagatataaacatgcagataaaatgttagtatgtaatggtagttttcaaacataatgagtaatgaaatttaagcagggtccaggtggaataggatcctagaatcctagaataaaaacatatcattttagaggcagaggtacagtcccattcctctgtttaaaaagatgaggtagataaagtccaagatctttcatctggagtgtttgaaagagttgggactagaagcacatctctggtctccagtcaagtgccttttctagttgagcttgacttctttatatctggataataaaatcaatctcatacaatgatataggtcatatttttccaaggcagttaagtattcattcactcctataccatcaataataatgacaaacatttatataaagcttacaacctaggcagtaccctaattgctgcctagcaggctgtaagcgctatatgaatattgctgtatgaatgttgcctgacgtgaagagttagacactgtagagtaattttccttatattgccttttgcttaatattgcccctcttttaaatcttcacaagagccacattaactaggtactgttgtcctcatttcatagttgaaggaggaaactgaagcacagagactttaaatatattcaccaaggaaatcgagccattaattggtaaagcctggatttgaacccaggcagtctgggtttctgagcttgcgcccttatccactatactgtgtattgttccaataatttttagttgcataaacgcttagaaatagcatttataagttctctgtgctccagaagaaccagtttcaagaaagaataaaatatatgtaaatagcggataaacccattatattttaaaaaggttggaggcactggatactaaaaaaaaaaaaaaaaaaaaaaaaaaagaagaaagaaaccataagagaaatatgataggtatggggggaagggattttaattgttctcaatgactgtagagcaaagttagatccaataggtaggaattgcaggagataaatccgggcttaatatggcagtgcagtgaccagaataggcaaccttgttagtgagccccctatctttttgtattcaggctgtgtgactggtccctattgctacagacaggattgctgcactggaatagtacatttggagcgcaattatgctcagttaggtcagaggtaagagacgtcattaaatttcatctgaaattatattgtaaaatatgtaagggcaagagctccagacagatctgactttgaatcctggcacgatcacttatttgctgcaagaatttagtcaagttacttaactctaacttctctgagtcccagtttcctcatccatgattgggataattgtactaatctcctagagttgtggtgaggaggagtaaataagatcattatctaaaatgcctagcactgtgccaggcacataataagtgctcagggtatattaaatttttcaggagtgagagactcattaatttttcaaaaatgaactacagtcctaattattctcttatttgggaaaggaagcttggcttagcaggtaataggactttatgctcaccaagctctcattgcctttggataaggaaccatgaaccctggatagtgaaaagtccttgtaaaggaagctttataaatcaacttatttaaaatgcaatagagcagcttatgatttaaaagcatcctgtggtgaatccttttaaaatgtgaataatcaccccataatttgtctgtttggtaagttcagaatttggcttattgtgtcttcttaaagcaaagagtacacctgcactcttatttcagtattttcatgctgggctgactttcagagaaatacagggtgcctcttggattcaggatggcataggttagggaacggatgaaacatgcaaggtccctaaagtcagtgagaacattaattgtactttgtgatgcatacattttaatgagtatgaaaactcatagagatcagttgacctagactgtatcgaggatcattgcacataggaatgctgtctgacttgaagagttagacaatgaagagtaatttttcttatactgccttctttttctctgaaatttcaaggaaagtcaacatgaaattttgacatgatatacagatcctttatgaaaaaccaagcagcactggaaacctttgcagtagaaagaacactagattaggaactggggactctgagtaagacctgccatatgctaactgcatggcatgggatagcacgccacttttattctttctttgtcttagtgttctaattgtaaaataatgaagttatacttgcatctcccgtgtaacttctacctagaatctttagtgagctgattcataaaaccaggtgtgaaattactttgtttcattctctccaatagaaaaattagaacaggaaatagtagaaacagtacttaagaggttattttctattggcaatacttgttactctgccttagcttgaactctcttttgcctatatgaagatttatgaaacattttatttagctgtgatacagagattaatataaacgtgggaaactcagactaaatgttttcttttttcctatcagctggcaaacattgacctgtgtttgaagaaacttgaatatatttgagagaaaatgacctctcccacaaattaattaaatctgagactaaaataattatatctcttcattgattccctttattttcacagtatccatgggaattttgccagttcttcatagagtgatttaagcttattgacaacccacttggatgaaatacagtttgaatatatgctggtgactctgtcctttgcaagttgaattggggaataacatacatcagataggatacttaaggagccctttttgagaagcaccatacagtttaagagcccaggtgactgctttataagagatctgagaccactttaaagatccccaatttttcacactggttgcaatccatgcaggatgttgaaaggagctagaatccataagtgaccaggcttatctttttatcaaataggcatttaaaacacatctttatgcagattcatatattgtaaagggctactattcaggacccaaatttctaatttgtcaaaagcctcaagctgattttaagagaaacttaaacttaattcaattaaggaataatgaaactgtaagtttagccaaattggaagtgccttcaaagacttagcattccatagtcaacctcagaattttactgtcaaccctaaagatgctaaaactattgagttttcaattatgtgtgataagaacatcaccctgcataatggctagtagccataattctttacatcctgaaagtgaagaagaattttactgagtcactcattgcaattcttaagaaaatcactatgcattgatatatgccattgccaatattttaatgtagaaataaataaccttcttaatcttctaataaacaaatagaaacattaaaaagttaatcacataacaaaacaatttccatgtttcattttctcttaaaaacgtagcaaaaatggaaagtatataaaaagcgattatcattagaaataaacagaataagtcattaaacgtgaattccagaaaggtgaaactgcatttatagaaaaaatttcaaacatatggtgtagagattaaaatttaattatatgtcatcctgttggaacgtgttataaaaatatgtatgtgcaataaagggtcaagaaatatttattcagtacttacttggtgctcaatatttgatgtcatgagacatatgaataatacatatataaataattgaaatttattctatttgacaatcagactttctctacagatcttatggaataataattcttccaataggtatataaattatgaacctattataagattaaaatatgtttgtaaaacatatatttgcaaaaatagatttatcagttaatccccatttaatcttactttgatgtattaggaagtttctgtggttgtttaatagaatgtagacttttggagacctcttaagatctcttacctgtcttaaatttgtgaaactcacaagtgtactatcagtagaaacaaggaaattacacaggaaaataaaaaaccaggcccagggtctgctggagatatcttttaattctatattgaagtattggatatgggatccatgatggagtccaagttatactaggcagaatatattatctaagcaatacttggttcttattgaagaactgagaagtcatgaaagcccaagagcaccctctagtgaaatttctggagtaggcttaaggggcttgctcttgaccttagctctccccctcacatgacctttgatctcccaaaagatagcagttatatttctagaatttggctttatcatcaaatcatttccagatcacaaagaaggtgggctgcttgtcaagtattactactagtagatatgcttaagcgctaagacctactatttcattgttctcatgatttttgtttttgcttgcagtatcagcctaccgtgttaaaatagtttctggaactaatataactaacgaactaatgggaagcattacaagtgtgtagctgaattgtagtacctttgtcccggcctttacctttctcatgcctctgacttttggcttaagtacactatatacagaaactgtattaatacttgcaatattcgaggtcaggggtagcaggtgagatttccagtagaggtcaaaaattacaggaggagtaaaaagtcttagtattcatggacttctgagtttttagagagatgtttacaaagcaagcctgatcttagctataagttagttaaagctgtgagtataatactattcattttgattagcaactattatgtaatacatgaagcaaggcaaattattaattgactttatagataatttgctctaaaattatgattggtaaggaatttagagatctaaatcctcccactttagggaaaaaaacccttacgcacctaaatgttaagtagcttgctcagcatgacacaaatatagcatcagggctacaacatacataccttgttcaatatcctacaagaacctgcttattaaggaggtttcaatattctttcacaattttattcttattagttttttggttttttatggttctaataacttatagacatgtcttcatacttacaggaaaagaaaatatgtaacttccaaggtcatcttttttctatctctgctttcatgtaggaggcttaagtcactcttgtgattactattaagatgaagtaaaaaacataatgctttgatataaatcaaacattaattcttgaaacactgtgccacacagtgttcacgttgtgcactgaaaaaaagtggagggacccatatgtcagactgatattctagaattactgataaccacctctgagattctgtacttcaaaattgtttctgtttttattagtacctacttcctagtgttcatggaaggattcggtgaatgaatgctaataaagcatatggaacattgttggcattgattaattgttatactgaatgctgatgtctaatttgaaaaaggaacaagacattttggggattatccggtaggggtatgagctatgaactgtattaaattttgtggggggagattacagcctgatgtctttcttgggggaaaaaacctctaagatattcaagttgttgttttccattgaaaatgaatgtataaaaatgacgatttgggaagacatattacatattaggtcaaaagtgtatgattcatttctcaattcattactatactctcagtcttggctttaatctcaaccataccacctgtgaccttagtatacaacctttccttcattcatattattgttgatattcagaaggtgaggtggttgtttatggcaactaaaggcaaaattacagaattttgattgttggaaagttaataattcagtgatagttttattcccagttcttttcctactttgctattcctcaacatacagtgttggtatttagaatcttaaaactagaaaactttaatgctagaagtgatcatagatactgacaagtctgattcatttatcttacagttgaaaaaattaagaccccagcgaggaagaaaactggccaagtttaattctacatactgactttcagtgataggtcacatttccttatttttctaaaaataattgactctggagaaacaattgattccttaatactgcactgatgtgctgaaccaatagatttaccaacgtaaatcaatgttatctgtgaatagacagtacacagtattttaaacctatctattcagtagtacggtacactgccttttaattcctgtcgctttgcgatgatgctatagctcacaccgaaactcttaagtgattatctttaaggattttcttctccagctatgagtctaaacagtctgagtaaagaggctgcatggtctccccatggcctcctaaatgtttttaggaagtggaacccccttctggagttatgagagaaacatcacttctaaaatgcctttaaaagtactccagcattaacattacactggaacatttcattagctttttgagaacaataaagaaatgtggagcataataggctaatatgtttaagtggccttggtagaaccctacttaactcagtgggattttctgcagcatgcagaggtggaaaaccattccttacatatttattgtgtaggactgcctccttctttattgcatgcaatttatatcaaagagaagtgactttccacctgtaattctaaaatcaagcaagtctcaaaatacacaattagaagaatcaatgtttagatatgatgatcagcaaccagcagtgctgacttttggcactctgaatttctgtcagtaaagatggtagaggagccaacttgaatctcagtatttcctggccttttaggacttaaattttcatcagggtattaagatctatgaagtatctgagttcctaaagaaaatgtgcgatgtgagtcaaacctcattggtcacaaattacaaaaattaattcaattaataaaagttattctcttactagcaataaagctagctagaaaacttttctgcaaaatattttgcattaagtaaaaatataagctaatgaaaaatacaaagtggtagtttttatggttttattaggatttcaagtgagtatacttgctatattgctattcttgcagtataatattctgccagtactctttagctctctgagcttctattttctgtggtataaattgggactcattagtcttagggacactgtgatcattgtgatttgtttgagcttttaggaaaaaaggtgtaaattaggcccacaattacaatattttaagcaagttcaaacaaacatacatgatgacaaaataaaagtttccacatatatattagtttcctttctgccaacaagttgtcaccaaaatttattggaaagaccgaattcctgtttgtgtggcattgaattaatgatattaaaaaaagcctcttgagtgacagctggagtggctgaagtggcatatttaaaacattatgtttgtttgtttcacttactgtcaaactctgtcttagaaatactatcaactggttatattgatagatagaagctgtcttttagtttcaggatatgttttgtatcaaagtttctcttcattggtttttgggatctatatgcaaaataacatataaacacaaatgtaaaacccagctgtaattgtctcttagcatttgatgacatcataaattccttaagatttatgctcatgttgtattgtaaatatcaccagaaccacttagtatgagggtgaaaatgctaaacaaaacttattgaaaataatgcatatacttatttttcactttgaggagcgtttcctagctaccctatttaccccagtggaatttcacaaaaatgtccctggcactcaaagtttgtctaacaatgaatcaagtgggcttattttaaaattcacccctaaatatgtttgctggttttgaaattctgattttgtgcttatgtaattcaaaaacagctttggtttaaaaacaaaatttggcaaaaatactagtgcattatgtgttttaatcacgtatggtgttttgaaaaaaatagactcaaaattgacaaaattgttttattggcactacagttcaaatgcatggattttcttcctcacaagttgcgtaaaataaaaataaaatcagcagatatttcttaagtgagtagtatgtgaacttaattgatttttataaaatatagtacaacaactgcactgcaggcataaattttcacgctatgtttttgcatcctttattttacagatttcattatgttttatttgatggtcaagtctatagtgtgctttagcataagttttaaaatgcatggagctctcaaaaaagtttcttctagtgatatggatagtacataaaatctagtatcaatggcccagtgtttctctttcatagagttctttgattttttcttatattcttataagtcctttctttggaaaatatatgaacttagaaacagaagtttccctggctcatattatgcccatgagacaatgataatgctgaagtccttttcataatcaggacctttatagagatcatccaggtattcttagccaaaatatccctctcattgtacactactccagggcaacatgtggtgtgccagctggatgccctccctacatgcctcaggtggccacatttcaatggtgcctatagagcacaggccaaattctcattctctgtgttaatcagtgggagaattcccatagaaaatgggatgtgaacatatttcaggaaaactcaaagagattagccagatgattaggccaggacattgtaagttcaagttttatgtaggatttctatagcattatcttagttgaccgaagaatgctataaaatttggagatatttagaaattaaaaataatcatccttttcattttactgtgatttctccaaagagaaattcaacaatattttttcttttgatataataggatctcatcttgattcataacatcaaagacaacggatgtacctagtcatataatttgactgaaactttttcccatggtattaaaaggatctgattctacttgtagaagtctcattatacttctcttttcaattaaattctagtcaattctacaaacatttagtaaatgcttactatgtacaaagcactttaatagatgctctgaataattctgtgtatggtgctttatagtatgtaacatattttcacattcattttctcatttggtgaagattcactttcttattattacttaaattgtctagagtttcagatgatgttgtttcctaggtagaatgtttgttttgtttttgcttgttctatttttgatgtgtccagagaccattctagaaatacatttagctttccttgaaggaaaaataaggtcttatcattgtatcatcctattaaattgagttggattggaactagcggcatttcctgaaatttctgtttgtttcatatgccctcaggctccattttaagtgtttttttaatgacctaattgaaatggtttgtcaacatgttcaaaaaacaaaataattttatttactacttttatgacaatactgatttatcatatttcatgtaatatctttttaaggcaaaaacaattagatttttccagaaactatttatatctcatacttaagattatattaaattttactgctctaccttgaaatctgcaagtgccatacaacttctgtagaataggtatgaaatctattattccccatttagcatgtgcaatatgctctaatattgttgcatctaacgcagaatgaaataatctgcttctatattaatgttacactatcaagtcttatttctacatatttctgagatttttttcaagtctttctctcaaacctactttgtaaatacattagaatagccccagttttacttttattcattcattttatttcccttacccgtagtgttgaaatggaatttatcaatgctttagcattataagattttcaaataatttaaaagaaaaattatcttcactttaagcattgaatgcatcacttttttccataaacccgaaactcagaacctgtaggaacgccttcatttgctttatttctgacattaaatttgcaaaaaggcactttccaggtaacccatcagctatgtcaccctgggtatttggccagagggcagtcatgttgaccccatctgcaaaggctggctaaactagagtcttggactattagaatctcattcatcaaggtccacataaagtacggtaggtgggaagcaggaggacagatggtagggtcgggcgcaaggaacttgtttgttgacattgatgtagacgcttcttcttgccagagtgactccatgcacttattttggcatggaagactaggccaaagctatcatcttaatagaaggtgagctgcaggcaaactagagagatccatgcacagtaggtatttagagttggcttagattttatctatcagcttgactgtcatacatacttgattgatgtgcagcagggcttgaaagtgctgcattgatgttgaggactgtgtcataaggttcctgatatggtgcacatgtctgaatggagttggacattggctgtctttgcccatgccaaacaacaccagacttcagtgcattattctgcagttgagtagcagatggtgactgcagacgtttggagggggtgtgccttcaaacacaatatggagccagcaaacttacttagaaggttattacatgtcttgactttggcagctattttttaagcactgttgaaaatccaagttccatccattgttattcgcaaaatactaggcaaggttggtattccatggaaaagaaatgtgaaaacgcaaatacactgttcactatgctggttacagttacttgggggtgttttccttggtattgtctaaatgggccaagtaaacattctcagattgattattcctgaaattggtaccaaaacaattattaatattagcaatgtaggtaaattttatcaataagtcaacaacgggaaaggccatcagagcattgggtgaatgctgtagtcaaatatggtatttatgagtgactttattttctttgggttttaattcaggaaaattattgtgttcttcagcactaaaaaaaagtcaagtatctcaatatctcaatagatgttctttatgcacaaaagtatggagattcacagattaaagagcacagtaattctacatgtatatgaaagtgatttttatcggtatctgatttttttcccttaagtgaatttctaacccacataaattcattttaggcttaaaataacttttttttccagattaaaaggtaatgtacacttgttgaaaggatgtgtcaaaatagaaaatatatataacgaataaatttaaatcacttgacaccaccaatcatggataaacaattctaagtatttgctctgcctctttccaagtgtatgggtgtttctaaagtgtacaggtgtttatatatatgtgtttgtttgcatatttctaaacaacattttggattgtatagtctgtatagtgatctcttcacttagcattaattttattaattctgagtcataaaatactcattttcattagctgtgtaatattatatcttaattatgtaccaaaaaattttaattaactccttcatgtttgacatttaggtcattttccactattatttctcctactctgaggatcatttttatatataaatttttatctgcatcttggattatgtttttagcatacatccttagaaagttgatttctgggctagaggatgtaaaattctcaaggttcctttgagaattcttctccaattgtatgtaaaagtgcttttctaactacattcttaactgttttgaatagcagcattatataaatatatgacaaattgcaggcaaaataactagtttacatagttttaatttgcagtgatttaataaggaactagaatgttttttacatgtttgtcattgttttcttatttttataaattgtttgcttgtggtctttactcatgtagttttactgatttgtaagattttatgtgagaaaatgttaaatatttgtatggtcaatttcttgtgtatttttttctctgtgactatgttcattacttttatcttcttttttaaatagcttgaaatttagtaaatattcaccattttttctagtatgatcatggttctgttttatatttttaattgtgtttctcccagaatttattttagcatgttatgatgtaaacatcttacttacttttgttcttaatggttaatcaattgttccagaatcatttccccactgattttgacatcatcttgattgcctactaatttttatcaacattaggatctatttctggactatctgctttttcagttctttcaccggttctatattgcttccattagagcttcaaaataagtttgtgtatcttttaggtaaaatccttccttatctttcttttttcaaaaatgctttggcttttgtcacctacttactagtcaggatttgtttagtttgttgagttcataaaaatgtttcattggaatatttgttggaattgtattaaacctataaatcagtattagtatctttgcaatattcagtcttcccattcagaagcatagtatgttttcatacataaatagattgtatctttttattcatatagatccccaaattccttcatatatttaggtataggcatgctatgttcttgttagtgtccttaattgcctatatttcatttataattctttggtagaaaagccacttcctatttataatccacatgatcctcaacttatgtggggttccattctgataaacccactgtaaaactggaaaatcttaagctgaaccactgtaagttggggactatctgtatttattatctagttattttattcaactctcttaatagttttaataatttcttttaagttcttttggggtttcaaagttattaaattatctcctaacaaagatgactgtctatttcctttcttattcctgtttaatatcctatttcattgactataatttccaaaacagttaagtaatcgttgtggtagagggcatatttcttgttttttattatgtggtattatctctagttttttttcatatttaaggcagatattggttgttgatttaagacagatattatttgatatattggtaaagtggattaacatactattttctgaatccttatttgattattaggaatggacgttgacttttattaatcttttttttctggtaaatattgtccaattgtaactcatggacatagacttttcttgagatgtatttttcaactcaaattaattcatcatacattttatttagcacttactatatgccagaaattgttcactagacattgggattaagatgcatagccctttccctttaaaacattataggataatttgaaatgtgacagttcagcaaaggacttagcataattgattttccactatcaaattgctcttgcataactagaaaaaactttatgatcttattaagaaaactttcagagtttttttaataacctaatggtataacatgtcacaatgtgaatttttaaaattgtttaaatgtaaaatggtgattcacaattgaaattatgagtttttatattgaaacaccattgtgttcagattctaataaaaaatgtccataaaagtttataatgcctcagaaaattcatagacttatgtaatatagattgtttatattctgtaagattaggaaattggaatttctaatcacacctgaccacttcttgtagagtatgacaaaaacgatatgtgatattggggcaactcattttcatgatgctgtcattggggtttcatttctctggagtctgaatcatctgaggatttcagcatgtatttacatagatttattttcacttgaagggtttttttggtattaattttattggcttagtgtagtgtagcataatctaacttgctttccccatgtaatggtatcatttgtcttatttttgggaattctttaattttgttcttttacatagtgtgcatgaatgaaattagattttttgtatttcacacaaatatttattgagaaccaattttctgctcagtatcatgctagttattatgaattacaacacagaaaacataagtcatactttcaaggaacttactttctagttcatggatagatacaaataaggaaattgcaaaactcctaatgaaatatttatttttatagaggcatatatgtatgcctctgcatgtgtgtatatatagagagatatttatttatttatttatttatttatttatttatttatttatttttgagacagagtttctctctttttgcccaggctatagtgcaatagtgtgatctcagctcaccgcaacctccgcctcccaggttcaagtgattctcctgcctcagcttcctgagtagctcggattacaggcatgtgccaccatgcctggctaattttgtatttttagtagagacggggtttctccatgttggtcaggctggtcttaaactcctgacctcaggtgatccacccacctcagcctcccaaagtgctgggattacaggcgtaagccaccacgcccaatttattatgtgtgtgtgtgtgtgtgtgtgtgtgtgtgtgtgtgtgtataagttgtataaatatatttcatatagacttaatatagagagagatttatacacacacacacggagtcatattcttgttcttttagcaaatgtgtcagttcttacaagattccttttgtatatttacctcaccctgtcctcttcatgcttttcctatcattattgtacttttataattgtttcttcacttgcagcttaaataatatatttacttctgcaattttttttattgtcttggaaactacactggatagacaaatgtcatgcacattaatctgtaagatattatcagtgataatttgtctcaaacaaaggtgaacctgctcagagtttggaaataggaatagtgcaggctactataattgtagactgaaatcattgctttctgaatctcctatttgattaaagtacatacttgtcttgatttttagaactattcacaaagagttaacatgcatagtaggagaaacccaaaatgtgaatggcgaagttatcatctctattaaatggggattttagcagtaagctttggtatattaaggaagaaaactcccatactttgggctttcatgagatttttatttcataggcccattcattttaaactttagcatttggcatatattctaaggtttagtcttaaaattttatcaaattttgaaaatttctatctcccctaaatttttaatgtctgcattgaataatgtttgtcacagaccacaatacctgtccctgtggaatggttattctatcttaattcaaaagtaatactattgattagataatacttacagcttccaaacttcaaggcattttttagccaccatttctccttaacctaattctgagcttcctgtgtggtatcatttgtttgaggtcttattaaaatgtaaataaattgcacccagcatacttcctctatttgcccagcttattactatatcaaaacaatcgttttaatgaaacatattgatgtattgtgtatttccgtattaaccaaagtgaagaggaagttatatgaatatataacagagcccactttgtaacagtttttgttaaagcattttataaattggagataatctgagccatgggagatgatgtaattctacatgacagagttcacagaaagaggatagctcctcagatagaataagattagactcttgagagagatgcattggggcttttatggcactttacctttataggcgtagctgactctcagttcttcatattaatgttgtagtgttgtagcaaagatagtaaaaataaaaataaagaaaaagagtgttatctaaaataatgtatctttggcattgatatgaaatttttgacttttaagcatcaaatttgccatttcattttgttcatctagaagctacttctaacctccatattatttcggagaaatggtttaatatttatgtagtagccggtcgtgtgtgcgtgtgcgtgttttgtgtgtgtgtataaaatctccatatgacatgattgaataaaaccaaattcatgaagtaataagcaataacaatgagtagtatcatgaataatgatcaattgcagggctattaaatatgatagtacttgatcaattactaaattaattttatagaaaacaattgctatagaaatacttgaaatatttccgttgcttaagcacaataccaaatagtaaaaataggaggctactcgttgtgtgcaggggaaaatgggtaagccaaattgggattaaaatgtgtcacgttggaatgaaatcctgaaggtccagtagtggtttattgtctctgtgtcatcagactattgatgctcgtaatctttcctcatattttctatattttcagtgtactgttttattttgtttttgcaatgggcatgtattcatgtcatagtcacgaaaagttaatgtaaaaatgtgttatgtatagcctacctgtagataattcattaagacttaactactaatatataaaatctgcctgaaggaatgggagccagaagctaaatttaaaagaaaagtattttattgtacaaataatccatgtctccgaacttgttaacattctatttttaaagcattctttagtgcaagtcatggagacctaagctcatgaggttagtcattactaggaagttacctgaatatttatgttacatgtaacagctagagagccagctaatattaatacaattaattatattctgttagaagtactatagaaacatgttatagagggcctttcttatctcatatggagtttcaatacaacttagaaaaaagctgcctgttcggacacctttgtgcaaattattaaaagaaaccctttgctcaagcagatgcagcttgggctagggaacgtgggttattgagtgaaacacactcctggactaggtgccttggacagggtacaaactatataatcagttgtgtctgctctatgttatatgccttattagttatttgaaaatggttggtgttgttccataggtcccaaattattttattcgtgcacagaaaggcaagaatcatcttcaggtgacttagcaaagaggtggttagttaagctttaagttaatactgagctctgatgatacaaatatgttactttgtctcagacaagtttaaggcagatttgaggctattctgatttgaatagcttcgaaggtagaagaaaactaaagtcaccacaaaaacatagatgagtttatagaggatctaaggttgctattttcagattgcatctgaaatgttggggtatcatatagtaaatttagatgaattgttacatggaagggtagatagacaaatatacagtagagacagatagatatctctttgttacaaaaagaaattgagatagcttaaatgatacatacatgtacaatataaatatatttatgtataaatatatttatataaatataaatgacagtaagtgaaatatataatataaattaagtaaataaaaaataaaatgggtaaacagtggaaaaacatgagaaggaggcaagaatttgacctacatttaaaaagcatcctataaaggatcttacctacatttacagattgggctctgattatatattttaaagaaatacaatgcttatactaagaaaaatcaattttctaggatgctcttcagtatgtatagggatcactgtattataatgtaaatatcaagataaatattaactttcattagcaacaaaggatattttatagaaatgcttctttgtagtcctcaatgtagactgacaacatcttattactgtgaactttagtattcccatttttaaaagatttggaccaaatagagaacacttcacacagatataattcattgaatgacagtgaattctagattatctagattatattatattagattatctagattatattacttgaaatacaactattttttgttattgttattatttgagatggggtttcactctgtcacccaggctggagtgcagtggtgccatcttgactcactgcaacctccgcctcccaggctcaagctatcctcctgcctcagcctcccaagtagctgggactacaggtatgcgccaccatgcgcagctaatttttgcattttctgtacagacaggatttttctgtgttgcccaggctggtctcaaactcctggactcaagtgatctacccatctcagccttgcaaaatgctaggattacagatgtgagccaccatgcctagcctattttttttattgttaattaatagcagaaatagtaatgaagttgggacagggttgatatccttttatagaaattgcaaagcctaataaaaacaatcgctggagaggtttgctggaaaaataccattccacaggaacagaaatctgtttaaatatttattttgaatccactctaatgtatacacaataggtgttcgagacttcaagtttctttttcattgtagcctggatattgccctattgataaccttataagaggtgacagcgtgctggcagtcctcacagtcctggctgctctgggcgcctcctctgcctgggctcccactttggcggcactttaggagcccttcggcccgccgctgcactgtgagagcccctttctgggctggccaaggccggagccggctccctcagcttgcgaggaggtgtggagggagaggtgcgggcgggaaccggggctgcgcgcggtgcttgcgggcaagcgcgagtcccgggtgggcgtgggctagacggaccccgcactcggagcggccggcctgccccaccggccccgggcagtgaggggcttagcacctgggccagcagctgctgtgctcaatttctcgccgggccttagctgccttcccgcggggcagggctcgggacctgcagcccgccatgcctgagcctcccccgacctacgtgggctcctgtgcggcccgagcctcccctaggagcaccgccctctgctccacggcgcccagtcccatcgaccacccaagggctgaggagtgcgggcccacggcgacggactggcaggcagctccacctgcagcccgggtgcgggatccactgggtgaagccagctgggctcctaagtctggtggggacgtggagagcctttatgtctagctaagggattgtaagtacaccaatcgacactctatatctggctactctggtggggacttggagaaactatgtctagctcagggattgtaaatacaccaatcggcactctgtatctagctcaaggtttgtaaacacaccaatcagcaccctgtgtctagctcagggtttgtgaatgcaccagtcgacactctgtatctagctactctggtggggacttggagaacctttgtgtggacactctgtatccagctaatctggtggggatgtggagaacctttgtgtctagctcagggattgtaaacgcaccaatcagcaccctgtcaaaacagaccactcagctctaccaatcagcaggatgtgggtggcgccagataagagaatgaaagcaggctgccggagccagcagtggcaaccggctggggtccacttccacactgtggaagctttgttctttcactctttgcaataaatcttgctactgctcactctttgggtccacactgcctttatgagctgtaacactcaccgcaaaggtctgcagcttcactcctgagccagcgagaccacaaacccaccagaaggcagaaactccgaacacatccgaacatcagaaggaacaaactgcggagacgccgcctttaagaactgtaacactcaccgggagggtccgcggcttcattcttgaagtcagtgagaccaagaacccaccaattccggacacacttatacaacaaggtgacggagttccatcacattctccatcctcagacttacatctttaagcaatgtatgtgatgtttcaggattttgtttcatggattagatttcttgttttccagacagaaacagtaatctttactattacgggttcctagattaaaggttatgacactttaatgagatgaagtttggtgaatactttgatttcctcaacatgttgtaaaagtgaagtattatgttgatccaaagatatcagtaagatattcacaattaatgctttatacattctgaatttttcctaaacaaagtttgctgatttttttcatctatttaagtctctgaaggaaaatgagtttagataattcctagaagcagatactatatgtttatctcttttcatgtgataggagttattttgtaaatccgttcataatttaaatgctctagggaagtgtattctcaagggaactttattgtggatcatcatgtaaaggaaaaattattatatagtaaatattattctctatatccatatgggaactttctgatttacaagttatttgagttccaaaaggagcttattccctttgtgtgttcccaaggaagtataacctgagtgagcccaggaatctgtgagaaaataagctggcaaatactaacctgatccaagtaagtatttggacctgcttagatctctgagctattattgttttgtataagattaagtctaaatgacatattctttacaattgcttagaataggttagtccagctccaaagttcatagcaactcattattaaccaaagtaattctagtccttctcgctgagtggtttctccaaactctatagagtgaggcaaaactatttatctcccatgggagaattttggtaaccttatccctatatcccatacacttccctagaaattcttaatcccccccaaacctttaaactttctagagatgtagtaggaggggcagttgaagattttctatacacatgtaaccattatgaaaacgttcattcaatggcagttagacttcccccccgccaccccacatgcatggatacctgcagctaggcccctgattcctgcattactaagaaaagaattaggcagtggtcattcgctgaagaaatggcatatggcataagtcgtttatgcccactatagattaaaaggtcataaatcatatcacagaagctggatacttttgggagtgaaagtggccaaattaaaagttatgttgggacaactagcacagttaggagcccacagtgttttagccgggagtgcttcctcctattatccgtccccacagttccattgtatcagtagttctgccagggcaggacaagtcatgaaaacccacaacttcactgctgaaagggggtgattcgataatttgatggagcagaacatagaaaaaccccatgcccttaggtgtggtcaaaacagtgacaatctcaggggcaaacaagcagggagaataaacatcatatgtagcctgaagttacaattcagagtagaaaagaactggcagattggccagaaatttagcagggagaattggaaaaggatactatcatagtgaactttggtaagctaccacatattcctagaggtctgaaaggctgcacacatactctggggaagacctaaggctttggacacacagagagaagataagagagaacaaatggaaagtaaaaatcaaaaaaacacttgtaaactgcctgaactttgagtgcattctacaacccacacacacgtatatatcaattagaggcgttagcatagtggccctaggtgtttaagtacaacctgtgactgatcgttggctgaccactaaactgtgttaacacaggggaaagtcccagctcaaaaacgaaaatggaaattacacaaactgagcagaaacatcagcagcggcacagcatggggaagagaggctgcacagagttatgttaggcaagtcctaaataaacaaacacagcaataacagcaacaaccctcaacagggaaaagtcagaagccagagttgctgtaatatgctatataaaatgtcaattttcaagaaaaaaatgagacatgtaataaacaggagtgtgactcatacccaatttaagaagtggttaaaagaaagtgtctgaagaaaaaaaaagaaattatatttgggttgaagtggagatagcagatgttaaacttagcaaacaaagagttgaaagcactattataaatatgttcaaaataataggaaatcatgttaaataattaaagtattactataattaccctttaaatagagagtatcaatataaacataagtgttattttaaaaggaacaaaaattctggagttaaaaaatattataatggaaattaaaaaattgcaagagaatctcaacagaatatttaagatggcagaataaagacacaatgagattgaagatcaattaatagaaatggtctaatttgaagagaaaagaacaatgaaaaaatgagcagagcttcggagacctgtgagagaccatcaagcatactaacatatgtgtaatggtagagaagaggaggaaagaaagaaagggctcaaaaatatttgaagaaataatagccaaaaacttcccaaatgtgatgaataacattaatctacacatttgagaagcacaaaaactccatgttggataaacacaaaaaaaatctgtacatagacacattatagtcaaacttttgaatgaaaaagagaaaattttgacagtaacaagaaaaaaaagactgttacatacaggaaaacaacactacgattaacagcttacttctcattagaaacaaagccaggaggtagagggatgacgtattcagtgtgctgaaggaaaaaaagggaaaatgtcatttaggaattttatatttagcaaaattgttcttcaaaaataaatataaaataaagatatcccaaataaacaaagactgagacaatttgttgctagtagacctgccttaccagaaatactgaaggaaatcctttaagtggaaatgaaatgataaaaatgtatctaaaattcacctaaacaaaaggacctcatcacgtcattatttaggtaagtatagacatgatataaacataaaactaaattctgtttgaacagaaggaaggatataacaaagataagaacagaaatcaatgaaatagataatgaaaataatagagaaaattaatgaaaccaaaacttagttttttgaaaagatcaaccaaaacttagtttttcttttgctagactgatcaaggaaaaaggagagaagatgacagattaccaaaatgaggaatcagagagaaggtatcaccaccaaccccacagaaatgaaaaggattatgaggtatagttatagttaatactatattataaacaaatagtataacctcataatcattctcatttctatggggttggtggtgataccttctctctcattcctgatctcatactatactatgaacaaatattataacctcataatccttttcattgcttgatagttagaaatacaacctgtgactgatcattggttgacctcaattgtcattgcttaacaattagacaattgttagcaactggacaattgttagcaattagctggataaaatggactatcttagaaatgcgcaaattaccaaaactgactcaagaggaaatagaaaatatgaacagactcgtaataaaaagacatacaatttatacaatttatagttaggagaaaatcctagatgtagatgactccactggtgaattctatccaataccagtatttcacaaacttttctagaaatagagcaagaaaggtcatctttcaattatttgtacaatattacactgagagcaaagccagacaaagacatcacaatgaaagaaaactgcagaccagattccctcatgaatatagacaccaaaactcaacaaaatattcacaaaccaaatgtggcaaagtagaaaagcattatacagtgctgaccacagaggatttatcccaggaatgtgagtttcacttaacatccaataattaattaatgcaatatagcatattaatagaataaaagagaaaacacatgaccatttcaatagatgtacagaaacatttgagaaaatccagtatccatttgtgatataatctttcaacaaaaggaatagaagagaacttctgtaacctgacaaagggcatctatgaagaacttataatgtatgtaatgatgaaaacctgaccgatacactcctaggatcggaaaagaggcaaggttgtcagttcttatgtcttctgttcaacattgtacaggagattcaatccagtgcagaatgataaatacatgtaagaaagagagagagaagcaaattagaggaaaaaaaaaagaagcagcagcagctgcaggggagggggaggggaagggaaagagaagggttagacagaccagcagaaagaaacaatcagtggcatacagattggaaattaaaaagtaaaactatttatttgccggcaatataatcttgtacatagaaaattctaagcaatgtacatacacctcccccaccacacacacgaactaataaaggaattcaacaagttaactgaatataagaagagatattgtacagaaatcaattatatttctgtatactagcaacaaacaatgaaattaagaaaacagttcaattcacaatcctgtcaaaaagaataaaggcgtttttacagaaattgacaagctaatcctaaaatttacacgaatatgcaaaagatccaaaatagtgaaaatacttttgaaaaaggaaaacaaaattagataacgtacaatttctggttttaaaacttactttatagagtatgatattggcatacagatcaatggaatggaattgaaagttcagaaaattcatcatatttttgatcaattaaatttgacaaaggtgccaaggcaatttgtcatgggaagggatagtcttttcaataagcagtgctctgtaattgatgctaggattatatgcgatataaatgaatattcacgaacctaggactgtaaaaaacatattttagttcttatttcatatcctgcacaaaaatttaatcatgggcctaaatgtgagagctaaaattataaaatttctagaagaaaacaggagaaaatcttcatgactttgggttagaaaaagttcttagctatcacaccaaaagcttgattcaataaaatccttggtaattaggatgtcaacaaaatttaaaacttttgcacttcaaaagacccattaaagaaatgaaatgacaaaccaaagacaggcgaaaatatttgcaagattgcgatttgcaaatcataatctgataagaatttttacgcataatatataaagaattcttcaataataaaaagacaagcaacccagctaaaaactgggcaaaatatttgacaattcaccgaagttattcaccaaagaagatgaagtcatgcctaataagcacttgaaaacatggtcaacattattatttccagggaaaagtaaattaaaaccgtaaaagactacttcacacccgctagaatggctgtaataaagacagatagtaacaagtgttggaagataaagacaaattagaagcctcctatattaccaggggagatgtaagagtatagtcactttggaaagtggtttggaagtttcttaaaagttaaaataaacttacccttatgatccagcaataccactttgaggtatctaagaggaaaaaaaatatgtccacacagagacgtattttatgtgaatgttcatggcagcattattcgtaacagtaaaaaactggaaacaattcagatgtccattggctgatgcatggataaataaaatgtggtgttatatccatgcagtggaatagtattcatcagtaaaagggaatagactactgctacatgccacaacataaaagaatcttaaaaatgaattatgataagtgaaaaagctacatgaaagagatcacatattatttgattgcattaataaaaatatccaaaaagggcaaatttatagagagagaaaatatttgttgtctgggtctagggattgactccctaagggtatgaaggatctttgtagggtgacaaaaatattctaaaaatgaattgaggtgatggttatacaactctaaatttacttaatgtcattgagttatacacataacaagagtggattgtatgttatataagttatatctcaataaactgttatgtttattaaaactaagtatagagaaacctggcagacattctcctaagcaagcgaccaaggttaacataccccgagatatcatatacctttgatgttataagaagggcacatcacctcttttgtattcttctctaaaacctataatccgaatctagttacgggattggacaaatcaaagttgtaaaaggtttcacaaaatatctgaccactagtcttcacaattatcagtcatgaaaaacatggaatgaccaagaagttatcacagatcagaagagactgaggagacatggcaattaaaatgcagtatggtatcctggattggatttttggaacagaaaaaacatattaatggaaaaattggtgacatctgaataaagtctgtagtttagttaatagtattgtgtcaatattaatttcttaattttgtcaaatttaccatggttatgtaagatagtaacattaggaaaaactagtgaaggaaatatgggtactctctgtactatcattgcaacttttccataattctaaaattgttccaaaatacaaagttaaaattttaaaaagcaaatggagaatttatagattaaaggataattatcgtttgaatataatgtgtacatcttatttagatcctgattcaaactaaccagttataaaaagaaaagaccatttaaaagtcaatcatttaacatggacaggatatttaatgacattaaagaattactattatttttgatgtggaatgatattagttatgattgtcatctttcagtaacacatagtaaagtattcatgcataaaataataagctatctgggattgtctttcagatgctctggtggaagaaaaagtaggtgaaagtataattggaaaaacaattgactatgggtgatgggtactggagagttcatttttctgtattctgccctctctcatatatttgaaatattttataataaaaagtttttaaatagtggaaagaaaaaaatactaaaataaataattaaagtattataattagccttctatgctgaccacaaacagggctgtctcttaaaaatcaaatctgcacaatgtctgaataaataaattatagagagatgagtgaactctcaaaagcaatctgagcaagatacagtcagtactgaatagttggaagagcaataagagaagtgcctgaattaacatagacctcctaagctggaatgctttgttgttctttccttgaagttctgtgacctggtgatatctaaaactccttctgtgtgaggattttagaaagtagaatgtggtcagaagcagccctttgttcgtagtcaatggtaagatctgtagttctcaccccccttcaggttttgttttgttttgtttttttattgactagaggctttgtttgtggccttgtgacttacaagataggttactgcaatataatgcatttgctacttctctggaaagccattcagaatctttaaggagtgcagaatgtacaactcttttgctaaagggtctctgccagagaagcattcttccggattttgtatattgcattgattacggagctgttgctcagtgcatcattggatgttgactgtaatctataaagccttacatagttttcttccaattaaagaagtctgacactggtggtcaattttaataatgactgagattgatctatgtgacttaaaattttaacagattttggaacctgaaatgtgagaaacaagttttcttattgatgacacatactctgaaatctattttaaaggtgggttcagtgtacagtagtgaatttgaattaaaaaaaaaaaaaaaaacagaaagttgaaaatagacaaaagtgccaaaaataaggtatttgtcctgactttctgttccttcatctcacctgacattccctcagaatattttacatccttgatgaccagtcttttaagcaattctacctgataaccccactatatagtgacagagttactgatttgttccatgaggagataagaagaggagcactattcatatcaaagacaactggtcctacttccaggtccatctttgggccaagatatgtagtcgccaacagtgagttggcgactatattttttgagtcctggcgcaaagtaagatccatctgttttgcccagccgtttgcctgagtgccacaaaatggtcctgttattagtcttatttgtggtcctatttgaggttaggtataatgtaaataaatttcagttctcctcgtgatgagtagtacagcatgggaattaagagggctggtgttggtagttgtaagtgatgttgagtctctattttttcaattgctctgttttctttggattgggaaacagacatttaagaatgagtttgtcatctggaaggatagttgtgaccaagtttccctcaacaggatacaagatgttatttttgagcctcattaccctcaccaagagaaaaaaaaaaaagaaggaaaaaggaataagaaagaaagtgaaagtggagaagaaacaagcagaaatagaagaaaaagatcaaagaggagaaggagaaatggcatggggggggaatgaaaattggtacactgaccatctattcatataattgatttaattattttgagctgatagttcaattcattcaacatctggcaaattgaggagaaggaaacctgactgaatgaattgaattactagttgttagttatatgtttatatgtaaatattcagcctagtttctatcaccttttcacgtctaaactagagaatgaatttgtttcgctaaccatattttgttggtgagtagaacaatgccagttggtgaattagatttatccagaggtgggcagttttaaatttctgaatcatttttcagagattattgttattcaatatatttatattatatctcataatttctgagcacaagttatttttgtcagtttcttttatgaatattttgctgccttataaggaaataatgtgcactcccctcctctcattcagttgtccctggtgacgcctccataatttctgcctttacgctggttcatttttagcctaattcaggcatgtgagaggagggggaaaagtttagttagtcaatgtcagtgattttttttaaatctaatctcattcatgagtgaatttactgtgaacctgagcatgtttacgcttaaaatctatgtacatcaaatagaccaattacccaaaatattcctctatacatttcaagagaaaaagaaaacaggaatcccaagtaagaactacatatgctttctaataatagtacaatttaaggggtgatttgtgattatgctctcatatggggaaatattaaaatattaccttgcactaatgtgaaattggatgtaaacatatgacatttagtgttataaatatatagaaagtattctgccacgctgtaaagtgaatgaaagcgaattatattacctcattttatattttaaaaactaaatttttctaaatcccattgtatcagtttttcaaagctaaaagtaaggatgatttaattctagtgtgtgatgtgatttttttaatttaaaaaatactattatttatagatggtgttgtttgaagaaagaaatgattcaaaaaatagtataatattttaagcctaatatttattatatacttggagctcttaatgcctggactgttacttaatttggaattataagtacatatttaaaaaataagcaacatgcttacagttacttaaaccagggagtgttgttcagactctcttggtcttcctgtgctgcttcaaacagcagtggctgcatgtgacaagatgtacaatatgatgtgaaatggggcacgctaaacccataatacagtacatttcaatggccattttgtgttgttaaatatgtttatttagcccttcttcaccatctacctcaccagcaattcagtcactggaaagtaggagatctagcatttcttacaattccatttgaagtcataatttccctttaatatgtgtattcagacccatagattttcttctttattccctgaacttaatattttctgtaatctttaggctgtagaaattgtttaggagtttttttttaatcagaatatagctaaaattcagaaacattgagtttctagtcatatcattatgaagtccttaacatggaggcgtattttgtttttcagaattgctttttttctcctctttagatccttttcttttcattaaaaaactactctgggaagagggttttttcttttttttttttttccttaacagaaaaaaaaaaaaaaaagaaaaaaagaaaagccacgcttgactgataatgcattgctttggatggtgaaacattatgaaagtttaatttttaattaaatctgaaataccaattataactgaaagagattttaacctgtttcttttcagactgcctgaagttacatttagagactgaaatcactgcaccttaaaaacaaaagattgagctgcactgtattcctgtaagtcaaagctttctgtaccttcttctgtgtttctgtgaccaacccaaaaaaggacaaaaacattggtaacatagtaaccagacatgagtaaaaatttgaatgtccctgaagaaatatatgtttaaatgattttcttcttaaaaaaaaaaagttgttggtctcaatattcagtatgtcttttttatccaacctaaattgtgaatcctttcttttggctggtttgaatttcattagggagggtgtcacccactgtgcatgagcacagtgacacacaccctgtctggaaagattcttgcttttttattttattttattttattttattttattttattttattttatttttactagtctcactgaaggtaaaagatttcttttggaatcaaagtagatttcattttcctttgtgatgtcattagaaatttttagcctttgtgtcaatggaaatggagagaaagaaagttcatgatgacatcacaagattctgttgccttgaggactttgggcaaaactaagtaaaatgcataattcccttgtgtgcgtgtgttccccattctgctacgaagcagtcaaaatagcacatcttatgtcttcccgtgagctacaaggctgtctctcagagccccattgttccataaatgcatgtcagagtctaccacagtctggtctacccttatttagctgctgttttgtcaatgtacttggaagaacaattaacatttgggatttcaacgtctgaataacaggcagtgaatagaacccaagcatataaaagattcagacgcccagggtaagaaaacagaagcttatagttggtgaagaaaaaaaagaaaagcatttttaatgctgcactcaaaggttgtgaaatactacaaggaaagtcaatctgtttttatttttaattttagatcaaaatgtacattttggtaataaaatccagaagcttatgatgtcttcctcagttttacagtttaatgtattgcaagttctttcgctaagagtcttaaaacacttacccttctattgttggaatgccagatgtggagtctactgtatcgtggtttttagagtgtcacagcccccagtcaacagagtacactaaaggtgattcagacaattgcttccattttcactgtagttcattgcactctttattgactgtagttcttgtgtgttgacagtagacagttctggagttgcttatatgtctctgcctatggtctgaattcctgctaagttcatttttgttaagcgatgatgcacggacagagcaaggttaccttactgtgattgcatctggtgaaatgaaggagactttggcactttgtgtatgttgcccactgagcatggtgcctggctggtatgagtgaataaatgatagttattgttattgttgtcataactacaacagttcaaacccacagacagtaaggtctctaagagcaggggctctctctttcttactcatttttgtaatttctaacccttggcacaataataggtaatcatgaaatagctgctattagtttaatttcaaaactttttaaaagtcagaaatccagggttcattctgtcagagaatatttattgtaaacacaggttgaatacagtttttgacagtcaggaagaagatgataaaggaatttgccaaacacaacctttctgcttatcatatcatacgaggtatccatctcccagccccttacctcattgactttacacttctttttcctgaccaaagtgagaattgaccattcataccacatccttttcacctatgaaatggtcttcagcatttttccacttaagttgtgtgttttatatcccacacactagaatcaactccacaaataaatatgcccaattccagggtagatgatgctctgatacctcagttcgtcttgccatattatagattttgtttcagggaaatgggacaagtggtacaataagtattgggtcaagaggccagggatttgggaaggaaccattagcagaatgtacttttagtgcataaaaagctaggaccaacttttcaacactaatatgaccacaatattctttagaactcagaaccatttgacaccttctaagttgtttttttttcttttttacatacatttatctgcccctcttccccaccatcagtttttaaaatttatttccaaaagggattctttcatttttattaaatgagcttctggtgatgcaaattaaggctctcataaaacttgacctctgaggcaatattaaaatgatgaaatttaggcttagtgaattctactgttatcatgttcaataacatttaaggacataaaagaattttataaaaacattttatatattttaagattgaaaagtttaggcaaatgtaagggcagagcatcaccaaacattatagtgggaaaggatgtaagaaacaaagtctagtgacttcatttttaaataagcaaattgaggcacagggtagggcacaaaggttacacaaaccatattgaccaccatcgcagatcatccttagagacctagacgtgatagtctatctgaatttacaatctgaggcttcaatctttccactacaatcagggtctaagcaatgtttcctgaggagcaaattgccttgggctcattttttgagacttgttgaattgtagtccccttcatcagaatctcaaattcatatataaaggagtatcctgaaaacattggttgttatcaaaagaggtttttttgtgtgtttttttttgtttttttgttttttaattttgttcctagtatcatgcctttggttgagcaacgagtcctgtagaggcaaatttatttggttgacttaatattctttatgatgatttacaaagtggacataagaccattagaacttcagtagtttaattgggcttacagacatgatgaaaccagtaatctgaacagaaccatagtggtgtggaattcaaacttcccaagggtgtgtacgacgcatggtgtcagaatgtcactgttgccaggggtcatttccatcagagaaaagttttccagagtcagaaaaaaaaagaaataagctttaatattttaaaatgaattacttgctctggtcatttgtttcacattgctttcattggattctgtcatttaccaatccaaagaggctacggtaaaaacctgttattttacccaaagctaaattctggacattttctagtttcttcctttattttaacccatccaggtcttccctctctccaccatgtactgaaagttagtggccttaagtctttgtgcctcaaagacaaagagacaatagttctgccctttaaaaattccatggaagctttggcatatagagaaggaggaatcgagacatggtgataccagagcagggtcctagatgtagatgttcaacaaagttctctcttcaaacctcttctccctttcctttataataatgaattaatgttctgtgcctcctataacaaaatattttaccaagatacacagataaataacacatattttctgttattaaggaattcataatttatctgggaaaatcgcatctttcttatagacaaaacattatatggaatagcagaggaagtaaatggttatcatttttttctaggccatgaaggaataatgtgatactagcaagaagcctatgaagagggagtaataaatgaaagtcaggagaacattgatagtattggtgtgatttcaacatagaatgcttgttggggacagtgactagaggaggaattggatgagaaccataatgtatgggaggatcagttttccaaagtgtgggttgcaacgcattagtaggtcatgaaagtttaaaagatcacatatactagaatcacaggaaaataaatattttttaaagcacatcacatatttttaagatactagatggcaaaataagtgtatttcttatgagaattatgcaccaaaatataaaagcagcttaaacatgacagagcttttaaatatttaactcatgtaatcctaattaagggataaaattattttcttccttatatatgagaaaatggtggagttaagcaatttgccccaggatatacaacaggtaaatagtagacacaggatgtgatcacatctgtcatactccacattcatactcttctcatgacttgacacagcttctcagagttacatgacttcaattatttcactatggataactcagaaatttatatctccagtcctgatatgtcttcagaactttagtcctatatttccaacatccttatttaaatcttcaactagaaatcacactagtttctctgagtcagcatatcaaaacttaatttattcttctacttaaaaaccatcctgcttttgactatcctagcttctctaactccaattctctaggacatctttactcaaaatatatcattctttcctcctcttaatacatcctagatgtccagtaagtggccaagtctcatttattctctttctttgatacctgttccagtcaggattttatcttctcttgcttacaaaaatctcctaattgaaagagatggagcagggagatcagtttatcctaaacactgctgccccattaactttcctaatataggagtactaagattatgtcgcctttgttcagataaaactttcaataattctgtgtataacaatccctaatcaatatacatgacatcctaaaatctaactctgatcccatttcttagttaattgtcacctaccgggttgtatgtactataaactcaggccgagttctcttactcacctttattcatattgttccagcatctggaatgtccatcattcaattttttcatatgcaaatccaacccatcctaccaagttcatttccaatgttatgaatttcatgaatccttctttccttgacctggacagaaacaatccactctcccctaactatcaaatttacttaccacctgtagtgaccctgctgacaacttgattttggacttgtagcctccaaaactgtgagataataaatattgggtattatttataagccaacaagcttgtggtagcttgtcacaacagctctaagaaactaatgcaatactcatctacacttttattgagacaggaattactttctatattttatagcactttatgtgtatgccttattcctttactagaaaacaaaattttaagggaatagtccatatttaattaacatttcttagccctactgagtctaccacaatagaatcattgattcattattcaactatatttaatagtagaaatatagaaatgatcccttagaccttcatcatgaaattgatagtctcctaaggaaattagacatgtaataagtgcaaacataattacaacattacaagctgtggtccacataaagtgttatgtatgcaagacaacattgagtgggggaaatctcttatactgtcctttgggtgttcaggacagaattctcagagagagtgtcctttgatttgaacattgaaggacagaaaataatatcagccaggtgaagaatttggggtagagaacggagtatgggaggggagaaagctccagacagaaactgcatatacaaaatcctgtattcaaatgcaaagctttgaatcagactttctgtattcaaagaactaaaaggacttcagagtggccagagcaaagtgagcaaagcagaatggctggaggtgtggtcagagaaatgccagagtgaggaattttaattttattctgaatgcagtgggaaagcacatagtagatacacacaaaaataccaattgaaggatagctcaagaataggacaagatcaaaattaattcaaaggtaaataatatacacatgctaacaaaatccatacatttattttaaatccttcctgaaggtttacctctgagtttgaggagagcttggacttctgaaatagaggtcttataattcaaaacatatttctcacttgcataaacagagtagatctctgacaaccttctaagataaggtcaagttaattttattttctttctagttaataattattaaaattctgttgttggttaacggatttcttgtttttgtttatttttaagtggctgttgtgtaatgtagagatgcataccaaaaatgtgttttgttcctagaatgtattttttatctgttaaaccttaatctcatttttaattttggtgtattttatcatgtgcaatgaccgggcacctggaggcatagaaaaccttgaaaataaatcatcattattctcattattactacctacaacatgactggatttctggattgaagaacaatccaggctttttttaagtatgatgcattaataacatggtatgccactaagccagaatagagatattggtttgtttgcaaagtgatggaaattatccccttttgcaattaaagaagaaatagagtagagggaatgtggaaattaaaccatagagaagtagcttaagctctaaagatatgaggatttatctgctatagctcagtaaaaagaccctggaaccagaaaatgttatagcgacagggaatcttaggaattatttattctaacctcttcattttggagacgaacaaaattcaggcctagaattcctatccaagtcatagttaaatagtcaatggcaggggctggtactgtaatcccaatactcaggagctaaattaccacagccaaaccagctaatatgtgatcaaagcccctatcataaccctttcaaggtcttgtgtagaaaaagaaatattaagtgcaggagatgagtctatgtacaaaccttaattaataaaaaatctgaacaatatatattacaatccatttacctaatataccagatactgtataaagagttgtctgtaatccttgctaccacactcagcaactacccagcaaagtaggaaccattcccattttataatgaaaaaactgagccccagaacgattaagtagcatctaaaattgcaaagccagtaagtgaggtttgtattactattagacctcactgattcaaactctgtgctatctcctgcttggtgtttttaaatctgttgcatttagttatagcctaagctagtgtggtcacagaggtcattagttctctaatagcccaaatgtctaaaagactgaaaaaatttaggagggtaagaaaaatagttacatttagcagatgccctctccataaaactcttcacatttaattctcacagcattgactgtagattgatgtcataatctttagttcacagtatcagaaactgaggctcagtgagattacattgctgtatacattttagtggaaaaaagcttgagcctgcattcatactctgatatatctgactgtaagtgttcttcctattattctacccacatccaagtctgttcttctcttggatgctagttagttttctatggtttacgcacctcatctggcaaagtagaattgtaatacctgctgtcatagacttcccaaaaagagagagtgcgttgagaggttggctttataattatatcataatggctggaaataaatgtaatgtcctctatacatttcctcctttgaaaaatggggatctgggaagattggtaagatctttagcattagactttcatttctgcatcatcttgatttactgtgtctgtgcccaataccccatcatatcacatataatcgttccaataacctagatctactgaaaaaaacctttgaaaaatgaatgagaagtaaaaaattgtaattattagaccaataagaaggaataattccaatgtttaataattggggtttggtgtacatttttcttcttaagactaacttaattaaagccttatagtgtgatcagaggtaaaggcctatgaaggtactcagccttattgctgctatcaaaatgcaaaactttggggccaggcacggtggctcatgcctgtaatcccgtcactttgggaggctgaggcgtatggatcacttgaagttaggaattcgagaccagcctgaccaacatggtgaaactctgtctctactaaaaaatataaaaaaaattagctggggatggtggcaggttcctgaaatcccagctacttgggaggctgaggcaggagaatcacttaaacccaggaggcggaggttgcagtgagctgagatcgcaccattgcactccagcctgggcaacaaagcaagactccatctcaaaaaaaaaaaaaaaaagaaaaagaaaaagaaaaactttgaaaattcaaacatacttatgaattgctagcactgttttctaaagaccagtgaggaatacatttgaagtgaatcccttggtaaaaccaggacagagagatggacgggggttgaaacattgctgatgatgggtgccactgcaaacataaccctgaattaccttccatgtgtgccaactttaggagcactgcatgtaaacacccccatttctgaagaggtcattttctattactgacacacttgaacaagtattctaaagccaactcttactgtagaataattatctgagtctgggaatgggatgtggggcatcagtatacataacaattttacggtaattagaagcaatgctacctgttagggtcctccagtagttgtttcttccccctacttcttgagctttgacttctgagattatctgtgtgaaagcccttagcagtccattgaaatcttctaaagtaaggcagttaaaaaatatctttcctgcttagcagaagggactttgttctttggcaccaccttactctttgcaatatgttgctagtagccctaaatcagaatgtgcattaatatatcttttgaattgtttggtctcctcaggagaaaaaaaaatgttttcaacaatcttataatattttgttaaaaatccaattctggttcaatgttttgttctcaaaggaattttgaatgaagaaaaagcttttgtaagagggaggaagcttatctaatctcttcaagactgatgagaagcaatcaggagcttgtgactctttgaaacagtaaatttctagggaattgggcacacgtttctcaggaacaataaagagtgttacacttcaggttggctctaaatgcaccccttcatgtatcccaaaaggcaatttgaaagcaccgttctctgagtcaactggaaaagggaggaagccatgctgagctgagattctttcagggggtcaagagacactgaatacagaatgaagatcactcttctgattactgtcgaattctcagttataaccttttttaataaaatgtcttcaaagatgtaggaaaataaattggctcagacaagagagttactggatattagaagatttagatttttgacaaggtcttctacttgtttgcaaatgtactatcttgaccatataaaatttgcctaacctttgctaaaatttcactgaattgttctttgcttacattacttgatattttaagactttgttagataatcaataagtgatagatgtgtagcattgttactgttgccatggttaccatcagtgttctcttcccttctctaggttagggttggcaggtacagctatgaacctgggttccacatctaaccccacatctgctcatcttcttgtagcactggaaagtgtgaggggcctgactagactctggctgctcagtagttaacctacactcatctcacctgaaaaacttgtcagtgaagttttagtcacaagccttttagaagatagaaaaacagtttgcatggaaagctctcatttttaaataaaaactgattatatcaagctaagtgagactctctaattgatgacataatactgtctacgttatcattgcttaccactagcaaggcagcaagtataattggaaggaaagagtatggggctatctggagacttgattcaggtgttgtcagttttgtcttaacatcattttccttatctgtaggggacactttctcctatcttaatgacacatgcagaaaagtcaaatgatatatgtgaagcattaaatatttagagttccatggaataaggctagtttataaatatcatatattacaatagaagtactagtggaaatgtaaatcactttgaggtctcaagagtaaggtcctttatctgagttcttagtggttggaaatttgtttttgagtcatcatatagggaagtcttctgttgctactaaatactgatcatgcattggaaacaatgaagaatgaattgctagtgatatattacttcttttaaatagttgctttaaaagcatttgttactataaattctctgagaagtttctctcaaattaaaaaaaaaaaaaacttactgttatgtctcccctatgatagtcagtgactttctggagggcaaaaaaccaggagtacctcactgattttctttcttggtcaccaaagctggtaccagataggtcttcagtgtttgttgagcatcctgtgtaaaaatttagtaatacttttagtaaaatttgtaaaaaaaaaaaaaaaaagtatactgatttcttgaattggactacatgcatatcatatgatatggacagatgattcatccatgttattgaagataatgcagccattaggaaaagaatgaattatatctatagctgttaacctggaagaatgaccataattttcagggtaatgagtatttatgaataaatatgttgcgtatgtttatatgaacatgaagaaagctatagaaaataattcataccatattcttcacattggttatttcacagagttgggaacaaaaaaaggaatcaggaaagattattaattttttctttaaatagcttttattgtttcaccagttacaatgaacatctattattaaagaagtttgcaaattaatacataaaattgttttaaaaattctttaattctcagataagcagactgagaaaagtaatcagcacacagaagttttagtttcatttgtattgcaacttctgcagcacaaaagaaaatgcatactgtaagcagactgattcatttaatcaacaaatatttcctgagctgtagttggtactagttcttgttaatgaaaatgtctgtgtgtatgagtgtgtgtgtgtttgtgtgtgtgtattcaccgtgctttggtgtataagataaatgtttacttagatgataaattacatcatgtttcacttataaacctcaggacaagtgtttaaatggaacaaaaatatacacaatcaagagacttgatgacatttccagaactctataatctgcttaaatatttacctgtttatcttcttctcacctcatgacttccgcagaccattttcatgacttttgttctagtataagttttataatagcagatccttataatctagatattaattatccttgtaactgatgcctcttctactcttaactctaaaaggatacttaatcttttctagcttgagtggatcttttgctatttataattctaaatttctcttcccttcatctcagtatgctccaggccctaaccggcttttaaaattaccttcacttgtttactcttagctcccccaactcaggatcattttgtctcagaggttcctaattctagctgcatattaaaacctataaagtttttttaaaatgttaatgcattggacccacccagatgttctgctttggttgttaaaagatggagtctagttgcacgctaaccgcttataggaacccaactcctgtttcatcttaaaattttcaattcagtgaagtcaaatttaacatgcttcttcacattggaaaccatttttctggatagtgactgcttctctaaccagacaataataaagctttaacattatgcataatacagctctatgtatcatcacacagatatgcatgtgacatgcatacaaacacatatgttaagctaatgaccaaatttgaacacataagttgataaatatacaattgctctttagatcctatgcatgaaaataattaattagaccttgtgaccaaacttgaaaggtcccctgatatggtttggctctgtccctacccaaatctcatcttgaagtgtagctcccataatcttcgtgtgttgtgtgaggcacccagtgggaggtacttgaatcacaggggcggtttttcctgtgctgttctcatgatagtgaataagtctcatgagatctgatggttttataaagagtagttcccctacacacacactctctcgcctgcctccatataagacatgtctttgctcctccttcactttctgccatgattgtgaggcctcaccagccatgtggaactgtgagtccattaaacctcttttttaaataattacccagtcttgggtacatctttattagtagtgtgagagcaaatgaatacatcctgtttaaacctaactattgtaaatgaaatgtcctatattcctaaagagtgtcagaatatgacttgagtctgactagtgaggaaaaaactggtggctgacaataatgtcaaaaggaatgcacagttgatagccaaaaggtgaaaacaatccaaatgtccatgaatggacaaatggattaacaaaatgtggtccatacatagaatggaatattattcctccttaaaaagaaataaaattctgacatatgctatagcatggataaaactttaatgcattgtgccgagtaagtacctagtatagtcaaattcctagagacagaaagtagaatagaggttaccaggggctaggaggaaggggaaatgggattattatgtaatggttacacagtttgaatatggaaaagttaaaatgttctagagatggaggtggttttgatacttgcataacagtgtgagtatacataatgccactgaactgtacacttaaaaatggttaaaatggtcaatttttaatatatattttaccacaataaaaaaatgtacctttgaaaactctttaaaaatatcagtgaaaatacattgcagttacagggtttagaagaaaaattgaactacatagtctgttcacagaatcattagatttttatgaaatatggtaatttattggcttaagtaacagtctttaccttgctgtcatacttacaaaattcaaatactagtgttatccttgattaacaggcagtaatgactgtaatgaactattagagactatgttttaaacaagcagagaattatttaaatttgtagctatgttagacattctcattttggtcaactaatggcagggaggtagaactgcaggtttctttttcatcaacagtgttatctcttaccaaattatcttattagtaggagaaaccatggctttatttgagcctgtattttccaataattcaatatgtaatcagttactcccttttttcctctgaaaatgttgaatatttttactgacattaataaacttcttggtatacagttctatgaattttaacatatatatagatttatgtaacaagcaccaccaccactatcagaatatgaaagagttccatcacactgaagaacttcttcctttatccatcctctcaccactaactcatggcaaccacagatctttttatcattatagttttgtctttccaagagttgtcatataaatggatatatatgtatacgtgtcatataaatggatatatatgtatatatgtgtatatatatgtgtatatacgtgtatatatgtgtacacacgtatatatatgtatatatatgtgtgtgtgtgtgtgtgtgtgtgtatatatatatatatatatatatatatatatatatataaccttttaagactggcttctttcactcagcttgatgcattaagactcattcatggctgggtatggttagctcatgcctggagttccagcagtttgggaggccaagggaggaggaatgcttgagcccaggaattcgaaaccagcctggacaacacagggagaccctgtctctaaggaaaaaaaatttttaattgactaggcatggtgatgtgcacctgtggttccagctacttgggaggctgaggcaggaggatcacttcagccagggaggttgagactgcagtgaaccatgatcatgcactttagtctgggcaatagagtgagaccctgtctttaaaaaaataaaataaaatattctttcatatcattgcatgtttcacgatttgtttcttttttattgctaagtagtgttcctttgtatggatatacagaagatcatttaccattaattcactgaaagacatttgggtaatttccagttttgcattcccactggcaatgtataagagtttcagtagctccatatccttgtcaatatccttgtcaatacttgatattagtatttttttattctagtcattataaaaggtgtgtaatggaaatactttttttcttttagccacatttttttttcttcaaactgtagaagataatgtgattctggagccataatcttttctgattctccttttcagtactttctatttctatgtactattttccacaggaaaaagatctattattattatatttctgatactattattttcccccactcctcttggaaattctgttttttcctatgacagtatattaattcaattttttagtttttctgaaattcctttttttgtgtgatttcacttttatgtggaatctttttaaaaagaagctgaaaaccatcattctcagcaaactaacacaagaacagaagaccaaacaccgcatgttctcactcataagtggaagctgaacaatgagaacacatggacacaggaaggggaacatcacacactggggcctgttggggagtgggggtctggggaagggatagcattaggagaaatacctgatgtagatgacaggttgatgggtgcagcaaaccaccatggcacgtgtatacctatgtaacaaacctgaaagttctgcacatgtatcccagaacttaaagtataataataattaaaaaagaaaaaaaaagaaatggtgtttctcactactatggcttgtgatgtattgaaaacatggctgttcactaccatggcacacgtttgcctatgtaacaaacctgcacgtcctgtacatgtatcccagaacttaaaattaaattaagaaaaaaaaagtagatttcaaaagtgtaaagaataaaatggtgattgccaggagctggggacagggatatcaggagaagttcgtcaaagggtacacactttcaattataagatgaataacttatggtgatcaaatatacagcatagtgactatagttaataatactgacttgcatccattaaatttacgcagagagtaagatctgaagtattctcagcacacacacatactcacacacatgcacaatggtaactatatgaggtgatggatatgttaataatcttgaccgtggtaatgtgtatttgataaccatcacattgtacatattaaatgtgtaaaattattgtcagttttacctcaataaaaccaggaaaaaatactgaaaactactccaaaacacaaagtaaaatataataataataaataacaatcaattccaccacttaaaaaataaattttaactggaagtgaaaaaacttccctctgtccctaaaatcttcttctgtcaccccctaagataaccactgataacattcaacacctgatgtgctaatctgaaataattttatttcagctaccgtgttcttaatataatttgtctccacattagacgtacaaagagaatataatttaatagtttgaagattatcctttcctgttgtattatgtgtttttcatctaactggctgagatacagcaagttttctctccaattatataattacctaaatagcatgacatctctgattttgcctcttgacccacaaagcctaaaatatttaagattttatcctttttggaaaaggtttgtcaactcctatttcagctgaaggatctaaagcccagaaaagttagatgatgttcccaaggtattggttagatccattttgtgtgtgtgtgtcttttggggtcagactattctgatattgtatggattctggagtatgtctggtttgaatcctacatccacccgttactaccctggtgatctagagcaaatgacttccctttgcctcagtttccttgtttataatatagtattgttgttagcattaaatgagataatatatgtgaaataattacagtgtgctttgcacatggttagtactccagttaactgttagctattgttataattagtgtcaatgtgttgaattcataggctatcctaaagagaagggataaatgttcacatctgatccagtctcattttcttaaaatagcagcgatgttatatcatctgtaatctgaggaaaaactggcatttattcacattcttatttttgtagtatggtttattcatccttcttttcaataactttacaagttaatagaaattatgaacttctaaaatacatgcataatttataatattgattaacttaaacacagagcactcaaatgataaccacatagcacaccttccctgagtccagcagatgatagtgaaaactctttgttctctcatgctgtgtatcttgaggacattttcactatatttaagactacttgaactgattacaattcttttatgattgggcagtggatcagtggctgggtttttaaaaatcatatttaattgtattttgtgcaatggtgaagtgttatatttctgttcactcttttctgttattcacacaaaacattacttgcccagtttattgtttctgttcatctactgcttagactacaaagccatgatgttgagctagatgaaatccagttagataaatgcagtatatattggatcagttagtattttactctgttagtcctcttgcctgtggcaactctagttaactatagaaagaaaaaaaaagttctattcctccaaaagaattaaaatgaaggaggacagcatattttctgctttaaaaaatctagaattgtggtttctaaagaaaacccactgtgtacttgataatttctaaagaaaaatttgttatggactataggttataccttgcatttaagaaccacaacgaaaagaccaactttaacttctcctcattaaaatgataagaattggtattgcctataattgtttccactgtgactcctatgtggtttttgttcaatatactagtccaaacaagattttactcttctcagccctgtagatctaatctcacaaaactaagcatatttttttcagtttcatacatcatcaccatcatcttcctgaggatgtatttttttttttttttttgaggcagagtcttgctccgtcaccaggctggagtgcagtggcgcgatctcagctcactgcaacctctgcttcccagattcaagcaattcttctgcctcagcctcctgagtagctgggattacaggcacgtgtcaccagcccagctaatttttctatttttagtagatacggggtttcaccatgttggtcaagctggtctcgatctcgtgacctcgtgatccacccgcctcagcctcccaaagtgctgggattacaggcatgagccaccgtgcctggccaaaagatgtatcttaacagaagagaaacactggagtaggaaaaatgctgccatgtttagtcttaaggaatttaagaaaataaattgatttgtgcttcatgaatccataattaaataggtagttcaagaggcaagattttgaatagcaaacagtataagtaagacccagatgtggcagtctactctgtaggtaaacaagaccaaatcagaagaaattcaaggtcaataaaaaccaccagcactttatccaaatatagttctgccatatttatgtaatgagtttaagtataaattgcttataattacatatttccataacatgtagtactttacctaacataatatgtattgcattataattattaatttaattgtctgaacctacttcttatgcagagactttattctgtcttgaccaccgtggtttccaatgtactcagcacagttcggaatttgatattcagtagattatcacattaggttgaaagagtgaatggatgaatgaatattcatgaataaatgaattttttaaaggacattattattattttatttactggactgattgccatacagggatatatgcatcaaataatagccaatttttcaagtatattgggaattaggaatacctttgatgtttatgtcacctattcacaggactttcaacttatctctgcatatcagccagtttctacattaaggatataagctctattttcacagatttagatttagtatttgcatcaagatcctgctcaaatattaccttctctactaaaattaccttaattccaccatctataattaattgcttattctctcatctcccacaacacattatctaggactctatttattgaatttattttcaggctttttccatggtttattaggcagattatatttgcacccaacattaacattgcacttagttactcaaatattcatgcatttttaaaaaagaaagttattatggttaaggggaaaaaaaacttacacatgtataaacttcaaaaatatttcatgctcacttagagcatttatccccagcacagagatcagagatccattgtcagtaccataatagctagctacttctacttcaacacgcccctccattggatagaacctgtgagtcttagctctcgctttaaaatcaatagcctcccccattgtagtaactgttattaattaactaagtcattcaatccagaaatatgccactgagcaactactgagcaaaagtgaatgggacagtttttgtcttcaagtagaagaccatataataacaaaaaaaagtatatgtaaacaaatcattacaaagcagcaggttaaaggctttgagacatgtataagatactgtgggagcatataggtggagcatttgcttgctgaagagccagcacctccactttcctcagtgagtgctttcatgttctccatatcagaagatgtatgcatcctgctaagcctcttctgctcccccattttctcctttgccttgtgtattagtctgttctcacaataaagacatgcaagactgggtaatttataaagaaaaaaaggtttaatggactcacagtttcacgtggctgggtagacctcacaatcatggcggaaggtgaaagtcacatcttacatggcagcagggaagagagaaggaaagagccaagcgaaaggggaaaccccttataaaatcaccagatctcatgagacttattcactaccacgagaacagtatgggggaaaccgcccccatgattcagttatctcccactgggttcctcccacaatatgtgggaattatgggagctacaattcaagatgagatctggatggggacacagctaaatcatgtcatcttgtgagagtcacttctcagttactttaagccacaaatgggtgtagcattttagattactccccttaaaaggatgagaatatctgtctcaaacatgtctaaagaaaccacactaaggcttttcctcatactatttcattaatcctactgaaataaaatattggtatgaattaagttaggcagccatttgaaagacaaaatgccttaacaagtcccattaatgagaaacaccttatctcccccctgcaaaatgtttaacaggcttgtacatattagaagtaacagctaacatttattaattactatgtgccagtccctgttctaaaagatttatatgtaaatttatggcattccatcctcacaacaactcttgtaaatagtcactgttgttatcctaattttactggtgaggaaactgaggcacagagagaaaaaatttgcccaaggtcaaggatggggcaaaatcaaaattcagtcccagggagtctgattccacagcctacattaaaaaaattagtttttaacttttgtgaatacatattaggtatatatatttattccttagtatcaagtcttcaaattaaaatttgcctttatatgactcttaaaaatgtttgttttttctttatagaataatatttattttaagatagagttttacaatggttgttatgtttccttcaacttgcatattctggggaagtgagaggtaatatacagtgtaaatgaatgaacagttagcatgttggtaatacagaatatgtttgcttatttatggtaagtcatatgattccctagaggtaaacctgtctaaattgtttacgtgtttataatctaagtgattattttaaaaatggatactacgggccaggcgtggtggctcacgcttgtaatcccagcactttgggaggccaaggtgggctgatcatgagatcaagagatcgagaccatcctggccaacatggtgaaaccccatctatactaaaaatacaaaaattagctgggcatggtggtgcatgtctgttgttccagctactcaggaggctgaggcaggagaatcgcttgaacccgggaggtggaggttgcagtgagccgagatcgcaccactgcactccagcctggcaacagaacgagactccgtctcaaaaaaaagaaaagagaaggatgttaccaactttgtactatttaagctagtctctagcaatgacatggatatatattagagaatgcatctctgcttagtgctctgcaccaatgaaaaagcctttctgtttttcctcactcttcacttccaactttctactattaattctttttctccttttctcttcatataacaaccatttttgtcttaatgaaaaacttaaagtaggctttattaaaacactcacatattgtttcttcatctgtaaaatgaaggattggattacatgatcttaaaagtccctatgggaagactccatgatctacatgtttgatggagataccattttattaagaaaaaaattatgcaataatctattaccaagacacatatcatgacaatcattgatacagaacatttttattcaggatttaaagtctggttttattcaggatttaaagtctggttttattcattacagatttttaaaaattcactaaactacttcaaagaaaaaaataacttcataatttttgtgtatgtaatttgcctgtgtagaggggaattgtataaatctacccactttgaagacctaagtgtgtaatcaaggggtgtttattggaaaatttatattaagtaactgataacctgggattttgattaatttgtgtcttagaaacattatgactaagaaactagagacaagtccttgttcatttgtaagattcctaagtgtatctcatatctttccaaatgttcttgactcttgattttaaagtcccatttatctcaaccatttctccatcacagcaaactttatcatactaaaggcatcctcttatatttgttatagcacagtacagattattagctttcaggatcataatctgtgctaaaagggttaaggtagttttgtagtaggatttttaaaaattattttatattttatctctatagcactcaataatttatcacaaaggttacaaacccaaatgaaccaatctgcactgatcctggccacccattcttcggtgccgtgagttctatgtcaactagttactacttaacttcttaccaggggtgatagaactaagagaagatagtaacaggaaaagaatgttctcaaccctctaggaactcagaaataggtgagatagtgataaatgggaatgttaacaattgcctattgggttgttggaagggttcataaacaaataaagagtacctgtaattatatggcactatgaaaatctgcatagtttttttatagaaaggatatgcatcctgtccttctaaagataagttaggtgtacatagtgttaaagcaaatagaacaaggagacaaggagagtatgaagttggaattcatatcgactgctcagcaccccagatagtggaactcagtggcctctgaagtcctgagatttgaactgccttgagtccccctggtattattaggaaattgaaaagacaacacattgagattcccatttttcatgtttattgaaatgaaggtgtatagggataactattagaatttctttagcctcctggtactttgaatgacttatgttatctttcttttggtacagtagttatgttaatcatcagttactttttttaattttatttaaaaatagactgttcttcttgttttgaaaactactgccaaatgaatactctgtgttaatatgaaagtagcaaaaaataaatgactctgtccatcttttacatgttctgtcattggactattttctccaaaagaaggattctatctctagtagcttttcaaaggtactagagaacgcagccagcatttctacttgattttctcagttcttctcatttgctgattgatctagaatctctttaagctttccataatcttatttctttatctgtatctgtagtctacatctattagcttcatggtgattacgaagattaatggtttggttgttgaaaagccatatagctaagaagaatcatagagttcaggtgtatttttagttctttattaataatgctgctaccaagtgtttttaacgatgaactagagaaagggataaactgggtggtttggtcacaataattttgctattggacttttccaattttaagttattgggttttttgttgttgttgctgttttgttttgagatggagttttgctcttgttgccgaggctggagtgcaacggtgtgatcttttttttttgaatgtgtattattattattattattattattattattattattaacatactttaagttttagggtacatgtgcacaacgtgcaggtttgttacatatgtacacatgtgccatgttggtgtgctgcacccattaactcgtcatttagcattaggtatatctcctaatgctatccctcccccttccccccaccccacaacagtccccagtgtgtgatgttccccttcctgtgtccatgtgttctcattgttcaattcccacctatgagtgagaacatgcagtgtttggttttttgtctttgcgatagtttgctgagaatgatggtttccagcttcatccatgtccctacaaaggacatgaactcatcattttttatggctgcatagtattccatggtgtatatgtgccacattttcttaatccaatctatcattgttggacgtttgggttggttccaagtctttgctattgtgaatagtgccgcaataaacatacatgtgcatgtgtctttatagcagcatgatttataatcctttgggtatatacccagtaatgggatggttgagtcaaatggtatttctagttctagacccctgcggaatcgccacaccgacttccacaatggttgaactagtttacagtcccaccaacagtgtaaaagtgttcctatttatccacatcctctccagcatctgttgtttcctgactttttaatgatcgccattctaactggtgtgagatggtatctcactgtggttttgatttgcatttctctgatggcccatgatgatgagcattttttcatgtgttttttggctgcatgcaatggtgtgatcttggctcactgcaacctctgcctcttgggttcaagagattctcctgcctcagcctcccgagtagctgggattacaggcatgcaccaccatgcccggctaattttgtatttttagtagagacagcatttctccatgttagtcaggctggtcttgaagtcctgacctccctcggcctcccaaagtgctgggattacaggtgtgagccaccatgcccagccaagttattgttttaatatatctatttaagaattcttgggtttaggttccatattatctttgggttaaaccttaaaaatagatttttctttgaatagctaaaggaaagttacctcaagtgcagatagaggatctttatttttataatacagtatatatgtgccaaatatagtttatatttgccaaatcaaatgtcactaaagttaatgatactgataattgatttagggggaaaatggctggtaatacattatgtgtgtaagcattaacttaaatggaaaatactatagatttgtcctacttcataaaaaatgcaaaccagcattagaaaattagaacatttacattcataatctgtttaatcttctgttgaatgcccttgtgcactctctttgccctgttttagttccctacttgctgtagattataagtgcccttaatatctccagtatctccacagagaattttgtcttcaagccttggcatcctgttttccactgtgccttcaacctgagacttcagtgatttcacaaatgctctgaacaatggagttttgaaatggttaccatttgtattagtttcctgtggctgctataacaaactaccacaagcctggtgacttaaaccatcagaaatctattctctcacagttctggaagccaaaagtccaaaatcggtatcattgggcgagaagcaagatgtcagcagggctgcattccttctggatgctctaggggagaatccttttctttgccttcctcagcttctgctgaccactaccgttttttggcttgtggccacatcactgcaatctcagcttctctggtcacattaagttggcctcttctgtccatgtggaatcttcctgttacaaggatacatagaattgtagttagggcccatctagataatccaggataagctccatatgtcaaaattcttaatttaattatacctgcaaagtcttttttttttttcatttaaattaatattcagactccaagagttagaacgtggacacattttgagatgtcattattcagcccaccacaccatgtttacctttgtacctgctctgcattcttcccttgttctcccttctcctttccgctagcactgtcagccaggccaagaaaaaacaagagttgtccaaaggcttaactttcctgtccgcactttgtatgttagtaaaaaaaaaaaaaaaaagaaaaaaaattggaggagtaacaacatggcagatccaggcatcaagattttacagggttgaagaaaactaggtccatgatcaatggtctgcagatttgtagattttacataatttctttggcctggttcacataatttccatcctaatcctaaagacactgtacctgaacagacccagttctgcctttcctcagtgttaaccttcctccatcattgtgcctaaggcaagaagaatccaacagctcaatcaaatgtcaactccctgtcacactccattcaggaaaactgtaccatagcagtgggtcttgagtattcttatgctacataatgaagagggacattgcagaaaggtggctgtcgggaaaacatctggaagaaataaatttcctaggatcaaagggctccgtgtgcagcccagagggtcctcagggtgctcctcagagcaaacaaacagttttcttgatgagtcactgcaatttttttttttttttgccaaaagcccacatgtattgcaagatctcaaggaaaagaggtggagtaaggagaaagaaaaaaaaaattaaataaggcaacagaagtcatttttaagaattttaaccacatgaataaaagaaatatcaacatgattacaatcttttaatatatccaccatcctcaacattctgtcatgtatattgccccagagtaaagttaagtataagataaaatatgtttaaaaacacaaaaaacaagtggggcaaaggaaggatcttggggaagagtacaacactctgatacaacatattttttttgttctaacatatgaaaattggcataggatggtgaagcccaggactgtgtcccgaagcctagccagtggcattttactgaggaaaaaaaaaaagttacttatgaatcagtacagccatgctttgttctgcatgagtgttttaatagagcgagtgtaatataaggatcaggtgggctcgtgggaatggaacaaaaggttttgtaaaattaaagcaaaataattatagctctaggtgcaaagcaagcatactccagcagttgatagcaaggacctgctcagaatagagaaggaagggagcatgctggaagttttttcttttcttttctttttttttattcactaacaaaggcttttaataggtaacagttgtaaagcatctttgagagtaattaatgcacccacacaaaaatttattaaaatgaaaatttaaggaattgtctaaaatgaattaattaacaaaaaaagaacatcatgcctttcttattttttaaagaaggagagaaggttaagcaaagcagatttttgtgagattgtatttttaaatgttcctggtttatttagtatctgaatagcccttaaaaagagagttggcgagatttgttatccaccccctttagaaatattaaatggggacagacataaaatggggattaatttgctataaatgagcctcaaagccccttgaaattatggtatctccttacaaaatgactgaagtttttaataagtttacagggacctctaggaagcagaatgtggtattcaaaagaaaggaatgtgtgtacattttctcacgtggccatttctatcctgcattgcccttacccaggtcattggagctatccttccatgtgtggcctccatggaagacaaaagggaagattcaaagtgtggtattagtaatttttagctcagtatattttctatctcaacagaaaaataaaattaacttcatttatcctgtttctataagaattttaaatcattatattggtttgttccccttattttctttcatattatttcatactgtgatataattataaagtagaatatgtgcagcgtgctgagaatttaccttttactgtgaaaattatttctagtcgattgcaaaagtatttgttttcagcatgttgttggtagttatacctcaaaaagttttaggttctgaagttgagtaaattttcaaaggttaacttttctaaatcttcaatgccgaaaatcattggaaataactgcctttcttccaatattcctttgttcagttaagaccagaagctagctgtgtaaaaaatatgagtaagaaagaaaattcattttggaagataaattttaaaaactagctttggtgatgacatataaaaataaataatcatagtttttgaagataatttcctttaaaggtatgattataagacaacttgtatagtaggcaaaacataccccagtaggcatgtgatctgtgaattttgggtacatttgcctggactttctttctctttttttcattgtttcttaaatgttcattatcttcatgcctttataaactttcaagctcttttcagatttttcctgttgaagagagtggatttagttggtttgagtaatgttgcactgttagtatagtattcttgcctgtgaggaagagcacatttgtgaagttccttggtgaggacaatttgcacttgagtagatatacactccctgtgttctttttcctttagtctcgaggtattttactttctctgaggatatgactaaaagaaggaatatcggggaaaatgtatttatagtgttaagaactttcttttttcatagtagtggttcctgtcccaattctttactctatgattttaaactaatgtgtctgttggcctttggactgggatagtatgttggataatatatttgttttctgttgctgttgtaccaaccacaaacttagcagcttatgacaatacaaatttattatttgacagttctgcagatcagaagtttagattggctctaccagtttctctgctgtaggctttacaaggccaaaatcaaggtgtcggctggattcttaactggaggaaactctgaaaaaaaatccactttcatgcttattcagttcctcatggttgtgggactaagatctccatttccttgctatcagctgggaaccatctttagatccttgcatgtgtgctgtccctatatgtcagagccagcagcagcaccttgaatcattattacacttgacatctttcaaatttccccttctaccacacctcttttccaaattccagccaaaaaagttctctgcttttaagatgattagactgggccagcttggataatctaggatactctccctgttttagtgttaacaaccttcattacatttacagagtcgctttttcatgtaacataacattttgccatgtaccacaggttctgggctttaggcagtgggcattttggggtgcaattattttgcctcccacagatgaattctaaaagaatgagtcacctacctccatcatacatttctagagtactctgagtattctagtgcttttgatctagaagtagaagattcagtatgaattctcaccttctaaatgctattagtagatttttttaatatatatgttatgaaacttggtaaagagtatttattttctgtttgataaacagaataactaggggcgagggaaaaccaagttgaccattagggcttgaggtagaccagaaattttttggtttatggcagtggttttatttatcctaatccttttaatcactacaaagcatactagaaccatagagagagcccagctgggaaaaggaagtaagcccagatcaagtgaatcagaaatgagattactaatttattttttattttattttatttttttgagacggagtctcactctgttacccaggctggggtgcagtggcctaatctcggctcactgcacctccatctcccaggttcaagcgattctcctgcctcagcctcccaggtagctgggactacaggtgtgtgccaccatgcccggttacttttttgtatttttagtagagacggggtttcaccatgttggccaggctggtcacgaactcctgacctcaggcaatctgcctgcctcagcctccgaaagtggggattactaaaattttaatacaggtgattcacatggaaggctgagataaatgcaggaaacagaaaaatctcaagtctttcactggtatctaagagagtgtgacctattgagagcaggatgcaagacattattaggttggtcagatagatggcaacatttcaattcataggttggtaatatgggctaaggatgcaatagttaggaatccaagttaaataaagacttcagtttaagctgaaaatgaagaggaaagttctaacactttctaacaccagaaatacatctttagataaggtcaaaggaagggccaaaaggtcaaaaggaaacgtggacaaagaggggataaggaagaggaactggaggtaaatttcatccacactttggaattctgttcaaggttggctctggtatttgggatggaagggttgctttgaatattaagagagaaatatagtacaggtaaatccactagattataatttctattatatcatttccttaaggaagaaatgagctcacccctgcaatctgccatcttgtgtattttcatattagactatatatttcagagataaaaacaggaagtaaaatttttaagtaagaaggataatttcccaagtaaaaacaggaaagataaggacaataagattgtaaatttttaactattttttttactttaattacaacagaaacctgaatatatgcttataaatttgtaagtcagtttttagttatttaataaatctaattaagtaatcacaaatcaactaacaagatagttgaagtcagatatatgtatgtttatatttttttctcaaagtatgttctactatgttattcatgaagcattttgggttttttgagtatttaaatcaactaattttttatttaggtttgttttgtcatttatttgcactttaacaaaaaacaaatcttctatttcccagttaagtaaacatttaagtaatacaaatgaaaaaaaatagagttctgagaaatatgcaattgcgtaacagaagtcatatatgggctgactcataattgcaaagtaaaatctctgcaaaagtccttaacaagtgcatgtctttcatatttaaaatacaggctgagcatccctaatccgaaaatctgaaatctgaaatgctccaaaatctgaaatgttttgaacatggacatgatgagcaaaggaaatgctcattgtagtatttcagatttcagactcttggattaggggtactcaactggtaagtatataatgcaaatattccaaaatccgaaaaaagcctaaactcctaaatacttctgctcccagatattgtagataaaggatattcaagctataattaaaatgttatgcataatttccaaaattcatcactgtatgatacaatacactttactgcttaccttttatgaaaatgaaggtaacatacagataagaaggaattacagatttctaaaagatggcgcttttttctactcagttgacaaccaaaagttgcccaggcaagaacataacaattggcatttactaagtgcttatcatatattactacatgaagtggattcttttttttttccataagttattggggtacaggtggtatttggttacatgaataagttcctttttttttttttaagatggagttttgctcttgttgcccaggctggagtgcaatggcataatctcagctcactgagctcactgcagctactgcctcctgggttcaagtgattttcctgcctcagcctcctgagtaggtgggattacaggcacccaccaccaaacccagctaattttttgtatttttactacagacagggtttcaccatgttggccaggctggtcttgaactcctgacctcaggtgatctatacgagtaagttctttagtggcgatttgtgagttttggtgtacccatcacccaagcagcatacactgcaccatatttgcagtcttctatccctcgcccctttcccactctttcctccaagaccccaaagtccattgcatcattcttgtttttttgagatggagtcttgctctgttgcccaggctggagtgcagtgtcatgatctcagctcactgcagcctctgccttccaggttaaagtgattctcctgcctcagcctctggagcacctaggattacgggtgcacaccaccatgcccagctaatttttgtatttttattagagacagggtttcaccatgtgggccaggctggtctcaaactcctgacctcaagtgatccacccacctcgtcctcccaaagttctgggattacaggtctgagccaccatgcctagcccattgcatcattcctatgcctttgcaccctcatagcttagctcccacatatcaggagaacatacaatttttggttttccattctggagttacttcacttagaataatagtctccaatctcatccaggtcactgcaaatgctgttaattcattcctttttatggctgcatagtattccattatatatatatatatatatatatatatatatatatatatatatatgcattttggcacacagtaaaacaaagtatattagctatttaacaggtgcaaatagatatatttgaaagtatattatctatttaccaggtgcaaatagatacatatgcatcagatatatgcatatatatatgatggaatagtatgtatatagtatatatgtatgatagtgtgtgtatataatatatatatgcacaccacagtttctttatccactcattgattgatgggcatttgggttggctccatgattttgcaattgtgaattgtgctgctataatatgtagcaattataagtgatttgtcaacttgtgctgttactaaatgcatgattaacaataaaacacaggcttaactcaacggtattatttttctaacaaaatgattaaacgtacactagtccccacacatggacacgtactacatgcaaacatcatccataagatatgcagtacacgttcaaaaatatctatttgcacctgttaaatagctaatatactttctgttttactgtgtgccaaaataaaattttatcgtgaaagaataagtgctatgggtatcaactcatttgagggtgtattctattgtcctcatttccaaagtaagacaacacatgtgcctaagcaagctatgtgtaatgaatactttttgagtactgtgtagcatggtagcaaaattactgggtatcagaacctgtgagttctagcctttgctctaccacatgttagatttgtgatattaatgaagtcatttaatcgtttgtagcctctcttccctcgcttatgaaaaaaggataatgatatctctcctatttactttccagagttgatagtcacatcagatgagctaaatatactttaaggcatttgaagattatgaattactatgcgaaacattattatgttttaaacaaatataaacaattcccattagtacagttaaggcaaggtctgtttcctcttacatatagccattaaaacattgaaattagtttattattgtttatttgctttgttgtatctgttgcagagtctccttgtaatttcctatatgtctgatgagttgctaatcacaatattaaatggtgttggttttcaatgttattgtaagtattagactaatgttcaaaatcagggcagtattatatattagtgcactatcaaagacagttaacagggagtaatgtagaattaatgattaaaacatgaagaattgctacaatattatatatattgctatataattttatctatttttattaattaaatagttattggtcaagtcatattttttattgatctaaattccaggaacaatgaagagccagatccttaagggttgacttggagagaaggaacacctttttatttttaatgtgtgtgtgtttttgctcggtttgttttgtatctcatttccatttctccaaatccctatccccaaccatttattatggcttggtccagattctagagccaatggtttttcatattaagctaatggataattagatggtgcagggatgaatttcagagtttatataagccctttgaaaatgtatgcaaatatactttatattttatctaaatgtatactttatatgtatttgtaaatatgctttttctttctccccaccccttccttggagagaaggttgataagtttcatttattctcaaaggaccacatgagattaaaaacacttggaactgttgagttagagctattggtaccaaagtgagcatcagctggagaaagaaattttccttttttcccctttttcccaactatcctacttgtgtcccagacatttggattggggtgggaagcagagaaggaagattagagggccagccagtggggaaaggatgagaaaatacctctataatggctttaccttttttttctttccttctttcttgctttttaactcacttttttctcctttctccctccctcctccctttctgtttccttcctcccttccttcctttctccctcacttcctttcttctgtccttccatctttcctcccttcatctctccttcttcctttttcttttcaatatttctcttcataaggtaaaatttaatcaaggacttttaattaagggcccattttattttagtgctgtggcatattcctttactcatctgcttctcatcacttgatgctgattttattcattttatcaccatcccagttttgagaatatcctactctgttctgcagaagtactagtgctctgcagaagttatttctgtaatagaaaatccatagaaatcagtgggaaaaaaggtagtatctatgcaaaacctattccttatcttcgtttttaacattttgggtccctacttgaatatcatcatctaagccaacatttttccaatgaataaaataaagagactaattaatttatgaattatttaagatagaaaatgggtgaaattaagctgtaattcttatatttgctgatataattcagttactttagatatgtagacaagaccatctccaacttctatagagaattgaaaaagaactcaggttacatttttaaccatcttgaacaagaacatcctattaccataaagagggaatagctctcttcactttttcatttcatccaagtatctttgtaccattgtttattttctttagagagaatgagtttgggaaagaaagaaaaaggtgattatgttatcatggatttctgttgtcagttaaaaatgttgcaaagcagttttcttgtagggtttgaattttctagttggattgacttggctgtcagaaagtcaagtagatctttcttctcccagattaaattgataattggctgaaataaaatgttaagaacaattagtaggggtagaattttaaagctatttaacagagcaaacaaacttcatagggctattttgtgtgtgtttttttaaacttctccagggaacacattgtataacgctataacttcctgttccatgaagtatttcttcattgacctacctgcagtaacagcttagcttatacacacacacacacacacacacacacacacacacacacacatttccatcccactattgaatccttttgaagaaaaatcaaggtacagtctcttattcatgcaaaagcatttaagagcacctgttttaaagattagagcttaattcttgcactagatgttttcaacttcttgtttaaatatgggaatgttactgtttcttgtctttcttacctgtctacaggcttttttatccgtttctgtgcccatttcagattgataacactctcaataccagctagccttctcatattccctctgctgttgtttctgcccctaccttctcttactcttgctttgttcagtcctctcatgtttctccattcttcatacttagaattctctttaacttctcatctggatgaatgccttttaatttttatgtagattcaaaccccatttattagtagttttcttctaagtagacaacctcttctttacccagaacttctctttgtaaccgtttcatccatattaggctgtgtattttaaacaaacaaataaaaataagttgatatttatcttccttcttagtcaaaatgcttcttggaggttggggactctttctttgacgtgttctgtagagtatatttcagtttgtctttttagtaaagatggcaacatctcattggattaggaaaaattgaaaaccatatgttccatgtaaagaaatcatttattgtttcgatatttgtgccactcaaacactgaatgctttatttctgcaaaagcatattgattcgttttctgcaatgaatcttatatttttcaaccttcttaaacaatatattctgaacttgatttagtctttacatgatgatttcctgataatcattattgtattagtttcctagggctgccataatagaatatcataaattgggttgtttaaacaacagagatttattggatcacagttctggaagcaagaagtctgagatcaagctattagaagggatggttccttatgagggttgtgggagggaatctgtttcatgcctcttgcttagtttctggagtttatggcaatcgttggaattccttgacctgtaaggcatctccctgatttctgccttcatctttaatatagcattctcccagtgtatgtgtgcccatgtccaaatttcccctttctctacaggcataagtcatacttgagtagagaaccaccttactccattacgactgcatcttaattagggaccctatttccaaatatggtcattttctgagatacttggggttagaaatttaacatatgaattttgggagggcacaattaaacccataataattatgaacactattttttgtgcagagctttaccacaatgatttctgcaggactcaataatagagatgtttgcaagctgtacatagttcttagctttgcatacttttatttctccctcacctcctctgtctcctcttcattctgagatagagccatcatttcttacagatatcattgtactttcttccgaaagtgttttcttcccatgtaatatgaatggagggtccagattactggtgttactgtgtattaaagaagaataaattggttccaaattaaagtctccttggtaagtaatgatgtatttgggcaacagcgtgtaccttatggcatttcttttcatttcccaagggctctattttccctcttctgggtttttgactatgttaacttgagataaccctataaatgaatataagattgctggatactaaggtaccaatatattattttctccttacagaaaactaaagaaatatatctcatagaaatactagaaattggtgatcttgtttactaattgctcaagattttgctcactgatataggaaaatcacagttcccttttgggtactataagatgtgaaattggatttttacagtgtctgttagacttccgtcattcaataaacataatactagagcagaattgagttgaaatcaaatgttgtgagtgggtaaggtaatgtgcacatccagttctcagcaggtggttctaagcaggatgcggggcctgcaccccaagctgctaacctatcaagggtagcccatgtggttctgagggcaccgtgctgatgagcacccactgtggttctgattttggcagccacggctgaatcgagtctttgatctttggagtgacttctgccacagtgagcatatctgtttgttttgcccctccctttggtcattattccaacctggcagtacaggacaaaaaaaaaaaaaaagagagagagagagaggtagaagggggttgtgagaggatacttcaggaacatggctgtaccaagtatgaaaaagctgcttaaaaattctggctctgaaagctcatgcataacatttttgctgactcattaatgaatacattttattttatgtgtcattcaacagcctgctaaaaatcactttttctgattatattttctcattactggggttttgaatccatcataaaatgcagccagccacacaaagaaaaggcagtcctgctccctgtcttttaatagtcttccttcataagtgtctgaatatgcttgaaaacatttacttcttacgctttgatattttaaaatcaattcctctaatatatttgaaaatcagcttcagaggtttgattacattttaattttatttatttatttttaattgaaaaataattatgtatttttatggggtacaatgtgatattttgatctgtgtatgcattttagaaatatttaatcaagccaattaatatattcatcacctcacttgcatgtatgacattttgttgaaatctttcaacagattttgtaataatctctatttattccaatatactgtttaatgaaaaacataaagatgactattctcattttatagctgaaaaaaatggagacactgaggtactatatatgctatttaaggttgtagcagagttagtgtcattctaacaatttaagttttcattcttatatttggggatttctatattctatgttctatgcatatgttctatgcaatgatcaaaacacttgatccacattatcttaataatatcattgaggtatcatagataaaaagtaaactgagacatagaaaagcattaaattacttgtagcaaatctcatagcaaggtcacagggaagctgatacaatcttggacttcttcttatggactagccatgactagttttctgacaagaaacatttttctccttttgagaatgtgaaggtcgaagatttccactgagaaagcaatgccttaaagtactctgagaaaactttagatttttaactctcaaccaaatatacagcccattatattgatcatcacttaacaagtttaaaatacgtgagttctaaacttcttgtttagaaaaactgggattaagtcacctttttattccttcattatctaggtctcactaagtaaaacattttaaggtgtcaggtatttatataaagtatgtgaaaatatataagtttaggaattagaatgtatgtgaaatttatttgggaaaaatagcatctactttgaaatgtgtctgtcataacttctgtttgtcatcattttcaattagaagacaaggttttcctatataaggctagagactcagacagccagtaaggaaggagggaccaaacaggctaaaattttactaagttgtaaccaatccaggtatcatgaagaaagagtacgtgaagttgtcttctatacttttaacttctatgaattaggattttcatttgagaaataaacagattctagaacgccctggcttcccaggaggtgccactaggttagtatggctcagacggatgctcattaactcatctgctggttttcccatacaaaatatctcagccaatatccatagaataaacaccaataattgagggtccaggcagtcctttatcccaaatcagaaactttacttacacacacaagcaaatgaagagagcctccttgcagctcctccataaagaaataccaccatttcatctagaaccagctttatcaccaaaaataaatgttctgtttcatggatatttgtgccatagtttaggtcaagaattatgggtggctggacttagtcaatgtcaagagagaagaaagaatgtggagagggcatcagagtgcccggagttggcaaatgctggcagttagctgtaaagttagcagcatgggattatttgaaaagagcatatgattatactgagtggtggcttccccagtgagtaccaaataagctttttcatctacattaaatacaatgtaatattgtattaatcacttggaaaaacaagaattttttctattattaactggtgagttcctgtgtcatctatctctattttgtctgtcagctctgctttcttaaacacaaccagttcaactatattattaacatcttcaaaggaaaaccctcccagactaccaaggctaatttgctttagctaagatttatttacatttattgtctaagataggcttcaataatatatggtcatttggtccagaaacagtaagtcttagttgtatgtggtaatctttaactctgaatacttcaaatgccatatattttacacctattctgggctagattttgtgctatgcacattaagcatatcattttctttcttttttttttttctttttttttgagatggagtctggctctgtcacccaggccagagtgcagtggcatgatctcggctcactggaacctccatctcccaggttcaggcgattctcctacctcagccccccaagtagatgggattacagctttctgccaccaccccatctagtttttgtatttttattagagacaggatttcaccatgttggccaggctggtctcgaactcctgacttcaggtgatccacccagctcagcctcccaaagtgctgggaatacagtcttgagccaccgtgcccggacttattttctttaattttcacaacataaacattacttgtgactgtgtaactataaagtaataaatctgatttttggtggacattagttgccctggtctcattgtgtagaatgaattcacatagtgtatatctagcttctctacttgtgagtttcataatatactaaatggaggtggtaatagtacctaacatataatgttactgtgggaattaaatgagatactatatgtaaagtccttagattagtccctagcatatagtcagcactcaatgaatgttaactattattatgtgtaagcattgtgggaataaaaatcaaacatttactgataagtgctcagtatatagtaggagctcaatacatacatatttaatgaattaataaactttgtaaattctttaaatggctagatgttactgaactatggtaaatagtattctggctgttgccttacactgttaaatataatataaagcaaaatgttaaataacaccaagaattctgtatagtttctaggagtatttactatctatgaaagagctttttgggggtttaggagtattatttcctttctcatttaacatttgcactcttagtcccatatagcatgtgctatctgactagaagtagatgtgtgaccacaaaatggacacagatttttccccttcctttaacagtcatgcaaatatgatttatcttatggtacagtgaaaacagaagcagtagaagcctgcccatagtaaaagaagataaataggcaagaaaacacagaaaggcagtgtgtgtcaagcatgtttcatgtttgcctcagagaactgaaacacacaaagtgagaaagacatgtatgttactatgtgccagtgctagagatgctgcatgcttttttgatgatatcaagacattatagttttggggaacatttgtttcttaataagtttatttttaaatcctgcaatatttaccatctgaaacatttatctgaaattgtcatgtattaaatcccatcttttctagaactggtgctctgcttctagtaacagtttgagaaagggttcaaaggtttgcctctccctagaatgttcttctcaccactggtacttctacccaacctttacaaatagttgatgcatcacttctaggaggcccatcctacatgtttatgtatatttgtgtcattgctctggctatattgtattacagttttcagttgagatgtgtgttttctcttttagagtctggtgactaaattgtgagcttcttgaataacgaggctgtgctttacttatctccaatattattcagttcctgaaatagagtagatgctcaataaatatgtatccaataaattaataaatttgcagtctcaaacacaggcatatattcttatataagattaaggacattaataaaatttttttatttgtatgttcctaaagtgattgtgaatctttggaaattgtttatgaacatattaatatgtttcttagtgctctagtcactttgagggaaattttttaatctttgaaaaacatattttttaatctctgtatattcttttttaccccgagcattacttttgcataatggactcaagtgtgttgtcaattactgattatttggttgagccacacagaaactgttagaaatccttatttttatttgcacactatctgtttggtggctttgttcaagcccatggattgtcagttaaatggaaaagtcttactttcaagcaaaattctcagcatttaatacagtgtgtagcatatatttgggagtcaataaatgttcatagaatgcatgaacaaatcagtcattgttgcaaactgatttgaggatgaggtatgagattttttttttaaggctaaatgaaatgcccagtatcacatagcaggataagagaaaatctgacactcataactcatacttctgtgtttccagactgttacccaagctcactgagaagtgcagtatatgtctgatttctcaacttcaccctgcagtaaacttttgcaatccagaggctagagacctcttttgtgaatgttgtctgcccaatgactgtgttggcaccagggagtccctagcagataaagtggaggaacatatggtttccatctgaatacaaattggtggacataacgtggtaattcaactgagatgtcctctatattgtaaactgaaagagtatgattagaggtgtttataaacggcatctgaattcccccacacccctccccatcccctttccactgtagttttatctgtctgaatcatagcaatctagcctcccagcctcactgcattatttgtgaaaatggccagtgtgaggaattattaattaaagctaacaaatcaccctgacaagctgtgccctggcatggctgaaggttgattggcgaaagtcttctcctttggagaaaagactttttgtgctcgtgacgcagtcagggacggattattgaatatgcaagttagaagaaaaatcacaggacaagcaaattgagtatttactggcaaataattgcactcttaagctgtggctctcttcctaaattcttaacattctcgagggttagaaagaaacacagaaaaatgcatcggtacagagtacatttcaaaaaaaatacatagactgatgtttcagacttgtgcaggtaagtgtgattgtgtgtgcatggaaagtgaaagaacaagggaaagcaaaggaaagataagggaaaaagcataactgttagtctggtgagtttttaaaatcaacttgtttattggagctcagcgtatttctgagttggaaatttagtttcagtgctgcatttattgtgaaagttagagacgtgagaatgagagaggattttctcaaagttgtttgtctttattagcagaagaatatgttaatgttttgtcccaatagtaattataaattttgttcagatatttgtggatatatgtgtaaaattatcacttgatttaaagatctttagttattttcaacattgttgattatgacacgtcatacagtgtttcgaacatatttgggtacaactattgcatttatttttaaaagtaaacactgttttcattaggaccaagctaatccttattgagaatttctaaagggacattatagttttggaatacttaaacttcagacgtctataataactaaagtgtccttattgtcaattgtgtggtctttttatctgtaatgttaatcagactgctaagttttgtggacatcgtaagacaggagagactagttcagaggtctttcaggaataaatttaaatacatagaaatatgagtgtgcaaatgaaggttaattccatgtataaaatatagacattaagaaacagagatactcttacaagtacagctaggttatgtgagcaacattaccagaatatatatatccattgcagatgaattgcatattctgtgataacctggaaaatgcgctttcatcgacaacaaactgtttttgaaatgaaagtaagtgactggaaaaatagtgcttttggcttttaataactatgaaaaacattgatttaaaacaaaggcataatcataatttaaactaaattaactaattaataattgcaagatgttttaacaatataacatctacatgatactagtaataggaataataataaaaatggaaaatctggtaatcacacagaaattaatcagatgactctcatgttttagaaaatcagaattttaaaatataaataaataaaacatatgttgccttctaatctattccttgagccaagtaatattgtattggttaggatttttctcttactatatcctattttattaaaaaatgtaatttgtcttggtatagggaatagagctcataagaaagtttagaaaatatattttttaaaggtttaattcccactggatcacattctgtcctcagatttcaagaggcagcctccttaaagtttcctgtgactatttgagggcaaaatttggtccattatttagaaatagcaaagggggcatttaaagcatatgttcagagacttaaccatctgcctgctttattatgaataccacagagttatgagaaattggaaggactcaaaaattgaaccagagttctatgcaagattttaaaaatacagcactctgatttttaaaaaaatgttttgcaaccacctacttttgctaagtatatcttattagtcctctatgtaagaatagtattattccacctttttgacgtatggtaagtgaatggcaaagtatagttgagtgacatgaacctatagaaagttaagcataatcctttctctctgatttaacccactaaatatgaatacctgtggagttttagacttgtcatcagtgaaactcacagtgacttagagaaacactataaaatggtgactgctggaacaaaaatgaagtccagctgctagtttctgggctgtctacaaatgagttgcaagagacatgcggaggccagactaaagagcccttctgtaatccaactgtgatgtaatgaaagtatgaatcagctattggttgcccatgctgaggggaaaagcaacaaaatatttttttaaagtgaaaattgacattattcccaggtggtactgtattcctttggtatctggaaggatatgagattcagaaattaataaaagaacaaaaatcatatttaagtcccaagcatagtaatatttcacctagagtggtcgtataaggacatatcaatatgaatataattgttaaaatgtctaatactcaattagagttcttccacattacctgagttttactagaatcagactgagactggctggatcattctcagaggaaaatatgcaaagtagactaaacttagcctgaatacaagtttttggtgttgagatgactatcactctttgttgcttaatgaaaagtatttacttaaaagaaaataatactggaagcaaaggactgaaatatttggtttgaagactctaagtaaaaaatgtatgtgtatgtatcatgtatacttctatatttgtttacataaaaatgttttcagaaatatacactttattaggctgattaagccaaaacttttttgtgtgtgtaatcgaaagactgaacacaaaaattttaaaacagaactgaaagatgtcagtcagaactgaattaatgacctggggctgaaaatacctatgtcaaatttcatatggattttttcatggtggtattttaattttatatctccctaaatggaagtgctgcagtcaagtgaatctatagcccaaagaataatgaaatatgtcaattattttaggtggttagtttttattttttattttgagtacatgcgatgtaaataccaaatacacatacatacatatgtttttgttttgtttatttgtcttatttactatttattgcaccaataagggaattaaaatggctgacaatgaaaaaataaacataaatacatgattgcagcaaaatacatgaattagaaataggtaagaaaaataaaacaataaaggaaaggatataaaaatggagttagaagtgaggtcagcataaaactatattcagtgaagtgctatacagttgcctttaaactttcttgcagcaaagttaaagagaaaagcttgttacacagtttgtaacatccataagcataagaaaataattttcattatttgtcttgaaaatggcttttgaaaacagctcttagttttccaagaaatcaatgctaaagcaactcccactgtaaagaattgaaggctgcagatacctaaaggtcaggtcggaagcagaagcagtaccttccctgggacatggatgtggaagtagaccaaagtaatccccttttaatcccagggcatgtgtttctagagagagaaaaaaaggacaccattaacgcagtaatgttggcaagctaaaaatgtgtggaaagtagggagttaaggggggaatttaaaaaaaaaatttcatgtaaataaatacatatatattttagcagcaaatcaaagattagaaggcattcacttttataataaccattaaaacatgttatcaaataaacctcttgaatcaatgttgctttcctaaattgttcataaaacacttctgtactgctgccattcttcttccacttttactttaagcagattgtcagtctctttgaagttttaaaaagagtcatttctggcttgaaatttaatatttctcgcccttatgtcctcccttggttcattttgagaagtcttagcaaattgcctattcttttcacgggtaattttgatagttaagtcacatttaataggctagtctcttctcttcgtattgaaaaggtgaactgtatagatttattattatattaccttgtagcctagtccatggtaagtagtccaaggaccaactgtatcaggattacctagggattacctatatcaggattatctagagcacctgttaaaatggagattcctgaaccccattccagaatttctaaatcagaagctctgagaatgtagcctggatctgcagtttaggaaactgcccaggttagttgtgcataataaagtttgaagtccactattttaaaattgtgactttaaacatttctagtatatgagtgtaaaatagtaggatttctctacaacaatcaatgagggtttattatactgtattaacactaactaaaacactaatacatactcaataatatgtgattgcctgctcataaatctagaaacacctagattagacaaaactctgaatttgtttgaacccctttaagccatatctcaccattttaaaaatattatttaatttttaagctatcatttattaagaactactatatacaaagtcatatgttgagtctgggcactagagataaaaagatgaataaaagagtttcttgtctgaaaaaaactcataactagaataattatgttattactaggatattttcttatccatactaggataactatgaattgccacataatctactctttaagtaaaactcaaggttccatatggtattatatcactaagtatacagttgttggtagcaattttatagaataggaccctactacaatttggaagctgcaaaacataagaaaaccctgtagggtcttcctcctccccacagtgggagattttatctcccaaaactaggatgagagggtatcatggggtcctcctgattccatttctctcatcattaatcagtgatttgttgccaggatcctttttgagaagagaagagaaatgtgtgtgagtgaatataccagacattctgagaacttgcatgtctctttctccccttcccttctggtggctcagctggcctgtaaaagatgctggagcctaaatggcagtggcctccccagttcgcaggtgaggcacagtatgaaggggcccaagcacctctcacgtggcactctttgctccacaagttacagcagcgccagaaattgagtatcaacaggctagaaaggatgtattgcacataaaggaattaattaggtagtggtctgaggaacatgacaagagcttgcagtttcattggtgattgaagttttcctggaaaccttttgggaacacctttcccctttgtttccagaaaaatataagaaatacagtggaaacatctatacctttttccttcttttcgacatatatttattgaggatgtaatgccatgccttcttttatggactagggatactgtagtgaataaaataaagtttctactttcatgaagtttatattataatggggtaggaaaggaacaaaattacttaatataaaatataaatgtggctgggtgtggtagctcacgcctgtaatctcagcactttggaaggccaaggcgggcagatcacctgaggtcaggagtttgagaccagcctggccatcatggcaaaaccccgtctctattaaaaatgcaaaattagctgggcgtggtagcacatgcctgtaatcaaagctacttgggtggctgaagcaggagaatcgcttgaactcgggaggcggaggttgcagtgagctgagatcgctccattgcactccagcctggggaacaaagcgaaactctgtctcaaaaaaaaaagtgtgtgtgtatatatatatatatatatacgtgtgtgtatatatatacatacatgtatgtgtatatacattatatatacattatatataatgtatacatatatacattatatatacaggtatacatatatacattatatatacaggtatacatatatacattatatatacaggtatacatatatacattatatacaggtatacatatatacattatatatataaaaaatatgcttcattttttagaaattgcctcctgtgttccccattacttctaattatcctcatattatttcataatgtgtatgtatgtgtgtgtgtgtgtattccttgatgcatttgtaaaatcctccagagaagagaccagtaaattcaagacacttcttgtgggaaacttctttccatggggacctgcacataatgtaaggggagaaacaagtcatctgcaaataccaagagtgtgcattgtcaaccctaaaataattctttttcatcttttgtgcttgttctggtgtatgtgtgttctgggttttttcattgaactgagtggtaggcactcaagatgcttagagctctaagaggtagataagtaatggggtcaatcttcaagggacttcacataaagcagagaagactgataattaacaatagtatgtggccttcataaggttctgaggcagacagagtaaggagtactgtccttcaaaaggtcagagagtacagcaacaggaaaggcttcccagcaggagttatgttttaactgagactaacaacctaattgtaaaacaaaacaaaaacattttttaagtaaagtcctgaatttccccttgatcacctaagtaatgtgcccatgttgaaaatatttcagacaataggaaaaagtattttttaaagaaagtaaaatcaccacttagagaaaccattgttaacattcatcagatacttttttgagcatgtattatgtcctaaggttatgccaactggctacagcttctcagaagggagcattttaattggcagatagtgtgaatagcactaattcaaaccttaactcatttcagctgtcttcagatttggcttacagaccaaatgggccccaaccctaataaggtagataaaacaacacaaatggagtattctcttgaacaaacaccatagcacctgctatatcccccacctagagtagatagatacgagagtcagattccttgggttccaatcctgacttgtacctcttttctatctgtgtgatctttaccaaattattggatttctatatctcaatgtgcttttctgttaaattggatttacggtacttacctcatgtaatattttgagaaattaataagataatacatgtaaagtgctaatcacagtacctggcacatagtagagttcaataaatgctatctattatttattggtgattactagtattattactactattatagttatttttattaccagagaaacttgctgaaaatatattttgtccagtacaactccattattattactaacaaaacaattcaaaacacatttcttactgagagcgggtcagagatattatctttccaacacacattaagaatctggattttatagatgaaaattgtaatacgatttagctcagtagataaatgacattatgtggactaaatttctgtttctagatagaaataatgtctaaatgtgccttaaatgcccttcatgtcacatattttgttgcaacaatttgtgattaacttggtttgttttattaaaagaaacttgtaaatccaacgctcttatgttttccagatagtgccacctttctttattcaatcagtgatggaaaatgataagaaatacagttttacctaaagagggtattttcaggaaggaagagattctaatggtcagatctgtgatttagcataatagcaaacaaagataactatcctagcaggtgccacatagtaggtgactaaagaatctttattgaattgaagtatattttgtaagaaaaagcatacgtcaatccaggtgttacgtggaagtttaagtgattttaagagaatgcacaaattatatgctcatggacaagttactttttgtgactaaatcttcaaatggaaaataaaccaataatatcttcattacatggtgagtgtgtatagtccttggtagagttcttggaacataataggtacttgataactgatacctgcgaacaacagaaataaccacaacaataataacacataaaagtcctgtgtataatggctataagctcattaatatataacacatatgatttgtatgtattgatatataaataataacattttaaattgctttgctaatgtttgacacacagtaggaacttggtataaatttgatctatttaaataccctcataaaaagattgctttagttattttagttaaatgaaaatgcagttcaaaaatctaaaactaacttaatcctttggaaaatgacaataaaagcaaaagctacctaaggatatcttactgaaatggtcaaataatttggcctcaatgcaaatgaatagcaggaataccactctgcttcaaagagtagacaaagggaattaacttggaaaactcttaggtgacccctattttgaatcttattaattggaagcattttaaagctcaaaaggctgttattgctagttacagtggtagctacatatggaaaatggctgcagagattcacaatacaaaaatagtccattgctaaattcaaaattctgttaatgtcacaaacagtgggacgtgaaacacaaatgaattgtgatgacagttgagtaccaagctgcctattttttccccctcagagctgcccatatttggctttatattttcctcagtcctgatttaacccataaatatttgtattttctgcagctagcctcaccttggatcgtactacttaagcattttcttcctaagtgtttctcaattcctaggaattctgctttactgcttttcttcctacagataagcattttaaaatatttctttacctattgctttagagtcagattttgaatcttttttcacctacagtccgatgaggctcagtgttgctctttactctcccatttctcctcagtgtttaaagtgtaacctgcaggctagggcctatttcttctccgtgttgctttgacttggtacttgctgtcatcctgatcatctgcatttatttgctaccatcattttttaaaaactggttttttaaatgtcactcttatcctttatgatagaaggtctttatgatccggatttggggagcaagacttattttatgaacccactaaactctcttataaatgcagcagttccacataaccataagctagcttgacctttgggaaatgtcattaaaaaatctctaaagagtattgctaaaatgaccaaattatttaggcttaatagattttgtagcatggataccagacctactcacagagcaacagtcctggctgaatatattttatctgggttttactgcatgtggtgatttggctgccatgtattgagtgacctctctgtgccaagcattttacatttaattcttaaaacaattttgtgagatgggtaccattatcttcatttaataggtaagaaaatcttgacctagagaggctaaatgacttgttaaaaggtggaaatgggatacaaaccaaagtttctaagactaacgttcatcctttctccatttccacatgcttgtgcctggttatatatttacattattggtaatgggaaagaagtttatagtataattcacttggaggcatagccaatttattccttccttccttccttccttccttccttccttccttccttccttccttccttttctttctttctttctttgatggagtcacggactgttgcctgggttggagtgcaatggtgcgatctcggctcactgcaagctccgcctcctgggttcaagtgattctcttgcctctgcctcccaagtagccaggattacaggtatccaccgccacacccagctacttttttgtatttttagtagcgacggggtttcactatgttggccaggctggtctcaaattcctgaccttgtgatccgcccaccttggcctcccaaagttcatggattacaggcttgagccaccgcacccagctgccaatttctttaaaacaaagtgttggtgagattttgctatgttgtcatgttatagaactatgaatccaaggctatagattgactagatctccagtagcaaaaggtacataagtataggcaacatcctttgattttccctttggttttggaggacatgttattgtcagttttgaagaaactacaacttaatatgtgtggcttatgtactaggcattcctgacttctcatcgagtgcctcctgtgacttgtcctaccttttcctccaaaactaaaatctaattattcttaacaaacatatcctgtaggcctttttcccaccaagttttctgaagaattgtttttattataattatttagtgctttattaaagtgggcaattaaagcattttaaatgcctccatcatcaatctatatgtttatcttatgaggcattaacaccactttacttttatacagcactttgcagtttacagcttgaaacatgtataccccaaaaatagcacattgccttttcatcagaatagggatatctaatttaacaatagtcaccacatacagtgaagcagtgagaagactggccttcaaaccagtaatcttcattttctacagaagtgcccaagcctggctttcctctttgcctttatgcagttggaccattgagttcaccagattgcaccccaaactccattattttgctttgagcaaggactgagagttagtgtagactagttagtaactttgccacaacaggtttacttttactttatttgtgtcagaacctctaaaaggatctcgtgaaaatttcctggaatttagagtgaaattttagctagaaagaaagagaaagagagagagagaaagaggaagctacaacaaagccaaaagaaagaaagagagagagagagagagagagagagaaaagaaagaaagaaagaagaaagaaagaaagaaagaaagaaagaaagaaagaaagaaagaaagaaagaaagaagctacaacaaaaaccccagaaccatcttttttcaaatagtcccttgaaaagaaaactataaaaaatttatgttaagattctgggtctttgaattactcatcatgagcacttttcctgggcagtatctcccatgttcacccttcctctggtcacattgaatgttcaatttccttttctcactctgacagttaccaatgttgatatgtcttcattattatttattactttaaatttaaagcagagtagtttttttctcactttttgaaaattcaataagttttattgtgtatgtatcaaaagtcactatataactgtgctctcaatcttggttttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccggcctcaatcttgttttttaaacaaatgaatattgctgtattttaaaaatatgaacgtcattttattttattttattgagacagaatcttgctctgtcacccaggctggagtgtagtggctcagtctttgctcactgcaacctccatctcctgggttcaagcaattctcctgcctcagcctcccgaactgggattacaggtgtgtaccaccatgcctggctaattttttatatttttagtagagagagggtttcaccatgttggccaggctggtctcgagctcctgaccttaggtgatctgcctgcctcagcctctcaaagtgctgggactacaggcataagccactgcgcctggccaaaaatatgaatacatttggctatttccaccctttctgttaatcccaaggatcttcaacttttattcttctctttaagatagtgagtcctggaaataaaagtgaaaatgaacagttctaaaaggttagtattttaaaaattatagtttgccattctcaggtttattcaaaattgactttctgatataactatatgtttttacaaatataagcattacctaggtagtaaaacatattcacagagagttattatcaaaaatatagagaaaaattttacatgtatatgtcccattccctccccactccttcctgagttgttgacatgagaaaatatctttccaacagtggggtatcatttgtttggtgaattttaacgtttgcatgagatggtgttcatgtttgtgaaaaatatcgaagacttctgacttctttctttttaactgcacatggctcaatctaataaattttcaatatagattctgatatggttataatcccaatcataccacatttaaaagctatattcctgactgtgtttctctgctagcatgacgccacaaggaaaatgaaaccaacccaaacaaaaccctccttataacagaaagtaaaatgaagcttgtaacgactgttttgaaaaatggtttgaacagtgaggaacaaccaatttttcaaacactgttgtagctgtttcaagctgtagtgtggatagtgtatgcaagaaatcaataaagggaagagatctctctctgacacagatgaaacctaaaaatactgttaagaccaattctccctccatgcatctgttactgcattccactaaaaggtgttgggaaaaaaatcagccaaattctactagaacgaagcatccagacaagtgactcttcaaataattaaaaaaaaacaaaaacaaaaaacaaacaaacaaaacacactacagtagaaaaaggggaatgggggaaaaaagattaagcacttaacatgttgagtatatacccaaagcagaaaactcagtgagtgaaaaacttgtccttcaaaagaagatactttctatccttcaccagtaacacagaattgatagtctggtaacagaagccttttaagtaggggtggtgggaagaacactgtcttcccaaaggcttcagtaggtattcaattgcccagggcaatctgatcagcatgtccttgtttctagaattgagtaaaccaaatcaggatgaaccgcacatggtttaatagttaacttttagaacaaggggcagggagatgcttttacgccataggcccagtgttcattccaatctcattactaaagtctgttctgagagcatttacagctttccggagagtctgagtttggctgaatcctgaagatggaaatgtagcttaatgacctccttgtcctggagtctcccttaatacaggtgaatttttgtgataaatcattctctagaatccaaagtattgattgatatcatcattattactattattattatgattagccctttcttatgtggttagttctctctccattttcctattctaggaataagtgtaagttttgtgaatatgcatttgctctctctgagtttctttgaaacagtttatgtcttctttcaagttggaagtgtgagatattttgaattatagttggatgtgcaagtccagtcctgctttttagagatcaggaacagaaaaggttctacaaacaatcctttatttgactaagagacagaacaaaggaagggagataattgtatctttgggtgattcagtcttcggtgcttagtattgattgactagtggtctctttatcctggcctctgctttctcagattcctaaacagactcttcccttatgtgtaagaggaactccctcttagcatcttctcagtctcttccaaaggagagtaaccatggacgaggatttagcatatctaatgaatgggcattgggttatcaataagtattaagggaaaataacaacaagaaaattgagggcagattcatggtaagcattgtttgtggaactgttggacgggtctggtgtgtagttgatgttgttgttctaaactgagcagcaacagtaacaacaaacaacgaaatcctacttcccactctcttcttcctttctattcaaaaacaaccatcactatcacaatagcccagtagacaaaataaaagcatgtctatatttttggtatattactgtatgtcttaactgtagtttctctgccacacattaacagagttatttatccctgatgtttttcaaagatcacctttgtgcttgtctgcatagctgttctaatagtgttactattgtctcttcttcattatctccttttatttgagttcttttttttcacgtatgcaaagaggctctttttctaggctctttgcacacattcaccattgcactaggacagatgggtgtttttctatataatgccttttaaagtgagaagacagcaagaatagattttgaacaatattttaccagcattattgaaaaattagctactgtatattctatatacacacacagcagctgcataaaatgcaaattctattcatgtctgatctcttctgcatttatatggtgactatcgctgtagcacctaagcactttatgttatttcctcttattattatttaccacctgatcattccagagtgctttttacaatcagagaatttcattaacaacccattccctcgctctttgtttttcagcacccttgcatgtaaaagtatcaagcatcttggtagctatatcagataaattacagtaaaaagatagagggcttccgacaggagggcaggggaaaaaacaccctaaagcatctcctaaaatttggtttgtgttttatggtatccaaataatgttacagaagtctgtaattttagtgaaaaccaaaccactagataagcgcttttatttatcatggtttccaccattgcaataatcgaaagtgtgaggtgaggaagaggaatactgtctgcacttcatagatagagaggactgggcaattgcactttcttctcactgtggaaagcttgtgattcttattgactcttgagctgcctttagcccagaagtatagaagtcaatctgttttaaaatccaaaaagctactgttatattttttaagctaagaggatagaaacatgtttattaaaaggttcattgtgattatagatgaaagtgcgtggttggtaccttaacagtttgattgaataaaaatcaagttcacactggggtttccttctcagctctactccttgctttctctttgactccaagctaattgcataacctctggttgacttgtgcctcgtctacacattcaaagtgaaattcagaaatgaggttattatctaactaatgtaggctgtaacattatttctctaaaatatctctgtgagagaattttgaaatttctgatttcagtagatagtaaaaaaaataacaattttatggaccatctccttttattcttagacaacaaccccatggaggtggatacatcagagtcagctggaggtggtcagaattatttgcaatgtttggtaagacacagattactgccccttcaccaagtttctgattcagagtctagggtagggactgataatttcacttctgatatgtttccacatgatgctgatggggaccacattttttggatcactgccctaaggatgatatggcttaagtacatatagaaaaggaaatcaaggctcaagtcatggcagtaaatttgtgtctatactctgtcactttacttttggcctcaagtcattgcagtaaagtggcagagtatagacacaaatttaggccttcttcctactacagacattttcttttcacttctactagagatattttcactttacttttatgttttgaatgactgtcagtcgtcttgagatcctaagtgaaaaagcattgtaaagagtggtaattggatcttttccccttagatccagtggctaccctattgcatttgtgaaaggagaggaggaagccattccaaattttagtgattagctttggtatgaacagcttttaaggccagctttatacttccctttggggatgagagtaataaacatagtcttctttgtattcattcatcatagcctgtacatagatatgaacaggtttctctttgatggacttatgaccatgttctgctgtgacaatgctttgtaaaaaaattgtcacttgtatattacttctccaaaaatcataataaaaaaaagatgtcaaagtgaacatgatggggcaagggaaaaaccactgcagacagactgaggacacttgagtcttgtactacctcacatattggcacagatatactgacctccatgggagacacccaacaattcttctttacccaagctatatgttacagtcacccagaaaggctttgaaacaaacacccacatcagggcccaggtacaagaaattctgatttaattgttctggggtagggtctgagtatcagtaggttttaaaagcttgccaggtgcttctaatgtgcaatcagggttaaaaaaccactggcctagtgtttaagggcctgggttttgaaatcagacagatctgagttcatatcttggctctttcacttagttactatgcaaccttggacaagttatttaatctctgtcagctttagttttctcgtatgtaaaatgaaaataatagcacttgtcttgtaggagatctatgaaaattaaattaaatgatacatttaaatgtttgacatcgtacctggcttgtggtatggatctactacacatcagctgctgttgctattataatgcacctcagtttccttatctgtaaagcaaaagagggggcactttaatttatgaaatggaggacaaatatctcaggatttcgtatagatacttgtctgtcaccatatccacagtatcctacccggcttcatttttgccgttcttacttcctacacatatttattattgttaggtacaatcattgacaggctcaacctttattatgatattttaccaataaatacttctctgccctcccccttcccaccaagattaaaaacttgaaacatacaacaaatccacttgtcatatggggtaatgtaggtatgatgggtggttgacctatgggtttaagaaataaaaggcagagttttgtaaacatgtctaaaaactaacatgcccctattcttgattgctatttttttctgccatcactcactctaagagttcagttgttggtagctttcatcctagaaaaggaaaattgttcatactctacttcttaaagattattgcaatttgttaattcccttcattttcccattttccctgatttccttctgtatgtctttttttcttttctttttttttttttttacagtcttgctctgtcacccaggctggagtgcagtggggcaatcttggcttgctgcaacctccgcctccaaggttcaagcagttctctgcctcagcctccagagtagctgggattacaggtgcccaccaccatgcccagctaattttttttttttttgtattttcagtagagacggggtttccccatcttggccaggctggtcttgaactcctgacctcatgatccacctgcctcagcctctcgaaatgctgggattacaggcgtgagccaccgcaccggcctcttctgtatgtcgtagagaagccttagtacacaatgagtaggtaacaaatttttaaagcaataatgatttcataagcctatttgcttatctccaccagtgtttaataggttatacttttcatatattttaatatctctgattttaaaaattagactttctaaaagtctccttgtatcactcttaacatagaaattatgtttttgggtggacagaaagaaattatttgactgtccaataaaagtacagatggttccatttttcttgactcatctcacagcacacattagtcaggtcacatgcctatttgggaatttttgtagtactaggtcacttgcccagctttggggcacataaaagaatattttcctggcttttaagtttgtggatcttacactgtgcctggcatggagataggaaggacatttttttccattaagctttttcactgtgttttgacaggaaaagttgaaacagagtccctactgagattttaacatgttccatggtggtaaccgtaggaaatagggaaacaggaaatttttggacagaaggaagccaaggagtccatctcagcctgtcctcacctcaaagataccagttggactccataatattatttttatctccatgtttatctaaagtttcgtatttctatagttttctttctgatagcagggaaacattgctgccaattatcatgaaaaagattgctctctaaacagtactcagttccttcttctggacaaatcaatggaaatattcattcagatattaataaagcagaattatgggagttttcatttggaaaaatgtattttagtgtttaaagagattctcaaaagatatcatgagaaaatccatgtaaactccagtgatagagaaaggtacttgtttcacacaaaaatatataaacacagaataatgacattttttgttcattaaattcaaggtgcttaaagttgcccatatgcacacacatacatgtataccttccatttactctacttctcctctaccacccactgtcccaacctttgggaaccaaaatactgaagtataaatcaactctcatttctgaaagatctataatgccatttaagtgaaagtccttaaccaacatatattgttatttttccctaaaaacttaattatggacattttgatgcatgtgtttgtttgtgtgcatttttcgtacccacaggaaacatttttcaaacaatctggtcgatggatctctattgaaaatttaccattcattagcatcatacctatgctaatagtttctattgtctttcattattatgaatgagatcctagacacaccattttccatcattttatttaaatagtgaaatacagttaaccaaatagcagtcatggctattagcaactttttgatatacatttggcatggcaacagttatattttatttctcatgtctatattaataccaaaccttaaaatggattatgaaaatacaaaataagctgttaaaaaagaaaactgctctttccagatcagaaacagtacctcacaggactggaattaacatcattatcattgccattttaaacgtaatcacctcagattacataatcttttactaacatgtttgtaaaattaggcttttccatagtccagctttgaaagataaacaccatgtgtacataagcataggtaaaatatctcatagatacagagcccataaaatgggcatattctcataaaggcaggaaaaggtttgctcaaggagcaagctgataagcacagtggtggaatgtcagaatgcctaggctctgtagttcagcctctaccactgaatgagtttaccctaaaggatttaacttcactgtatatcagttcctacatctgactcaatgtcaacttaaacacccccaacattttaataacaaaataattaagatctaaaattgttttgaagtgttcaatattatatacagatacagccttcataatgctcaagcttaaaataggaattgggatcaaattgttagaaaaagttctcttgttccaaatgttggagactgactaagtgatgtcacagcctcaaagttttgcacaggttgaccacaaaggcagagccacagaggaggagctggcttaaacagggccctgtgatggtggactatgttttttaaactaatagaagaaatgggagacactgaaatctgtgaggaagcatgtaacatgatcacgtttgttatgtctcttgaattatctaaggtttgacacaaagggtggattcaaagggcctgacaattggaagctctggtatgatagaaaggttttgccttaagactgtagttctcaaactgaattgcacctcaggaactggcttaaaattcagattctagggccatatccctagaggttctgattccacggtagttcttgggtgagcctgtgatttttcattatagcagcacctcttaaaaccacccaggtatggcccattctctgctcagcattagttctttccacttcaatacgttggcacgatggccaggcatgatggctcacacctgtaatcccaacactttgggaggccaaggcgggaggatcacctgagcccaggatcgctgatgcccttgagatcaaactgtgaattttttgtcataactagtcaatagtctagcatccagcttatgtggtttctggttatggacagtactgaaaagattatttaatgttctataaagtcctacagacagaacatttgattttttcaatggaaattctgtatctttgaaacgttctctgtttattcctattacgtttgcctgttttagtttttaggaaagaatacaaatacatctgtttggtcagaatttttacttaattgacactataggatttatcggaatagggagtcttttacaaattttgatattgttttgtcctgttttttatgcatgtgcccagatgtcttcacaaaactaaaatgaatttttaaaaaatgaacagtctatttaatgcacttaccacatgttgttatatgagaagtgtgacatttgacctaacctctctaaaacccttgaatctataagggtaagcaagaagcatccccattactaagaaatttttgtcatatgaaagaaaatctatcttatttcacatattcaattcccttgtcattttacattataaataaataacaaaccaatttggcacatgcccaccgattaaaaataaaagttgtcagagaggagaaagacaaaaatatgaattattaattataatattaagcagcacaaaaagcctaacatgaaatgatatcacttaaaaagattttatcaaaataaaaattgggcaatgatatagtgcttattgtacaattcaattgttattttaaatgataaatatatttaccatatctagtatatttatatcaaatttgatgaaaagatattttaatcatagcaaataaagaagttatttagagaatagtagcataaaaggaaagctcaattttaaagtctcacattaaattatcatattgacctagtggctatattcactgtaagatcatactcttgcatattgttatttttcaaatacccattactagaaaaaaagcaagaacacttaattagcagaaagggtgatgtttttcttttcatgatgattttggaagtttatacagttcatagtaaaatgggaatgaatgtgggatatttttcctacatagagatttgaaacaatatacatttaatactggtttataaataactaaatgtaggtttccagcagagtagagtgatttcacctcaaaaagggaagatgatcagggctttgatgaaaatatttctacccatgtcttcctaaaacagccttcctaaggaggctaggcttttggtaatttaaatgttttatttctgataaaatttcatttgtttcatgaaatgtattaaattccatttggaaacaaaaattctgaaaaaaatttccacattttgaataatctcatagaagttatccgtgtagattctgaagaaaattcttcatttgctattcccatgaatagcagttttggttctgtttagttgtattttcattttaacactctagagagcttctttgacttgtgttaagcttgcttgttccatttcagttgggtttgttcatgctgtcttgatagtttattctatcaggcatgatgttactttaccgtctcaatcccttggcagtatttttgtttttagtttttaactgaatttaatgctcttgaaaatagagaggtgggtccatatctagaaaaaaaaggcaaaaagttagacatctccattcatctttacagtaaaccaaattttcaaaaaaatgtttctctacattaaatatatttcaaacaactaagtctttagagttctatttaaataaaaacacaaacttttgtgtcatagactacttgggccctatatatctcaacatgggttctaatattaattcatcttgtccatagatttgtaactttggctcttaaaatatattctcttctaactattgcaataatcactaagcatttggtaagtgtatctatagtggtatacccagagatggtgtcccctcagtgcaggttatacaataaagaaatcaaactcggtaaagattttcattttatttctcattcttttcttatctgtagctcccatttgatcagggaacataactcctttcagtattgctgtcttatccaaattttcatccagaagtgacttgcttggcctctgtagtcttcagaggctgttcataaagcttgggtttcccttgtaaatcatgtaagtttcatggccctccagtgttttttgtttgtttctttggggctcactgattcccaccatgtacatccatttcacagctgctgtcatcagctgttctccctctgtgtgatttatttttaataacatccctttatgcccaattttgataaccattagtcccagtaaattctcttatgtttagtccttacttgaattttactttttaaaccactgagttagaacaagaaaacagcataagcagtgacagaaaaccaaatgcagaactaccaaaatgaacgcctacaatcctatctgatgaatgaggcagaaatgaagagattgctcagagaacattctggaataaaagaaaaagaaacctcaatagaacatcattccagaagggaagaaaatatagtcagtaagttatgaataaaatcaagtcatattaaaaaaataaccaaaagaaagcaaccggcttttagatattttttaattacagttaatatttactgagagctttttatgtgccaggcaacatgctaagcaacattcattcatcatttcatttattcattgatttcttgctagaaattcatgacaatagaacctctactatttccttcattttacagaagtgaaaactgaagtttagtttaactaaattatccaaggtcacacagccaggaatgtggagctagaatggaaactccggtgtatcctttacctttatactgtgataactttcaaatgacagcctttaaaaataaacaaatacataaataattctggtttgactactctacataaacatcatgaaaggcctcattcaatcaactcttgacttatacttaagtgttataaatacttgaaacgttaccatcatagagtgtagttcaggttttggaaaatggatctttccccaggtttgctagttttattctctgtagtggtgagaatcctttttggctcactctgttcctaactataagtaatgttggttaatattaagaaaaaaatcttctgaagtctttcaatataatatattttgattgaaaaataaatgagtatgtatctgtaagttatacaattattataaacaagatgagctgcttagataattaaagaggtttccattgacttatttcttggttatcaactggttatattttaaactaatatattaaattctgataatctagaactttgagggtgataaatttcatgtactggataagtttaaggcaacgtgacttcttttgatgtatgatggtttcatgataaataagctattcctcagtataaaaatactgttcttaagcctgaaggaatagtggcccatatataaaatctagtttgggcccaatgcatctgctgtatacagtggtctaagccagcaagttgataaattcagaaactgagcagcctggagccatatgagattcatactgccttgagttgcaggatacatatatattatttgatccagacatttttcatatttcttttaaacaagcagaatcctcttttcaaactaaatcttattagaaacttaacatatggaataatgagtaatattttattgagataaactcattttcaaattcagattatttatcatattgaatattataaagtcattcaataagaatataatggcaaatatacaaaggaataaaaactcagcattggattattgtattggctcaaaaatcaatgtatttttgtatggggaatatagcagatactcaaataacatggtgtcataacgctgatgggaaaaaaaaaaaagaactattcccagtgagccactgtgtgtgtagagttggcactttctccccatatctgcataagttttctctgggtagtgggttttctcccacatcccaaagatgtgcgtgttaggctcatgggtgtgtctgagtgaatgtggctgtgtgtgagtgccccctaagatagaatggcatcctgtctaggcttggttcccaccttaccagtccctgagctgctgagataggctccatccactcatgaccctgaactggaattattgattaaataattatcttacttttattaatctttcttaaatgtatgtacagctcacatttatttcttgcttttattaatctttcttaaatgcatgtacagctcacatttatttcaatgtttaatatcaaaagtgttttgatctttatttagaaacttgatgatgtttctgtgacccaaaatttgccataagaacttaactcttatttatatcaattagtctatggtaaaattgctttcattatatgttgtttcacttaaaatcacagtttccaagaacctatggatggcaataagtgaagactttctgtactatactatatggtatcaaaaaaatcatgagactgataagtagttgcatattgtaacagtttttttcaacagcttgtattccaatctgagagccttaattagaggcctgcatgaaagctgcttattcttattgtacataattaacttgtaataacacattggtctccagtgttttttaaatttatataatacatttaaatttgcatgtcatttttatcacaattgcaaattgatatatatgtatttactacatattatatatgtatttatttttttatttatttatatctatttgataatctttttgtaatcatctctttgtaagtctggggaccatgaagcatagtttgaaaaccacaaatttggttcaaacaatttttaggaaataactatcttttctttttctgatcctctattaggtaagagacaatttaactttttggggataccgtatcttgtgggttttggtatatgtgaatcatttattcttctaaagctaaagctactgaaggaaaaggactttgtttttatttttgttttggtttgtttcctccaggagcctaaaattccgtattgtacatagacagtccaggccatctagttactctatgtgtacatcagaaaacttgaaagaggagtccaaatatcagtctcagtcctttcttctacccttccatgcttctactactacctctacatgatgccgttgatagcaaaagcaatccaatgtatatcaaaatgtcatgtttaccctacatatatacaatttttataaagcaacctagttaattctcttggcttctagttttggaagctcccaagatgaaggagggtgagagggcatagaggtagaaaagaggtagaaaagtgtaattaaatgctagtgtagacaggacagaaggaagcaagatagtcctggcaccactagtgccttctctagaaaactttcaagtctataaaagaatgaccaaaaatcagaatcaactgtctgggccacagatgaaaaatcagatcaaatagagaatgtggtattagctgtgacaccaaccaaatcacattagagcaaccggaactagaaaaacttgtgcagaagcaggcacactctgcagcttttcagccttctgtcaggcgttgggtatccaggtaggcttaggcattggagaactacctgttatgaaagtcaagccttattgagactcctgcatgatgagccagtgaggaaatgagagcaaatatagtatgctgtgaattcatagaacccgtaagtctgtttctataaatgggtaacatttcctactaacttatgtggaaaaatcatttttataatatatgtgtttacattaaaccaataaaatgtcttgtgtatgttggaacattttgcttttatgtctggtagaccatttacctcctcttcagtgtctgttggaacatttattttatattctctatttcattcctgttggagcatttatgtatgatttgtttgttacttttatctgttgatcttgccctccccatatgctcatgtctgactggcctagtttcccacattcagtgtgtgatctctagcccttcttaaatattaattagtgtaattgaattccctccagtatttctaacctcaggcacctgaatctcagtgtttttattagaactgatttgtgcatttaaagtccaacctgcatccccatcccccactgcccaagcaacttttcttgattaggtaaaggtcgtggctatgtgcatgcctcagagaaagtcttcatgggaaaataaaggcattatatatcacaacctttctcagttaaagactgaaaaatacaaagctgtcttgaatctttggcaaaggaagtcacccagaatgaataggaaaaggatgtagccttccccaggagtactgccagaagtgaaatagaaaagccatgcagagccctgtgtggagatgagagcaaagcctcacctaatcatagtacattttcctctacgggcacagtcagggactctaggacaacactttgtataaatcttctcagttgttccagtttgcaggtctatctctgaccaacataccgttcatgattaaacatgagtgactctttccttggaagataacaggaaaaaaaggaaaaggagaagagcctaaaaatagggatagagaaccatatactcatgagaggatttgtcaatgagatagtcaattactaccatccatgtttgaggagaagagaaacaatgttagataactagagatgtggaaatcttctgatttacagaaagtatagaaaggcaatttatgatgatgcaactacttgctgttagtcctgagcaacagtctagaatggattattaaagcaataaagtataaaacaatgtatcatgatccactgaaagaagtggtgcttgctagacaatagaatggcttcagtaaaatgatgtctacaatatgtgatctgatatctcctgggttagatatatagacagattagtaactaatctaggcacagccagattagtaactaatctaggcacagccggattagtaactaatctaggcacagccggattagttactaatctaggcacagccggattagttactaaactaggcacagccggattagttactaatctaggcacagccggattagttactaatctaggcacagccggattagttactaatctaggtacagccgggttagttactaatctaggtacagccgggttagttactaatctaggtacagccgggttagttactaatctaggtacagctggattagtaactaatgtaggtacagctggattagtaactggttgattgaccacactattaggtacaaacaaatggctcaatatcataatataggggattcctgtggcatattgcaaggatattttcggccttatcttggtcacaagtttttttcaataactggaatgaaaacatattcattagatttgcagatgacatgagtccagatacatagaaaagttgttgaatgaagtaatcgaattccaaagacattgaaagactggaattatgggctacatctaacagatgaaattttctaaatggataaatgcaagatattgcctttatattttaaaaagactagtcatgaatgacgtagcagagatatgactttccaacccagtacaagaaatttaaatagataggaacatcttcaggtataagtggccagaatggtagggaactgaaacatgtgatatgagcaatggttaagggaaccgggattaacaggaaattcaggaggaaggaatgtaataactatcttcaagtatatgaatgacagtcatctaaaagataaattatgttgctttctgttactccaacaaatagaccatcagccagtgatgaaacctacaagaataaaatactcaagtcaatatgaaacactaactttgtagcagccttctgtgttcaaaggtaaaaaataggagggtaaaaaataatatggaagatagacctagattaaatctcagttatgccacttattgaatccttgtctcttgggacatttcttgaatgttccatagtctgtttctatacctataaattggctttaagtaattccttccttacaggttgtgatgagataggcaccatataggcactgatacaggcaccatatcagtctgtaggcctaccataacaaaataccacaaggtgggtggactagcaaacagaaattggtttctcacaactctggaggctagaagtccaatactgaggtgtcatcaggtttggtttttcctgaggcctctgtctttggctgcagatagccttctgctgctgtgtccttacacagccttttctttgtgagctcaagagaacctctgatgtctcttcctgtccttataaggacgccagtcctagtggattagagtgccaaccttatgacctcattaaaccttaattacttcttcaaaggccttatctccaaatacagttggtaggagcttagggcttcaccctatgtattttaggggacacaatcagcccataacattgcctaatatccacaaatcctagtttcctaagaccaaggtgtttaagcatagacagctaccttacagggatattttgcaggatactgaagccataacccatttatgcctagtgttccactattggaatgctaagcttgtggcagttatgtatatcctgttgctcaaggtcatcaccaagttctgatttttcacacatacacacacacacacacacaaaattgcaacatttggcataaatgggttaaacagatgattgtcatatataattttaatggactctgctaacactgatattctgtcattataaaaataaaatctttggggccagacacagtagctcacacctgtaatcccagcaccttgggaggccaaggagggaggatcacttgaagacaggagtttgagacaagcttgggcccccaagcaaaaccctgtctatacaaaaaaaaaaaaaaaaaaaaaattagccggatgtgtgatcccagctactcatgaggctaagatgggaggattgtttgagcccaggagtttgaggctgtagtgagctatggtcatgccaccgcactccagcttgggtgacagagtgaaaccctgtctctaaaaaaaaaattaaaagaaaagaaaatcctacatatagcatcaactctgaaattctgcaattctctaaaaatcctcgatagcaaggtagttgttaaggatataaagcaattttctttcaataaatgttttcctttagtattcaaaaatttaatattattgcactaatatttacttacgtactagacctcccttgatttctgcagcccaaattcccaagatggcttctaagtgaaacctctgtctcttgtgagaagacactgctttgtcaaacctttaaatgcctcagaagatatatgtataaaagtagagggagaatataattatcttaaaaacaaatttaagaaaacatagcaacaccaactacacaagtaaatgcatgcataaagtaaaaataaaaagagataggttaatttgttccagaagtttcaaagtctcgatctatagcttcgagactttttaattcataacaattaatggaaaatgcattttgttaatacatccattgctgttattctctattttactatgcatatgtattgcctcttatttagaaactaatagtttaagctgagactatgccagaatctagctattaatgttggatagtcttttagtttatctttcttgcaaagagtatgttagtgaaaaatgggactgtgttgtctattttggtgacaaatgggaccgtgttgtctcttgtgtccatgggtagctggagtcagtttttttattttttatttttttaattttaagttcttgggcacatgtgcaggatgtgcaggtttgttacagaggtaaacatgtgccatggtggtttgctgcacctatcaacctgtcacctaggtattaagctccgcatgcattatctatttttcttgattctctctgcccccacactgccctcccctgaggacatgaaaagacacttctcaaaagaagacatacatgcagccaacaaacctaagagaaaaagctcaacatcactgatcattagagaaattgagtgacttttaaaagtcagtattctacatgaatgaaataacacattctctctcttattctcttgacagactaagtcatgttaaaaagatgcacgtcttctcaaggagtatgtgctttctttcagtctaactaaaaacagaaaacctgaccactattcacggttttatttcttggcaatgaaatagcctcctcttgagaggggcagttactgtaactagacgatggttacaactgagagtttagtctatggtctgatggaaagaccattacatcttgagctgcattatctgcattcaagttctagctcttccatttttttactttgggcagttaacaaattctccaagcctatccatgttatgtaaaactttatttggacttctttccaggtctgcacagtttgacccaatgtggatatttaataaagattaatttatgtcctttttctctgatccttaattctttcaccttctaatgggtatactattaatactttctctacttacctaccccacaggatttttgagacaatcaaataacacgtttgtgagaataatttataaactgtaaaacaccatacaaatgcatttctccttcttatgagtgttacgagtggatggggatgcttaactagaaattgaattgggacctcctaggaatttacattgaaactgtttcctaagagacattagaggcctcatgttgttgtctatttaaattgcctgacctaatctgtacaatgaagatatttaacaacaggtattaaatttgattgtctatttttctgtggtattttccagggagcacaagaaagattatttcctttccaatttttttttcctgtattattgggctgctgtctgttctcaaatatactgagacaaattcttatcctttgtaactatggggatctgggcccatggtgcttactatcattatttctgttgtatttgtggtaattattgttattattattaattatactttgtaattatatagcttcttattttaaggaaagataaattgctagaaaataaacaagctcctgttctttagagatttttggagttttgaacattttaaatccaattttgaccttttttcacaaagatttctacatgaatcttcaaacacaacatgttttttgtctgccatcaaaaataaagtactgacttgtgagatactgccctcgaagttatgcatgagaaaatagtctctcagagcatttcatttcctctttctgccttttaaatgatttcttacagtatagttaccacatagtggaagtttgttttggagaaagattttgaagcagaaggtggagatgcttaaacagtggcccatgcctaggtagaaagttctcattgcccctgcttgcttctgactgccttttgaagaaaagaaaaaggtgaaccaaggtgagatgatattagtttgtggattaaggggcaggcagttaagtgcagcccaagtacaaaatgttcaacatgaaactgacagaggctttttggaataaaaattccaccttctttctttagtctcttgggtctgttattttgaattcttgaatatccttaatagtgattaagttgtcttcaagtttccaggttggtgggcctgggctccttttgatcatgggcctcttcattcccacagttaaggacctgaacccaatagagggattagaaagccaaagaagaattttgatccctaggtaatcttcatgtaggtttctctatgtgttggtatgaaagggagggtgaaattttataggaaataaagagggctattccattatatggtgactttaggaaatagtcgtccaactctttcttatccatgaaactcttcatccaactcttctcttatctcactgacttttttttttttttttttttttttttttgtgatggagtctctctctcttgcccaggctggagtgcagtggcacaatctcggctcactataacctctgcctcccaggttcaagcaattatcctgcctcagcctcctgagcagcggggactacaggtgcctgccaccatgcctggctaaatttttgtatttttagtagagacggggtttcaccatgttagccaggatgatcatgatttcctgacctcgtgatccgcccaccttggcctcccaaagtgctgggattacaggcatgagccaccgcgcccggcctatctcactgtcttctaaagcagtggttctccaagtgaccagcagcattagcattacctaggaatatgttagaaatgcagattcttaggcctcactttcccctactgaataagaaactttgaggtggaacacagcaatttgtatttgaacaagcacttcaggtaattctgatgcatactaaaatttgagaaccactgatctaaagagatattgaattccactgagaaaatattttgacaattaaaaattctaccagaaactacaagtgatttttggaatccagaaccctctgttgttctacttcaaatttatctttatggcttcatcctaaactgttttttttaacagtcgttaaacactttttaactttgacctgcgattcatatcaaaacaccccaccctgtctaaaatgatctttgttcctctgtctagccaaatcctctctctcctgcattatccattcaaatgtctcttcctcacaaaacccttaccagtcatgccagcattctctcagttttggctccctgtaactctcagtgcctgtaccattcaccttttaccggttacatagtcttatctgtgatatatcttgtgttactaaaataaactgtcaactattataataaataataggttacatttattcagtacccactgtggtcaccacaaccccctcagtgagttactgtgcctgacttttgcagatcttcggtagcttaccctgcctcacacagtatgtactaaaaagattctccttcagccttacacttggccactagcctatattgttgtataatgctgaaaaacttttctcatgttgatgccttattttctccccagctcaattttatgttcaactgcaattagagaccataattctcctgttatttgttacacaataacttttagaatatagagagttaatgcacatttgttggtatattgtattagaaactctaaacacatttctgggatttcgctgattgggaatgaaaatgtttaaatttctccttagatccagaacagtctccatgtgtaagttgagtatattcattttagcgaagtaatcaattgcatttaaaatattcaactcacaattatatattgactttcattatcaatttcgattaatgcgttttgaaaatactttattctacaatgcatttagaggaggaaatagctgcttttgtttattcaaggaatttaccaattttatgaaacctgtttattattttgtaagaagaaaatggatgagtcgatagcaaatctgacccttgtctgtatacttacatgtacccagtagtgatgaaaagagatgaagataatgttagtggctaaatgataattgttgagaaggcatatttaattgaagagaaatagattttttaactctgtgtgcataaatatactctataaacattttgtatttgcacatggtttaaactcatctaactgaattctgacttaaggaatagaaagcatggtctcttccaggtcaagccacactgtagttatttgggggataaatgcttggctaatttatattcctttataactgtctttattaaagtgaagacccttgaccctgagtcagaatcacctggatggttcctagactccactcctacaaactgaatcagaatctctgggattggagcccagaaatttgcatttttaatgatcatttccaggtgatcattaaaataaaattgtattttataaaatttatttaataaaatgtattttattttatggctcaattaaatgtgaaagccattcctatttggactcactctctttttctttggcaaatcaaatcttccagaaaactgatctgtgagtcaccaaactgatagttgttaagcatagagtctcagtgacaaccttaaaagtgactattgcaatttccttcaatagacttaatttattgagttctgatacttttgtgtgccaggcattctagttaattatctaaattaattaatataaaacctaaatagctctttgagatacatattctgggccgcattttaaagaagggataattaaggcttagagaagtaaatatctaggccacccaactagtagttgaattcagtttgaccctagaacgtgtattcttaaactctgaaacagaactgaaaacagaatttgaaataaagtcttctaaattctgcctctctttctaaaaaggcagctgaatagagaaggggttaaaatagatgacagctaattccaagtttatgtccaaactctgagattctatgatgttagtcaactgtcatcttaaattatatggttggtagctatagtgttaccatgtgatgagctcaatcagtaaaccatcaccttcaatgttatcagagagaacaatggaagccccatcaacagttacctgtctgtttttacagtcttccttttcctctacttcccttaagaaacccaagtatatctttgggaggccgagcggtggctcacacctgtaatcccagcactttgggaggccgaggtgggcggatcatgaggtcaggagatcgagaccatcctggctaacacggtgaaaccccgtctctactaaaaatacaaaaaaaaaaattagccgggctcggtggtgggcgcctgtagtcccagctactcgggaggctgaggaaggagaatggcgtgaacccgggaggcggagcttgtagtgagccaagatagcgccactgcagtcctgcctgggcaaaagagtgagactccgtctaagaaaaaaaaaagaaaagaaggaaagaaacccaagtatatctttttctatgcaaaggctactggaataagctttttattattttattgagagatctctcacaataatgtgaggctaatttctctgaacaatggcttgttttaataaatattttgcaaatacagctaatacactgtgtggctgactctggtcctcaactctagctgcacattcaaatcacttatggagttcaagaatatataaaatcttgtgtctaaaacctagagattccgatctgtgagtgtggcctggagtggaggctggaggctgattttttacagagcttcacaggtccttctatggacacccaggattgagaatcagtgatccaactcatacttgttaaagaatttggtgatatcatatgcattacaagagtgattgaatgaaacaaaatctctatataagtcccagaatgagtcctttaaaataaaagtagaacctttgagcctctgaaaagctgtcgcttgggccatccaaatattcatattgagtctcagataatgaaaagtcacaaaattagaagccattagagcatggtgttaagtggaattatggaaaaccatttgtaaaatgctgtggggtttggaaggacctgatttttttcacagacatttttgtaatagaaaacaaggtagtggaaatggcagcatatttgaatctatttgcatttccttatcaaaaaaaaaagtaaaataaaagggaagggtataaccttgcaaatgtatcttgatctgatattatttttgcaagttagacagatttggggacaccagtcagccagattcagggctagctatcaaatcagagctcactcttcaaatcccagcattaataggaatgataaagagctacgtttcgattaatcctgccctggactttagacgaaagaaactgcagtttaattactgagtgaaattcacttcatctgatctgcctgtctttgctataatgtcataatataatcagcatcacccccacctgaaacagagctgtgaagtccaaggacctgtttgattggaagaaataaaatgatgcccagacaacaaccagccacagtgcagtaattactcaaaccttgttttcatcggtatgtcattctctcattggcttgtcatgacagcaactgagaaaaggatggaagagagtgtgattgaaaaggagtctgacctgatggaagcagactaggtgtgggagggaagagccaagctgtataaaatcttaagggtaattaaacttgtttttttctttaatatgtatcccactggctgctactgatttctcaagtccaagttaaaccattcaactgatctatctccctgcaattaaaatctcttcttcagttgaaattatagtttttactttcaaaataatttattttccttttgtaactggaatttatttggcagattttttttcttaggtcttcatgtggttttgtaagttaaacaaagagaaaggggttgcagattttcttctgtcagaggtaacagcctttgggagcattccttactaggtttgcatacacccattgcctttatataaaaccactgaatccagtaaggtagctagctttcctatgaattattaccccatattacacaaaatgtttaaagtaactttctgtatgtcatgtagttagaaagggccctgagccaggatatgaaccaatatttgtctgactctgggtcatactcttttgacttttacaccctccactcccttattctcacttattacaattaatacttctccagttgactcattcatcatgttattgttgggcatcccctatatgcgaagaactgtgctatactccagatatacattagtgaaactagaaagaagaatcattttcaaagagctttccggtttggtggttcagttgcttctgtggcttttattgtaaattgatactttaagtccaaaaagcaattggaccattaggaacaaatgtacaatgtgaagtcaagaagatcttctttatttccttctttttattcataatataacccaaaaatctcagaattgagaatcccaagaatcccacgaatttattgctcatatgtagtcagtcatcaaattatatcaaatcttgtcatatataatccaccaaaagatcccttgtacctaggaaaaacagtaagtgtgggggttaggagaacaggctctggagtcagattgcctgggtttgaatccaggcttcaccacttactaactgcataaccttgaaaaagttgcttaatccttatctgtaaaatggaaacaataaagttacttacctcttagggttagcatggagattaatgggttaatctacataaagcacatagttcggtgcctggcacagagtagaactttagtaaatattgttattttttcctccacaatgtctctagaacatgttatttcctgtacatttctgctgacactaccgaagtcagatatttatcacatagtacctgggttgttgcagtggatcacttctcattctcttgctctcacaagctcgcactctctctctttctctctcattacctttatgctctccctgtttcagttttttctgtccaccattcccaattatttatactagaatatcactgtgaccatgccagtgtcctactttacaagcctttaatagacctcttgtgttcacagaataaagtggactactcagcccattattcaaggaccccgtttcgcattccacactcaacccatctttccagcattgtttcctattacaattccaactaacttgtttatttgctgctcccaaatacatatctcaattttctgcttccatgctttctctcatgcccttcacacaacttgaaatgtcttatcacctcccaaatcttacatgtttttcaaagtataactagatttgttcatcatactgaagctttcctttgtcagcctacatatcagtgatgattttctctctaaacccctattctgaatatctgaattttattgcataataattccttctgggcattatcccaacaaatagatattaaatatgtcaggcacaggtcagtgtctccatacacatcattatttacccaatagcatctatcaaagaaaatcaaacatagatatacaattagtatatgccaaatgaatacatggtctgaattggaagtttctttccttgttctaaacactttttttccaaaaaagttactccaaatttagccctttatttctactgattttctaaacttccttttgaattattttgatgtctccctccttaatcctctccaaaaatcactcttataatgcctttacatttccacagtcatcatgctgctttcttacttggcatgtggatatggataaccaggctactaatggattctatttcctctgttcaggtttattctgcaccagttacgtcaatggtagagtaatacttgcatgtctatagaacagaaattatagaacccaccctttttactttttgtggttgtcaggaaagcaaaagatattttatgcaaaaatattttataaactgcaaaaagctttacaagtacgaggtgtcatctatatttagataatatatttagatatatatttaaataatatatttagataatagagactacaccttgtacttgtacttttccaataagcatgtattcatgtactagatgtataagaaaaatatcaaaagtaatatatgataagctatatcatatttcttgaatataaacaatatatacatattatacacaatatatacatatatacattatatatattatatatgtaagaattatttctcctacatttctatatcttcccttttttcattcaatcctacacctctcttgagaaacttgcattatttggcctcattatttctttagatctgccgggcaaatgggagtcttccttgaaagctactcactgggaggatttttttaatgacttccttaaaaatcagcaagcaggactgatctgatatttgacatactgacaggaagaatcttaacagtttctaaccttcctaaaacagcattaaaatacatcagctttaccctgtacctcagatatcaagattgtgcgaattctctggccatgtggattttcttgacattttttagtcaaaatcctaaccagagaacaatatttgtagttcagcaattccggtacagaaaagccttctgacttagtctactgctggttccaactttttcttacgtgatatggttctgttaatcagggagagaattgatggacagttagataaaggcttagaacttgcaatcggtgcccctaataacccaatactggagggagacacttcagttttgttttattgttaggaaacagaaacaggacaggcagagcagccttcatcccattatttctagtggaagagggaccccagaatgttcctcatgatattcagtggcaggcaggcagtccgctccagctagctttgtgttggatcttttagctatgtccatatcattgaggttcaaacctttattgcacctgaattcctgtggccattatcaatggattcatatctccatgaattttcttttccttaaggtctcacctcattgttttatgttttgatattatgataagcagcaggtgtcctccaggctcccttcttgcttctatttcccccccctgcacaaccccctggacttcctacacattatccagctaccaaaatgctcactttcctggctgtgttcctcctaaagcagctaatctttacttcttcttcctggccttttggctccttctgcttgtgtggagttttgagttaaatttttcgagttaatatttaacctgtgagataactgtttacaaaattgttagttgataatcagggatttttttcctggattaatatggttaaagtttaacttagtggaacagctcacacacatacaaaataataaatacatatgtgtataattaaagtattaactctgggaattttgctactatgttctcatgacccaaaatggagtatttgttatagtctagataaaagaaaaaccttggttaagagtctggcaagctgactctgtggaagaatttaagcggaaaagggagccagagtctactcctaagtggcaagtggcaggcaagtgatagaaacgttccttttttttcttaagaaaatgatctttattcatgttatttttattatcacattcaaaagaagttattgggattctctccaaaagtgggtttggatatattttggctttgattatccttgtaatatcttgcgatattttctcgtgtcagtgacctttttatatgtcacagcgcgtggttgtatcttagagccagatgtgaggaaagcaatccctgtgttcaggtacttccctccactcatgtttgtaagtcaggaatgactgttttttctcttgagatgaaagtgaactttaactccatctgacatcagaagatggagtactggtagacttagaatatatcttgtattcttaaaggaagtcttcatgcttttgctgtgggtagggggaacaacctaacacagaaaacatattcaggttactttagttcacttggaaatggttttcgtatttacttcttgccatgtagacctcaaagaacaagtgtttgaagaaactgggtggagcaattaagtggatctaggtaaatgatcacttatgaattttcaaaagtagttcataaattttgccatgaggtatgtggaataaaaaagcttcaagccaaaccaagaataagattttctactcttttttgtatatcaaagtcataaaatcagaccatcaaaacatctgacagtccactgtttttccaaatatactgtgtttatcccaattcagaaataagaatgaattgctagtaacagatttcaaatttgatgaggcttaaataggcttaagtgccctgtaagatagtagagaaagttgaaaagaggggtatcccaaaagatattacagtttcgaggaggaaaagaagcggttatccgtgttaaattgttgcaagaagttgagtcagatgaaaattaaaatgtgaccattgcatttggcaacagtagatatggtagagtggaacggataaaagcctgattggaatagattaagaaaagaatagaaagtgaagatacggtaataactaatacggacaatttttctaatacattttgttatgaaaggaagaatcaaaatggggggtgaactggagggagtcttgggatcaaaagaatagcatataaatatacacaaacatggtaggttttgtttctgtttttgttttcttatgtggcattttgtttatctgcctccccagtggaaaagcaacatggacaagaatcaaagcctcaaatctctagtagaaagagacatggaaaaggtaaaatccatctggtaaaatgtaaaagggactggctcagattcaacagatcttggtctacttaaagttctactagctactggtaatgtgaacctcaataacctttctgtggctatcagtttgcttatttattgataacgtctaaagttcctttatggtattctgtatctatgaaaaaggaaaaaagcagacacatttcataaacctctctctagtagaaattagtttatatcattcacaattttattatttagaaaacacacacatcttgttagttagccctcacaagaatgctatgaggtaggtggttagattgttttgttttaatggaaaaggaaaccaaggctctgcaagggtaagtaactggcaaaaccacacagtgtgcaggcagcagaggcagaggtcaacttcaagttttcagaatctaagtagaatattcttcctaccatgttctgctctacatacacctcccctgtagccttttgttttgttttgttttgttttgtttattctcctggatcttcaatgaataccccccactttttttcatttctgggccaggtttccattattttcccttctgtgcattccactttcctcagaactttcaggtatggccacccctataaatattttcatttcttcataatacagaaccaagtgcataagggttgaaaatctatattaagttcataggaaaaacaatcccacgccaaaacattttgccagactagtaaaattgcatttcaaacaacccatgaaaaatcaacgctgtaaccacaatggccagtgttagcagtggaaaccttctcataatatcttgtcatttggacttacaagcttttaaaaccagagaatgaaaagggaagagcaaaaaggtaggaggcaaatatggcaaaggggaagtgggagaagagatggcacaggaggggtacaagtgttgcttagtgtagaccctgcagaccaaaaattattgtgtttctaacactattgatttttttcagcagctgatatttcaatctgggtgcagtgtgtctgtgagtctacgcacactgtcaagaagaaatatgatagtgtcttaaaagattaataatatcgctggtcctctggaggcctgtcttaattcactggcctgttccctggcatgtactgtaatttatctagtctgatttgaatagcaaatggcaatcggctgccattagggaaatgggcatcattcttattgatccagcatgggctggattttatttaaggagaactgcaaaatgttattaccttcaggaggagaaactgaaaacagagcttttcccgtgtgtatttcggaaatgttctaccttaaaaaggggggaatggattgtggatttaggagaacggagagagattatcatcctgttgtgtgaaaagggacatgtacaggctgtttacagcataattgtttatcagcaggaaagaatgctcatgattataagaggccacgggcctcagaggttagaacattggaaagatagtctgacctgttccagtccaactttgtgtaaagcctctagttgctcagaatccatttgtcagtctgtaaaatgggctaaaagaatctgttagcaatgtgtaagctttgtttagcatttgtttcacatcctgggagtcttggataaaggatgttatagaattaaaaacacacacacacaaagatcttatttaatactgtgcatgttgtggggtagtgtccagtatttattattgctcttcattcagcattctggaagggacaagttatgtgctgagtgaagcaagacgaagtaacctcataattctcattaaccattactatatctctcaggtcaacgttgcatatattgactttaacgttcacctgttggggacaggtctaagcctacacttttaccttgttttactgaataaaggaaagctgtcagtgttattgtagcaaatgtgggagacagacttgggtcttactgcctaccccacactctctttgctgcaagaataggagctgaatgtaccatttctctgagcttgatgcacatttcctgtgaaggagcgtgcacataccttatccctaaccttccttaaaagcctcccggaggggaaaaaggtatgacaaaggtggctagaggaaggggctcattgctaccgaaattcttcttcattccacctcgggttgttagggaaagaaacgataatgtgctacaggaaatggccaagtataaaagcaataaaataaattgaaaatgactttgtttttttgagcggcagtaattgctatatgttgtgatgtttgcataaggaattagttaatgtgtagcagaatggcatgtgatactttttatttgcttgatgactatagtctctgagtgaatgacttattaaggttaataaagaaaaatttgcttgtgacttgtaatgatccaattgctagaatttagcatccccttatgcattgttgcctaaaggggagaaggaaaaaaacctacacacattaatggccgactggctatgattttttatagtggtgtgagaacaaaacaatgtcttctaaattgttggtctgtctatctttctgcctgcctgggcaggaacgttatggctttcttaattctcctgtgtgatttatcatcctaaattcattgttttgcataactctgctcaaaatgaagaaatgtcattattttgcagcgaaaaagttgtcatttgcataatgcctgccattaattattgtgagactaatgcagttgttgatatttttagggcacagtggtacagcctgcaccttgtataatgtcattctgaaaacattggtagttaataggtgccacaacattgcacacatggaaaagaagatgatgaagaagaaggggacacaatggaacaggctgtgatctttatttagcttttttttttttttcctgaaatgcttggtgagagaagactataaaaggaagcgaatagagcaggaagctgtgacatccaagagaacaaagggattgaaaagcagaggttttctatttaggctcaattagtgtaacctgggcttcagccagtttaatggaggaagtcatgtctcctgtgttttggcttacctacgtaaccaaagccttgagcagaatgtagagttgggcttttaaaaccatcagttagaataaggttttgccctgaagcatgttcatctcatggaagaattctcttagctgggcacttggccaaagttaagaggacacaccatggtttcatggaagaaaaagctgaagactatgattttcagattttgattaatcacttgtctgtacttcacttatttcagtatttctgtctaggatgatagctttcctttcctgcaaaaagcagacggatatagtagtagtatattagagtgacatttttttcctctgtattgtttgcagtaggtctaacttttgcatctgattctttagggaaagcacctaccaaggcttcctattacctatttcacaggtaagtgaaagtcagttataaaaattcgatcagagatgaaactcattacactgagcctgggaggcataaatattacaaatgtaggtaactgttgatctttttagtcatgggagcttaaaaaaatggacacatcaaatagaattttttctcctaatttcactgtttcgtgtatattataaatttagatatttcttttttatcattaaatttaaaagacataaaagaaatggagcctcaaaagtaggtctagttactgagactgaccagagatacttagaaagaagatattacccttcaatgttcaaagcctggcattgtaatctctttggaaaatgcagtgtttttcagactctaatccagattccaatggctattctgtgcccaaagaccaattactattttggagttctcttaaagccagatgatgctttgagggggccatcaggaccttaaggagaccacaggggactgtctcagtttgtcttataataaatatctcggcagaattagggctgggatagttctgtagatcttgccttacttttggagtttaatctttatgtgttcagttttgggatatgtaaaaagccggcattttcagctaggaaaattttaatttctgtgttaggaaattttaattctacggggaattaccacacttggagttgtaaaaaacagatgagctcatgcgtcaattgagacccatctgcattgctgctactcacttttccttttcttctgaagaaaatgaaattgtcctaacaccccaaattaatgtatttgactataataaaatcaatataagcatacgatataaaaacataagaagtccaacatcgaggggaaatgaagagaaaatgaaacaagggatttgcacttcatatggtatactagtacagactgattaattcttaatcatcttataacctagtaatgcctagttatctatcatatattctacatgtacctatagatcctacatatagatacatcggaatagctgataaccagcttagcaggttataccattattagggtgaccaacttgtcctgactagcctggagctttctctgtttgaacacggaaaagctcacatccctcctcagtcttggacaaaccaaggcaattagtactataaccatgatggatacttgtaaggcatactgatttaatagttacattatatattttgtcacctcttctattgcttattatatttgaaaaggctttgatttcgtgaacaaactgctatatccttttatgtagtgaacaaattgagccctttagtgaacaaactgaactctttttttttttttttttcgagatggagtttcactcttgttgctcaggctggagtgcaatggcacgatctcggctcaccacaacctccgcctcccgggttcaagggattctcctgcctcagcttcccgagtagctgggattacaggcatgcgccaccacacccggctaattttttttaatttttagtagagatgaggtttctctgtgttggtcagactggtctcaaactcccgacctcaggtgatcagcccgcctcagcctcccaaagtgctgggattacaggtgtgagccaccgcgcccggcctgaactcttttttataacattaattttctaaagaattttatataactgtaagagaggttgagtaaagaagtgtagattttcatgcattaagtttctagcactttgatcatgtatactgtggaaaatagcagtttcatagtaaataatcaccttcaactctgatcccctgtgttcaggaactaaatttagagctcaagtcttatacagaaacagggtagaaatccatatgttagctggcatgattttcatcacctaacatctgataatcacgtcatactggcattctttaatactcactgatcgctgccaggacttctaacttctctatcctttgctttggagtttttcttccttttacatccagcactgtactaagaacttgggatacaagatggataagacatggtccttcacgatgagtttttcagtctaatctatgaaggaaaattgcaagaatgaattttatatagcgcatcgtcaaagcttagacatagaagaatagcacttagaatgttgtttgcttcatggattagtttgttcatctgtttaataaacatttattgaagctctactctctgctcagcaatgttcttgacattgtggatacaaagatgaactatacttggaactttcacaaaataaatagtataaaagtatagctcactcctctccagattgagggttcatcaagcataagattgccatgtcagcatttgatgccagtctaacttaccaggaccagttgggctgggaaaacgtctcctttataaactcagagatactatttttagttaactatctaatttgacttactcctcccaagaagtttattataagacatgtgagctattgcatgtaggtggtttcccagactggcctgtgcagtcagatggaaagaatagaggcctctgggacaatccagagaagccgctgcaccatgcagaataaagatttcctatttaaagtttatgtgactgggatgagatttataagtactggaacactttattcatctacttattcattcagtcatttaatagctatcaagtacctataatgtttcagacattgttctaattactgggaatatagtgagaaattaaacaaagtttcctatgaaacttattttatagtggaaggagagacagccaataattatgtaaacaaaaaaaaatcattttaaataatgatcagatctaggaagaaaataatgcataataaggaggtagaaaatagggatatataatttagaaagtgctatttgaaatagggtaagtaggaaaggtctcaccgagtggaagatatttgagcaaatatttaaattattagaagaacctaagcatgtggtgaccagcaggaagaacattttagggaaaggggatggatattgtaaagactttggagtaggaacaacttgaaattttccaggaagagcaagaagaaatgtgtggctcaagtggaccaaagtaagaatgatcatgtagataagtagggaccagctcacacaggccatgataaagactgacagaaagctatagaggatttttttaagcatgtatgatctcatttacatattaaaagagttccagggctacactgtggagaacagtctacagggtcagggtgatacaggaagagcatgtagtagttatcatagtagcccagttatgcaaagggcaatggcagtggggaggggatgaaaagtggttcaactctgcataacttgaaggtagggctgacaaaagttgctgagggtctcaatgtggttttacatgagagagacatcaggtgtgatgaatttcaggcatttcaccccagccactggataaatggcaatatcccatggagttgggagctataggggatatggagaaatgagcagatttgggaaagagatgattatgagttagtattggagaatgttgaatttgaaattcttttccaaataaagagatgtagtaggcagttggatacatgagacaggagttcagaggaaggattaggactggagattcaaactctgtttttatttctgcatatgtattttctttacagcataagcctacagggtacgaagaatgaactctgagaatgtttggaggtaaatatacatgtcccatattatatgatgatgaacatgcaagtactggtctcaattcagtctgctattttttaaaattccctgatatacattgcaaagaggtaccaacaaaaccatgtgaacactttctaagggcacatatggtttatgatcatattgagttgtaagacaaacaaattattgtttcatattgatgtaagagtagaaataggggaagacacagattctgtagtttaatgtgtaggaaaaatcaatgtgaattcataggaaggtgaaactctaacccattgttggaattagtgaagatttaaacaggtagtaaggagcagtcagggcattcaagatataaagtcataagtagattgtacaaagacataaactagctttctctttatgacggagcaaggatggagaacaaggacaccggtctagcatcagcagagtgtatatgtttgtgaagttaagggagatgaatttataaaagttggctagagctaagggatttgaacttccccagtagcccattggttctcacctctagtataattcagaatcacatttggagctttcaatgaagatgcctggatattacttctggaagtcctgattataggttatggaaaggccctagcacttgtattttcaacaggcagcctattccagaacatttgcccctcctaaagctgtggttatttactagaattaatagtcctgtgtgagtagcatgtactggattgataggtagagttgtctctccctgcaccaggtgctcatggatctttactccagttcattcttaagtgtcatggctcggattttctccacatctctgcctaaattttcagcctttctctgttttataacttggaactaccttggccttttaaggcttccttcattttctttctatttgtggtctcttgcacaattacctatggtcaattgtgggtgtaggggtgagtaagaaccatgagaggggtggtgtctcttacaaagaactgtgagaatgagaagaactatgaaactgttctgctgcaggcctaaataatataactaattaatactatggaggctgaattgaaagcaaaatataggacttaaagagaaattggtattttttctaagcaggaacctaagattaaaaccacagatttaataagattttttatttgtttaattggtagggtatcttttataactacatagtcccaaatacttaagattttagaatgcaacacatacatctataaaaacaggagaaggaagacttctagagacaaaagagtgcctacagagggtcacttttaggcctttagagaaggaaggttggtatagatgaatattttaagtaatattttactatgaaataaatgtgcttttattatggaaaagttcaaataaacaaaaattatttataatttctctacccagaaacaagcacttctagtgttttctggtctttttgcactttgtgtgtacacaactatcacttcttaaacaatatttaagttaacaatatttaacttagcaatatttacttaaacaatatattttcctgtacatatattgttggttatatgccttttcacttaacagtattccaaaaacatttcttcatgtaattaagtggtatctaaaatatgatttcttaaactgcatagtatttaagtctaggaatgtactgtcatttatttaatcaactctctattgtcagacaaggttaccagtctttcacaattataaataatgccatggtaaacattcttgcttctaaatctttgtgtagatctttgagtaattcctttagatacattcctagaggtgagatttctgggtcaacagtcttcatatattttttaaatttttgatgcatattgctaagatgccctccagagcattttgccagttttattttttcggtggtaacatcttaaagttttcttccaaaagtgatttgattcaaagccatgctgttgcttttctctgagtcctttctggtccaccagttatagcagacttaatttaactcttaccttaaggttaacacttagagtaaccaaaacatttttgtagtcatttatgctgcaaatgagacagtttacagaatataaattgacagtgagattagattgcgtttctttcttatgcatgttctgtacaagcattctgcttatcctggataacaaacaaataacaaaaagaaagaaaaaaccttacctctcttgcttgtcctaactgaacactcacaatgcattaggcattgaactgaacgtggaggagatatgattcctgctttctgagactttgcaattccaagtaccatgattgataaggtacaatataaatagtgggcttctaggacaatgccctgtggttaaaagtaattaagttatatggtgccagcagactacaggatacttgtgatccacatatgcaggtggattgtgtgcatcagtcatgatatctgtggaatctgagagacgggaaaggcatacctgttttaactccagaataatatagagaactcaaattcctgcccaggcaaatagggataagttgtagactgcaaatagaagatggattgtggggaggaaaaaaaaatctactagttcccgcttcttccactgtgtcccctccaggggacactcataggtcagggtccttcatgtggtagctttgagttcccgacattttcaaaactgttctagggaaagggtcgggcatgtatatgaagactattttcttgtgagcacaatgggagaatatttgaaactgggactcttgtgaaaaatcagaaaggttgccagtgtacctgggccttcctattgtcttgaagtactgtggtggactttgtcatgcttaaaggaggtgtgattgggggtagggaattgcttgactgagaattaaagagtgagagctcctgtccagttgcttaaactgaaaaggatttctgacacatatttggttagcaaaaatgactgtgagttagtgggacaattgtagcactgatgtaaaaattccaaatagtccttccgaatagatatacacacatttagaaaatgcattataaatgacatatagcaaaaatgtaaacaagccatttaataacattttaatgcttgattctgatctcttaattaaaatgtgcataaaagaaaacaatggtggaacatctgtgtgtgttattgggatagcaggatttatgctgcaccctgggctttttgttcgcttttcagtgtgtgtgaatgtgggtgggtttcctctttgagccacagttacccatttgacccccacagggtctatattcccacccaccttctcttggctgtagttgcaccccctttttttcccctcttacttaaaatactgtatggtttgttctttgcttaaattaaactactctcgtcatttgatctgaaagccactcttcaccccacccctctaacctgaaaccgtgacctaaccctgactcacccttgttatctcagcagatgtacacagcattacctaatgttttggcctcagtgaataatctcaaagagctttggggaaagtgtggccttttgtatctgtgaccttgcagcagttattccttagctggacactgtgggatttagatgttaaaaacagactttctactaacccctgctggtgatttctttattattattactgatttggaggatgtatctctgaaccccattttgcccaactgttaaatgagagtgccagcaatcacaaaaagtcaagggttattaagtgctttaaaatcgtccactgaaaatgttacactgtgatatgcttttatttccacttttacatggaacacatgtgatcaccaaaaagtttgtctttgattaaaaaagcataaaaagtacctcacatcttctgttactcccagcagatttatgtatcattaatacaagagaaagtcacacacaaatagacttcttaaatatacaataattaatatttaatgcccccttttatgagggggtctttgtgctgggatgtctctaatcttcacaacgttcctgcaaaataggtggttttattctttattccacaggtgatgaaaatgaggtttcagaatcatttaagtgatgtgcctacagctttattgttaataaatggaaaacctgggattcaaactcaagtctgtctctctctctctctctctttctctacatcatattcttcctataatatcatgacctatatgggagtatggtagctcccatttcctatagaccgtggctagatggtgttatgaaagagttaagtaaaatgtgccatttgtgacaaatgtctgaaagttgtttttataactaggatttaattcacaaatgaagagtaattatcaatatggcacagatgaagagctgcatgtatggatcagtataatttctgttctttggcttatggatgcagtatgccccagggagtttcacaaatccacatgacatctcccagtgctgggttctgggttagctggccaaagtgtaaaattcctccgtgttcggatggctcacaactggttactatctgaagagatttgtataaaactacctaccatacgtagacttagtttcttttctgaatttgtctctaacacttgagtggggaaaaaaataccaaattttgatactgggtttgttgtttttaatgggtgtttgtttttggaagtgttgtgccaagagaggaagaagaagtgggtgtgggtctttcttccttttgctattttccctttgccttcttgtggtcttatttccaatctgattctatattatcagtttgccataatcctttgcaaaagacataaaatgttcatagactggaagttattaaggctttaaatcacatcacactatcattggagtaattttgggggggaattttgcatatttcagttctctagtatagggcatgtgctgcatactagggatgtaacttatacctgctctacttccctttattttttttcctcaggctgagagaacctttaaacttgttatgtgttctgaaacagatcaaatattagatttctaagactatcaggctgtggtggtgagggaagggttagtattatatacaaatatgtattagggaaggcatcatagttaagtgagaaaaacatgggtcttgagtattatgggagctcagcccttttccttactagctgtgtagctttgagtgagttatttaattcactaaactaagattttgaataataatacctactatatagagatattttacagattaaatggtatagtacatatagaatatttagaacagtgcctgaccctgagtgaatgttgtttgtttacatttcacacagcaagaaaagggaaaaatgggaaagagtggcaattagaaaataatgatattgggtttgaaaaaattgttttcatcctttcaattcagcatagtagtagaaagagcatttgtctagcaggcagagacttgggtaaaacttccagctctgcctccagaaagctgtaaaatctttgctgttcaccttagtatctcagactcctcattgcgaaaatgagagagttagaattcattatcttgatttagtcatatacttttgccttcagaagatttttctgcttctcagagtagtctatgacatatcattcaacagtgtataagtctcaaaggccaacagccaagtatggcagacagggctgttgttaagatattctttttcctgtgtaactatgtttacatgttcatttatgttctttgtatatttgtcatgtgcctgaatatttatgcacctgcatggttgttgaagtaagctcactagcatacattcatacatttttgtgggtatgtgtgtttatatataacctatatatatatatacagtatgtgtgtatatatataaatatatgtctgtgtgtatgagaaacagatgcactgtaggcagataaagcagataaatatagatccaaatagaagcataagcatataaatatagacgttatatagagtgaaagcaagcagatcagcaccatttcattattgcttgaagtctttgtaataaaagagttagaaatcagtaactgacattgaaattattgactgaatgacactgtcatatcagaaggctcagtgtgaggtaagaaaataacctttctttcaactttgaggagaaattagcaggaagatttattactgttaattatttgatttaggaaagtttttaggtgctgtgtagtgttgtgtttttaaaagtacagaaatgtcaccactcctaaaaatactgccatacaacaaaaaataaataagaaaagaatatctattccagtcttgcaaaaagatttggcaaatgtgacacctggatccctttcgtccacaggctgtgatttgcaactcttgcctatttctacatatagacaaatgagttggtttcgttctacagtattttctacaagcccctctgaagtctttaaggaaactcacctaaaggagatatctcaggctaaagtgaccattgttaagttattgtcatggggacacttgcaattgtctttagtgagtgtgttgtgtgagtaaaactgggcttccatctgttactttcatatcactgtctgtttttaccagtcaaaataattggttgtgagtttttgctttattttattttgttttagtgagaagggtattgtgagttatttttagctagctaatttactttttaatgttgcaagttatatcttgctcatgtgtttgaatgctatttgaataaaaaaaaagtagtccctccattttccctctctaaacctcatctatttccctagcagatcttatctccccttcagcttgttgtaggaacattcaaagaagctaaaatttgaagaaattccttgaaatgtacaaatacaaagcctgctttttcccagtaccacaaaactgccaaagttgttgcaattgctttttctgtcattagtctaccattgcttttccttacagggatgagagaagagggaccagaatacgtgttcctcctaacttctgctccaaatcagagtttagactagaggaaaaaaaggagggaagggcgaagcaataaagacttattgaatgttaaggaatgaattggtgcttcctgaagaactgttcattcttcttctctcaaatctggcttcagttactttgttgttaagttcttcaccaaattatgattttaaaatatttttaaagaatgactcagtggtcttgaggatcacacacacactctctctaacacacacacacacacacaaatttgtgtaagattcatttaaaaaattgcattgtttgaataaaatggagtatacttttcaatttataaattattttgaacgaatacttaatgtaatgtgtaaagttggcatactctacagtgtttcagactacagattcttttttaaattctgttatttacctgatgagctctaaggttaacttgaacaagtatttatttattcaagagtattatagtatatctacataaaacgattcagcaaagattttagaaaaataatcacttgccaaaataacatagtaaaagtcctttatctttacatacacacacacacacacacacacacaatttagactaaagcactatgtcccatttagcttaaaaaatgttttaggattagatttctgagggaagtatgtacatacacatactcctcttttcttgttctttgtttccttttctcctggtgtaacatatttactgtttagcttttgtcaaatactttataataattaccagaaattttgacaaagacaaaaaaattcatctgtgtatgtgtatatttataggtttatatgcacatagacacacacacacaaacacacacatccagattgaaatgttaatgttgtattaatcatctgatttttgggggtggagggtttgagacagggtctcgttctctcgctcagactggagtgcagtagcacgatcatggctcactgcagcctcggtctcctgggctcaatcaatcctcagcctcagcctcagcctccagagtagctgggactataggcacgtgccaccatgcctgctaatttttttttcactgtgttttgtagagatggggttccaccatgttgtctaggctggtctcaaactcctgggctcaagccatgcacccacctcagcctcccaaagcgactcccatggtgacgatagtcaccatgcctagccaatcatctgatttttttttatgcattatgttttaaaactttctcctaatataaatcttcaaaggaatttttgtaaacattcaaatgtctggtctcatttaaaggtttctaggagattgtgcattttcttatctaagacaaaacattttccaaatatgcatttggatatttgcatatgaataaacagggatttatcagagccaagagcaaagcaagaatctctttttaggagtcatttaccctttctacctcctacttggagcatgaggtagctctcatcattggcatggagacttttttttttcagttagatggtttcatattctgttcctggtgttgcattgcattgcagtacatatgggcctgggagtcaaacagatcttgattcaaacctcacttcgcaactttttaaattagctctgtttccttacgcaggttagctaacagctctttaactatgttgctaatctataaaacatgggccacagctacttcactgcaggtttgtattaaatgaaataatattaatggaatatatgtcatgtagtatgtactcagtaaataccagtttcctctggcctgttaattttaatatatagctatgatttcctccccaatccctctacatcatggtggcacatagcattacactataggtatcagatattgtagacaatgctaaagaaataggagcaagaaattttagaaattattgattatctaatactgaccctgggaatgagcttatgaggaaagaaatctaaggaaaccatcagaaattcctgtctcctataattgtaatgtttcctacaataatgagttaacaaacagaagtgggagatttttcaacacggtgttgctgaaagcctattcacatcaatacagtggaatggagtgatgtacattaaaccttatgaaataataggaaatccttttattgcccattcatatgccaggttaatgtgcttcattccacagtggatgttgctcaccttggctcactctagattaagctcattgattaactaccctttgtaggggaagggtcagaatacaactctcattgaaattattaaatagttgctatgtgttttcttttttaagaaataggaggggagaaacacctcccactctaagatacttggggctgcatttcagcctacagctgatcattttaactgaattacaaaccccataagcataaggtttataatggaaacaatgacccaatcttaattacaatgattttggcagcaatgtccctgctatccagagactactttctcatgtcagaggactcttttaacctcctcagagttctttttctgtgtaactacaattttagtgtgcaggtctttctgactttttttggaattgagagagtttgaccacattaagccaaggagatttctctgaatctcctcctgctgtgccgtaatcagtctcaaatatcaataatgtagaatggaaagaaagaaaagggaaacgaaaggtgtcctgatgtagtggaaaatgagtggtctggagatcatgagcctttgctctctgtctttgatgagatactttgaaatgctagcccccaagttttcatattgataatatggaggtctagacagctgtaactttctatagggaagcctatagctgtagtttactctgtttgtcaatatcttattgcagttttgttttaaatataaaccaaaggcctatttattataataatactaaatttacactttttcttcctttgtagtttctgaggatatcacattaacaaggaaattatttctgtgaggaacaagaataaataaaagtttgataaaaagatgaaaagagagagagaaggaagaatatgaagtcaggaagggccatatatgaactagacacagagtacaagtgagaggacaggaggcaaagactctaaagagtcaaaaattaagacaaggaaaaggagaagcaacaatttgaacagtaggctcacatttaagataaaaaaaagtataagatagctttgaggtgaacattttacataatgtaagaattccttgtcttataaaagaatcctttgaaatcttcccctatggcatttaaaataagattgaatttatacaactttgatttagtctgtgctgtgaaaaaaatgaactgtgagctttagatactagtcccagctctgcctcaaaatatatgcttttgagaaaattaattctgagtctcagaatcttcatatataaaatgaagaagaacaggtaagttctcatccacttttaagaatcatgaaatgaatgatcttgttgacatattgccagaatgcttattgaaggaagttgctgaatccgattacattaaatagatgaccaagagagagaaataaaaaactttttgaaggttttgactaatatctacatgctcagtcctacagaattaacaagatggtagccccattttttaaaagaatatggctactattgctaaacatgctttaagttgaatcttcgctggaatttttgagaaattgtagttgcaattctttttctaaaggtcttattctccaattaactgaaagatggcatttctgactttctaaaccagaattttttttttccaaaaaaaaactgtttaaccaagaaaatggaaatcagtacattcttggtgtccttctagtaatttaaatttgtgtaacctaatcaaaactccacctgccttgcccttcaacaaaaagccatattctcttccattactaaatggctacatttgtctcagtattttttaaaagatgaattacgttgatatcccatgactttttctttagaatgtgtccatggaaattaaaatagacttttctgtgcccaagactgaaatgaaagacagcccaaaagggctggtggaaatgaacacaaaactttgctgatgttatcagtattataatttttgttaagctttttcctaataaaatggaactgaagtcaactgacccctaaataactgcctgatatttctcttacagtattattttgtgtgcagattaatgatagagcaatatagcctaagatttcttgtaaaacatcggaatatattttttcaggcctttctagtgcattctttctacagagatatttctcccatcatcatttttcagtttcaataaatatttgctgagtatagaaaatgtgccaagcaccatggcaagtgctaggtatacaactgtgtgcataccaccatgggtcattaaagcatctttgacaagtggacagagtacgcatctgtttaatattttctaagctcagatggctgaaaagagaagacaactggatgactagaaaccccaactcttgttctttcctttggataacctcctgtgatttttcccagtcatcatttgcaaacacacattgagggagaaatcaagttccctgcccagcttttcagctgattactaaagagaacttctctttctctttctcaccttagtggttgttctcagccataggagggcactcaggtacaggaaggacctgtacctagcagcagaaacaacttcaccctttctttctggtccacgctttgggaattcattatatggcatgggaagcactgagcagcattcaaagactgagaatgctacaggcattccacccaaacaaaagtaaaaggctctccatagacataagaaattatttaaatttctttatgaatattgttcctcaatttagcgttcttcctcattttgcctatttctcttttattatcctatattgggctgttttgttcagccaaacaatttgtagcatgtctgttttcaaagtaaaatagtgatatatttaaagttctaaatgtgttctttatgtatttttaaaggagatgggtaaaatagaatgtatttctctttaccctgatgacattcccgtgatatatttcaaataatatttttgattgggtaagccagtaggaccaaatccatggtgatcacagatacagattcacaaatgcatagagagaatcataaatagatgcatatggaggagtctgacagtatagtgaaattggtttcaagtaatttgacacattagaactttcaggcattcacctgccagtaatccttattagaaataggattggaatattggggtcaccagctcaagaccatttttttgtgagagctgaacaataaccaaaagtcagagctataggaataaaaatgaacctattccagtcattagaactgtttctctgaataagctctttcttcctctccttcattcctattttttcctctccctatttctccctttctctttttcctccctccctctcctgctcctttctttttagtgttctgaattcattagatggcatagtgtaaatcaatagtaaacgctaaccgcctactctgtactcagttacgcaacatcacttaaccggtacacagagacaaaaagggaaaaagcacacacagcctttacattcaaaagctcttgcataattttacttttccacagccaaaaagaaaaaaaaaaggaaataacagatggggaaacttacagttttttttcccttttctcagactgtttaaaagggagttagttaacatccatggccctttctagttgccctaggctgcagcaaaatgtcccataattgtcagcaccttaactggctttaaatgagacatcgtgacctgtatgatgggttaattttccaggtaatataaggcaacttattttgagatgttttgacttcgtttttacttattttgtgaaaaaccaacaacatttaaagtatgaaatgaattttaaaatagaaagagtataaggaagacgggtgtgtgtgtgtttgtgtgttttcacttgaaatgtatcctgatgtaatatttatgtaaaaaagccagttatataaacccatctttctcttgctttttactttgggagctatataaagctctaatgcttttttttttttctttttttctctttcttcttctttttttttttttttaacaaagtacattcaaactccaaagtcttaatgaaagagaaaacatctagatgctacaacagagacagttaattcagacttcctatagaattcatcatctaaacaacagttttatttaagaaggaatagtttctgtaattctcatttagagctttctgtcacatttctccctggaacacctttggtttcactgtactgccttcttaatgtctcaaatgtacaataaatctctctctttctctctctctttttctctcgctctttctgtagcccttcgctccttcccacaaccccctcccccttttctttcattggagtaactccctttccaccttaagtgggagcacagtgagatttgtatgcaatttataagtccttcatccctgttgtaatatttggttttgcttaactgactggtgtcctctgggaaccaggcatttgtctgataagggaggttggagggattttttgttttgttttggtcttcctttttagtttctgcctctcaagcggtcataaaatggatataaagtgatagcacagccctaggcactgttaggcatctcttagaagaaattaagttcaggtgtgtgaagggtagcagcagtggtggtagttttgattgtttttaatacaaccagaaaaggtgggaggtgggtggaagagaggatggatgcgatcattagtgtgtgaggaggaactattgaagcgcttgatctccttgtatctcagatcagcatcattctttaagatcatactttacttctggatattaaagccataagaaattggttcatttaattttactaaagttatgaatttgtttaacactgtcttatgtgttaactattgcaatttagaattcctttgtatggaaaaatctggtgcacaagataaaaatcaaaactattattgcccaaatgtgaggttctctgttttaacaactgggtgatcgagattattggtattatcccatctctgtatttgtgatgacttgcggaaatcttttctgatcttaatatgaataatgactaagctagtatatatatatttaatgtattttatcaatacttttccatttagctttattttcttaacaggatctatagctcagataaatttattacagagaaataatgaaaattggtcagaatattctagtctctaactgggatatcatattcccacatgcatttttctaagggttcctctacatgtattatagttgagtttggattccaatatgcagttttgcatgtaggtgcctgattgtcaaaagaaaaaaacataaaacatttgcaccatgtaaagtgcattgtttatgatgtaattttaatatgattaacaatctgcacaaagctttttaaatgtgtagttctgtatacaagaagttattctgagtaccctaattttcaaatgggttgtttaaatttaaaaaaaaaaaacttagaacacaaaagtgagggagatttgcattttattgattgtcaaaaatagttgaaagtatctcgttataaaagaagcagaggaaaagtctttgaactttttccctgcctcttgttgtcagaatagcttccattttcatcttggtgggttttcacggtctctgaaccatactagggcaggactgacctttcaaatctcgatgtgtgccaatgtagacttctcggctctcattttctgttgtaaccaaggccttgggaacacattagctgtttctcatttttctgtttttttttatttttttaatatgggatccaggcttaagacaggtggcaggcctaagctttctgttacttggacatgcaagaaaagaagctagggagaattttaaacagtttcgaatttttcataagtctttgacaactctttcaccctagcttctcttcttattgctgttggcagtagggatagattttttcttttaatgtggcaacaagaacctcagttactgacttaccttttcaagcagaatccatccagttgtgtctggcacataatagtaccatcataaatattttccgtgtttcagtgaactcgtaagggacctgctatggccaaccctgcagactgctgatgcaggtaagcagtaagccatacaagtaataaagggtaagaagaaatctgatacagaactcttcagactgtagtagtggaccaatcacttcattttatgagaaaggcctttttatcctttctgcctttataaaagaagcaaatttcagaagacaattttacatctttcctagaggttctttttaggggtctgtgctacatagactgttggctgatttaacaaacataatttttggcaagctactttggtgatcctcattaagtttcatatgcaaatgtgttagatacttatgattctagctatcgagtatgctcctcatgcactctgccacagggtcctttgaatcttggcttttctcattttctctggacaattgtttttggacttcttttgtttatataagtcctaggatggtaactataaaaaaaattctatagggttcttcttttatacagtgtttcattacttttagctacacgaattcctgatttttctaaatccattttggcttaaagtaatcatgctggccattttcaaggctttcattgtggtagtgatattgggggtgctgagtgatctttgggaaaaccacctgtagcttctgaatgttaaaggcattgaaaagcttgtagaatgatagactgctgcctgttagatgagcagttttttaaatgcagattatataatatttaaagactttgttgctccacagtagaagctttttaaatgttaatttgggttttgttttgttgttctatgacttcgcataaaagattttgggtctaaaaggtttcagttcactcgttccatttgtcttacaagacttggaatataatattatacatttatttatacttataaaggaggataaggccaataactcacaactcatgaaaccgagggtaaataatccatagcttattctcccaccattgccacaatatttataacacaaataacaaacaactaaaaacaaagagaaaccagcttgtttttatgtacaaaatgtttgatcaaaactacagtaaagctcaaatggagctgcaaatcctagtggtttacagtggtttgatttatttttttaaacagaccatggataattaaccataaaacataaccttctcaacacaagttacagtgaattgcagaaatgggcagcaagtcattcataactggttgcaactggttagagaccttaaagttaaacatgcaggcagttacaaaagatactttcttagtgcacaattctatttccattcccaaagggaaacatcctttactttttatatactaccacttagtcagtatcccaaagtgaggaataaatgggttattttctatgattaccatgttatcatacatttattaaaataaatacctagcacttacctgtactctttttatttcagaatgtttcatcattactaacaggatattcctcatgacattgctgtctggtaagtaactctcattatctctaaatggcagtccaaaatattgaggtgcaaagaagtcaaatatctttccatgaacctcagaaaatatgagatccaaaggctgtggtgagtctttgggtctaaactttagcaatactaaattttgacagaacatattttgacattggtaaaggacagatctttaatatcctatttgttcatttgaaataccagcatttagaagaataagaaacatgatctccagaacctattatcacagattttgacaaatattttagaatactctgctaaacaagatggaagtattcaaaggatttgtttggaagaccctccagagagatatatttccaaaggagactcctgagtggacagaaagagtgatagggtgaagttggcactgatgtttcctgtgtggaacattgtatgttttgaaaaaactcaaaaccctccaaacacatttagtgatactttgaactacccattagtattctatggtattctgtaaatttgaaatgcatttgcttcatttggatcaatcttaaaattagacatggttgctcttgtacttaccaacaagcaaaaaaggaaaatacccttcaaagacataaataaggctatcctcttttaccagttaagtaagaggaccaagaccagggctacaggtaagcataggcttgaagatttttctaggtgtcttgtagtgaaaatttgtaaagtttgtaaagtttcaaaaagattggtattgtggccttctagaattcttgatatttccatgactgggagaagagtgcaggtcaagactgggggtgtatagataaagtattatccaatcagagcttgaaacagctgactttgctagaggctgacctgcattgaaatgcactggcaactgtactggagagggaggaggaggaaaagggtgacttccctggcatctaactgtgttctgcctggctccatctaggcctgtttagtcatgaacatcatattcatccaaacctttaaaagttacactcttgacttcgctttatatgaacgtgcataaactgagggaaataatctcttggggtaataaagatagttttctaacagagactttccatatccattgtgcataatccatagttgtcactgtgttgttgtttctgattctgttgcacatctatctctgtctctctgagcatatccatctcaccagtgaaggccaggagccttcgggattgtagctccgcctccctccccactcccacgctttacttgctatgctaccccaaaagaaactcgtattagtaagcctcaggagctcaagggaaaggcttatttggtgactttaatttgtcactccttttgcatttatcacaaaatgatctcatcacaaaaaggactgaatttcacgcttttgctggcttgcaaacaagccagtttcttccctattgctgtccaacacagagaaagctctttatgtttctatgatcagataaaatctgtattgacgtttcttttcctgtgggtgtatttcccttctaggtatggagatttaaactatctgggcaatgctgtgtgtttgcagtttctctgtttcagtaaatgaaaagctccttggggaaggagaacatatcttttccagtaatgaagaaatatttattttcattttaaaatgatacatgctcattaaaaataatttagaaaaacacataggagtaaaatgaagaaaaattaaagtaattatttctataatttaaatccaatcattaataaccatttgatatatttccttactctcattttccccgaggatatatttttaaaacatgatgttatcatactttctatataattttgtgtcctgctttcaaaatttaacctaagaaatatgtaattacatagaccttataaacatttaaaataaatatataatattcctgaagaggaatagctcatttaacctaaatgcccaataagagcattattattattatttatatctcaataataccttgcataaacagtaaatgaatcagtcaacaaataataaatgaataaaagttcaaatcagtatatgtttttaaattttttatgataaaaaatcttaaattcatgaatataaacaaattactataatgaactcccatgtactcatcaccagcttgcacaatgactaactgatggcctgttattttctcactatatcaccatgttatgttgaagcaaaccccagacattgtagtatttagtacatcattatttcagatccatcaggatattttttacacgttaatgttaaaaactattcagataaatagttcttattattgtatatagtagtatttttcttcatagtatcctgacatcatattttctaacatgtaacagttgattgtaaaatctcatcagtgagttgcctaatattcttagacacatctgtaagccacagggcaatttggttgcctagagaaatatttcacagatttggctaggtttcttgggggaactattttcttttggtactttttttacttgactcaaatttaggatgctaatttgcctgccagatctatacagcattaattatacttattattgggtttaagcatgtgttgaatacaatttcttacctgaggtgaaaggaaagcatagtccccttattacttagaactccagtctggctacagccaaccaataccagataaatatggcaaatctacttaaatcaaatgtaacactggctttaaaagtttataatttttaattaagattattggcagacatggaaaacatgtgatgggtatgtgaggcatttagaaatatgtaaaagggggaattatataataaaaatctgaatcatttttaaacaacatgtttggggggaaagaaattatgcattgtataacaaagggtgctctctgtgcttgtattattgctctagtttattctaaaaatatttagaaccctctatgagccagcttcccatggctagcctagatcctttacacacagagttccacagatgaggaatgctctgtacaaatcaggctgtctgtagagaacctgtatctgtagtcttgtgctgtctcactgtctttgaattgtaggtcagtgactattcagtagtgatgtgttgtccaacaggtgtattacacgcatcagaaattcaggatgtaactatgcaacatactgcatcagtataaactgaatttatgtgttactcaggtctatttaatcttaggagcacattttccattggcctcaaaagtgagtagctagaatattgatgtgcctaacccttggggaagaaaaaaaagtttccccaccacactaaatctctagaaaaatatgagggtttacagtatggacatatacaaaatattttcagccaaaactggtagagcaaagcacatggaaaaaaaagagaaagtcataacattagcaataaactatcctgagcaaacagagagcatatataaaatttgtcagattagatggtataaacaatacaaactctttttttttctttccatttctttttcccctctgaatcttctgattattttgtctcctttactctgggcctgtcatcatcattaaaatatcagaaaaggttagaactatatcggatggcttgactaaggcaggtgtcacaagaaaagaccagtaggaactagccattatactattttaaagctgcaagtcttcttcacttttttcagcatcctgttcttatatgtggtgttaaattatgtgtctcatatcacataaacctagaatataaactgccttttaaaaagatccataagtttacccacagttctttctagcttatgtattatatatttcacccaagtgaaccatcaatgcctcatcattctaatagctgtaataacaataattattattaatgatagcatttgcttcttggtgtatgtacgcgtacacctttttctcttgcttcaggtttccttatgcttggcctctttggctcttggtgctagttcagttgttgttacatttgtgacctcacgtatcctcaagctataagacatttcttagaacgaactagtacgatacaccttccacctcctttcccccagttaagctcagaattgtggttagatgattctgcttacatgaggcagggaatccttggcagatacccccaccaaccaagattttcattttagacctaaggataccaatacatgtcacaaaagcaagataagtggtttgttcagatcatcagatccctgtttaatgaagctgacatattttctgaataaactttattggatgcataacacaggatcatgcacaactgctataggatgggatttatgacattaccgtaatgagagaactttggtgattctgctctacctagagtggtgaaggaaggataaaaaccccactcaagacaaaaatattcaagaaaatggttctgtagtcagctcattcctttcatggtggaagtgttaacgaaagaaatcttcacttatttttctcctcttacctagagaatactttcttcttacctagagtctgtgatatgaagaatatgctctgtagatggtcttatcttatgtggattggtccatgggacactatgctaggctccatagagaactggttatgtatgttctgtcctcctctatgaaaacattcctaaccgtactgttgatgtatacatttcggtcaaaagtaatttgctttctgggtatttgatggccactctgtgaatcaacctaatgtatttgtggtatggaaatctgtaacctctcaatactaagtttaaagactcttataattaattattgaaaggcactttagcccttaactatttctctctttggagaaacaaattgatcggttaatcatgtctttgtttatttttattgttgttgctgtacacattgcacataaaacaggaaagaggaaaggctgtttgtaagaggtaattacaatggcaaaattgtattttctctaactgttctcattttctcatgtctgattatatcaagacctgcactctagaagtgtgtttcagttttgctaagaaaatgatagaggagaagaataaatccatttctataaagtggtgtcaaacacaacttgacacagttacaaatttcttttttttttttttcaacttttattttagattcagaggatacatgtgcaggcttgttacctgggtatattgtgtgatgctgaggtttggggtatgtatgatcccatcacccaagtactgagcatgtactgaacagttagtttggttttttgttgttgttgttttgttgttgttttgagatggagtctcattttgtcacccaggctggattgcagtggtgcaatcttggctcactgcaacctccgtccccccggttcaagtgattcttgtgccttagcctcccaagtagctgggattacagatgcgcgccatcatacccagctaatttttgtatttttagtagagacagggtttcaccatgttgtccaggcttgtctcaaactcctggcctcaagtgatccacctgccttggcctcccaaagtactgggattacagatgtgagacaccgcgcccggccactaagaagactttgatttctcgtcacatcttttgataataaggatctggagccaaaggagaaacagaaactacttttaagaactttggagatccaagtttagtggactcttaagagcctgtattatttcttggatgacttatccagccctttgtagaatcagaactctcacaattttctttaaatcaaataaaacccaaggggttaagtggatctttaaaattatttccaggtcattctttcaataaacatttattggtttatttgttattatttcaacaaactatgtgacaggcaaacatgaactcatttctttctttctttttttttttttttttacctttcaactccttttatttatttacctatttattttccttaagcaagtaaatctccctatggattgttaagggccctgtgcatatttgcatgtagccaaagattcagtctcttgcaggaactctggttgtcaactggtgatcttgcctttgtcttttctcatagttctgcctgtggcgcctgtcactagcagtcaaataaggacaattttaccattctctcctgctgctctaatttttttttagtgccggtacatgaatttgttattctttataattccctttgaagttggaaatccaaggggaatctaaaaccgaccagatgtttctgctgctggaaaggaaagagagtaaggattaagtttaacaaaaacttggtctccagaaaaaaaaaaaaaaaaacatttcagctggaaatcatctttaaatgcattcatttgctacatatctgttagttaatttacatttactggtcctttgtaggctatgtcctctatcaatgtactctggggaaaaatcatacattttgttaacaaaaagacccatgctgtggtttgctcaggcccatttccctcatggagttttagttctattactctgcgtatttttctcacatgccttacactgaagttatcctgttgctcttgttgttgttgttgttattgctgttgttgttgttgaaggttcactatcatatcacataaagtttggaggccattttagcaaactgatccaagagggtgaggtcaatacagcctgcggttagggagggaaggaaggaagttctgccaaactgcttagcctttatggagaacttcattctcgttagagatatgtagatcaaaacaagaacaagagtgatgaaggccttcagggggaataaagagaaagtcttgtggtttttcgaggattcagatgacattgcagacagtgtgaataaacaggttgggaaatgaaaaatgatagagaaaggtatattagaaaacaaaagagaaacgggcatatgtgagacacatttacaagacctctcagaatgggtgcccaaggcttcagaccccaatacacaaagggaagagtaattaaaaaataaaattagagaagagtcttaaaaatcaatcagaatgttttggtggttggcttaatacttcacaaaagcattggattgaagaaatggatattttatttgcttgtttcctgcacagcatctctcatactatcctcctcagttgttctctggatttcctaggcttccctaggttttcagaaggacaccaaattctgtgaataactgcttcgcactctttaccttgctcagtggattaaacatttggaaacatttcccacacctcaccatcacaagggatgaatactcaccactcagagtttctgttaccctaccctatcttatttttaaatagaaagtctgagtcctcagtaattatattaagctccttaagctgcacatatcaattgcatataccattttaagcattttccagtctttttaaagagagagtagaggaaaagacagagagaaatcacttagcagctgattcacttattttaagcagctttcttcattttaaaatataaaaaattcaggtcctggaacattgggtgatttgaatgttctataaagatttgaaaaaagatttttttaaaattatatgttctacattcagggacctggatttttagtttagtccttaaaaaaacaggttggtgaagtaaaggagttttcagtctaaacactttatttcttcttccttttcatttatttatttattattattactattctcttttgtcaaagcatacggtatgaaaagcatttatgttggtctcactactgacagagcttaacctaataatccaagacttggaacttggtgtttcaataaaggaaacactgtttgaggtattttccattcaaaccagcatcaaaagtttttaattaacaccatcagaaattaatggactgaatgaatgcaagacagcgttcctacatacccctttactgggaacaagacagcaagtgggatccattgtgtatgtttgtattttataatgtatttttatttacttattgaagcagagtcccagctgcacattgcgtagcagagctacaagagtgaaacctgccgagggctgcttcactccagcagtttcattttgctcactgattgttgtcctgagttctttgtgattgtaattggttagaaagtttgaaattagcaagtccttgtcagctcatgaaagctttgaaatcatgaggcttgatacagctatcaagcctgctgatgcctaatcacttttcgggctaagaacctccagagcggtgaacattctcagtccccaggctttacctcaatcaccaattcaccaccctctggagctccttgtcttggatggtggctttgtttggggccctttcttttccatcactgaagcctatagcgggatgaacagattttggactgactaatggggatgggggttgttaggaaatgagagcaaatgggaaaacagaatgatgtaggggatcaagggaatagggaggaaggaaaaggggtagaaagagcataaaagaaaaaggaagcgggatataagatggaaagagctttgtaaatattgacatttagattctgtgcaactggatttgatatctcaggatagaactcactgatagagcctaaatggtccccagggctctttattttttcagacttttttttaaaggcctgcccactcattgtcaaagggaagacatgtgtgttcatataacctacctaccctaccacctccccatttgtgaggaccaggaatacaatattttcttttatacattacattagaggaatgaggggtttatcaactcctctcctgtaaccataaaagtatccattgtttatccttatgctctgagtccccaaaccagttttctccagaaaactctttcacagcttggtaaatttttaaataaccccaccttcatccttgtagcaatgcaggagctgctcaggcagggttacctaaagtaaatagatattgtcagcaatgatgaaatgtttacgaatgcttaaaggtcttaataactttctgtatatctaactcatttatgttcaaagacctcaagcttcatacatttaggtgcaactcttaacctgtcccaatttctcctgtattttaataaaaacaaaaataaatacaaaccagatacaaaaacaacaccacaaatcttaatgctatgaattcagaatgtcagaaaaattttcaataggccccattatggcaaaatgctgcaaaaatgcgtcagcattttgggaaaagctccctaaagtcgttcaactatttcttccctgaaatatgggaagatgaatacatattagactcctagaagaaaataattggtgaatgagtgtcaggattttcagaagcactgctaaaaatctgatcttgccatcatagcaagagaatcagttaagcctattaacaacatgtcatttttcttagctggacagtgtaggatttactgtcccaaagtctgacttcatgcaggagtcagaggagacaacttgtttggaatataatttaataaagaagatgcagcctaaccttccccagatcatactttaaaggatgcaatatcagactacacagtatattatacaccactgccccccaccccaagtctttacaggcttctgtagcagatatggctgtcagaatcctgtcatagtccctcagagatgtcaggcagtgctgtcatggtcccttcagctgcacctgaagccgttctctgctaacccagactcccacctcaagtatgcttttccttctgccccaggaccttttccaatgctgggagatctcaaaaaatctaggatggggagagtggggcttacattaagcccccagggcttaatgccctggggaaactctcaactaaaggaggaatagagctggaaaaagagatgttctagcctctatttctttataatgtctacctctggagccattttgtgtaaatctcagagatcctggccaatccttattattgtcaatccttattattatcttaccctctgagattaccttctaagttactgcctgtactgaagcctttggagggaacctaaaatgagccaggtactcaggttggtttgtttgtattaatcaatttgcagcaacttcttctctactgttgactgccccccatgaattattgtccattcatagcctgattcccaccttccatgagacagattaataagactccacaacacaaatgacaatggaatggaaagttcagaactctctttctgtacctcagtgtctaagacatggatatgtaaagattttttctggggtatggtgaccaagatgatcaccttaacatcacaagcctactcctttttaaccaaaatgtcccagtctggactgaagaaactaaaggatgaggaatagtccagcaaaaggtaccttaattttccaagtagtttactttggctccaggtaagtacaaaaggacatgatattccatgttagctatatttctctctgaaaaaaaaattccttcttttagaaaagtttatcaaacatttaatctaggagaataaactattgacaactacagaatttgttcccgcagaaaatacctaaagtctctgctcatttcatgtttactaatatttcattagtcaaagcaagtcacttaaccaagctcaaagccaagagacagagatatatatcccatctcccacattaacacatactctactgagagttacattcaagtcatatggtaaagtttatggatgtaaagttctattatagagagggagtgaagaattagagaaagtaatccggtctatcacatatattattggtttggactcagaaacaaatggtttgaataaacaacttaagaagcctgatgagttataagggacttttgtgttagtgattgataccacatttacaatcacagtctctctaatcactttcaggggttttcatcatagattagttttgaattcatcaattatggtaagcactgaatagaaaataagggtcagataaaacacagtaggttagagatgaagagtgcgaattctattccagctctatcactgagggtgaaatctcacacatttctactgattttctcccccctcagtattatgatctcaaaaaaggagtactactcttcttttttattttttcttagtatagaaagcatacaaaaggcattgtagaattctgtgcgtagcataaattacaagaggacgattaaaatccccacaatcgtctagaagtaatttgttttcaaactttggggatatacctttctaatcattttttttcctgtgcatatataccctttttgtttttggtaaaacactgtgaacactgtttctacttttgtctcttaaatctgtgttgtgagtaacattctatgcctttaaataatcttcagtgtcatttttgtgaagatttattccacattcaccatcctttttttgtgaaatttaaatcagatgtcataaagtctttaaaaagcagaattactttgaaaataaaggtattattattatagaattttagagattaaagaaaaaacagaaactaacatttaatgaagacctactctgtgccatgccatgtgcttagaactttgtttaagccatttcatttaataacctttcaacctaatgaagcaatatagcatgatggttaaactctgtgggctataggctgtcaagttcagctgcacagcggctaactagctttatgacttttcaaatgtttatcttctttttggcttagtttctctgttacaaagtggcaataataataatagcactcacttccaaaagattgttgtaggattaaatgattggataggttcaaaatgttaggaacagtagtattcaataaacatagttattatttgctatctttcccactactccataaaccctctattaaaatacaaatccacattgattttaactgctttggtgtagaagtggattctaagaagaggcaatgtgaaataaatggaaaagccaaggattttatgttttttaatcctggctcccagccttctaataattttgcctctgggaattttgtcaagatttacaggctgggcgtggtggctcacgcctgtaatcccagcactttgggaggccaagggaggtggatcacctgaagtcaggagtttgagaccagcctagccaacatggcaaaaccccaactctactaacaatacaaaaattaaccgggcgtggtggcacacgcctaatagtcccagctactttggaggctaaggcagaaggatcgcttaaacccgggagacggaggttgcagtgagccaagatcgcaccactgcactgcaatctgggttacggagtgagactccgtctcaaaaaaaaaaaaaaaaaaattatacgctcagttatgtttttaattaaaatgggtaaatactaacaatctaagggtttttaaatgataatttaaatgagataatatatgtttagagtctactatcttgcctaaacaagaaatagctttgtaaatgttagtctgtcttctcttgcattgccattaaattgttgtatttgttttaacaattagtatctctgggcaagtaaatttatatacttttaccattaccacaggcactcatgcattagtgtgagacagtcaataaatacctgaagactgtgtggaggcagtgctgctaagttgtaagctggtatatttcttggctttctgaagtttatcaccagttttccctgactctagcatgatctgtaccctgcagatggccccactgttttttgattcagtaacgatcattgtcaaacaatagatttctcttttgtatctagttgatgtgtaaaggtttttattcaaattaacagaaaacattttcataaagcagcttttaatttattcaatgagcgtacaagattactaagtgaaacatgcaggagtgaatgattgagtgaatgactctatcttatttatctaatagttactgagcactggttgtgacattgtagcatttggacatcattacttggccaagtatatcaatgcagtgtgctttttggtttgtttgtttgtaaaacttagacaagagtcaaggtcaatgccctcaggctgttaactgtttagattctagaaagaaacttggagataaatagcttcaaaataaaatagagtgaaatagatactgttatagaagaataggcaaggcactgtggttaattcttttttttattttatcacatattttttaaaaaaacttttaagttatactttaagttctggggtacatgtgcagaatatacaggtttattacataggtatacacatgccatggtggtttgctgcacccatcaacccaacatctacattaggtatttgtcctaatgctatccctcccctagccgtagacccccagataggccctggtgtgtaatgttcccctcgctgtgttcatgtattctcattgttcagctcccatgtatgagtgagaacatgtggtgtttggttttctgttcctgtgttagtttgctgagaatgatggtttccagcttcatccatgtccctgcaagggacatgatgtcatccttttttatggctgcatagtattccatgtgtatatgtgctacattttctttatccagtcaatcattgatgggcatttgggtcggttccaagtttttgacattgtgaatagtgctgcaataaacatatgtgtgcatgagtctttatagtagaatgatttataatttttttgggtatatacccagtaatgggattgctgggtcaaatggtatttctgattctagatccttgaggaatcaccacactatcttccacaatcattgaactatatttacattcccacaaacagtgtaaaagcattcctatttctccccatcctttccagcatctgttgtttcctgactttttaatgattgccattctaactggcgtgagatagtatcttattgtgattttgatttgcatttctctattgaccagtgatgatgaggtttttttcatatgttttttggccgcataattatcttcttttgagacgtgtctgttcatatctttgcccactttttgatggggttatttgttttattcttgtaaatttgtttaagttccttgtagattctagatattagccctttgtcacatggatagatggcaaacattttctcccattttgtaggttgcctgtttactctgatgatagtttcttttgctgtgcaggagctctttagtttaattagatcccatttgtcaattttgggtttttgttgccattgcctttggtgttttagtcatgaagtctttgcccatgcctgtgtcctgaatggtattgcctaggttttcttctagggtttttatggttttaggtcttacatttaagtctttaatccatcttgaattaatttttgtataaggtgtaaggaaggggtccagtttcatttttctgcatatgactagccagttttcccaacaccacctgtgagacaaagattatgatacctgtcttgcagggcttgttcatattaagcacctaggaccttacctcaatgcatgatatgccctcagctcatggcagttacaattataatcactttattttcttacttctgttctctcttactagtcccatcttccctaacctttactacttttcagatcacatttgttgttctttgcatttttgttgtctattataaggcctagcacataatagatggactagaaatgtatctttaatgaagtaataaattataataactttctgaggtcattcttatgctcgtgctttctggataaatacaatatacctttctttggcattacattgtaagtaattctacgtactcgaaccatttaatgaccaaatttcaggaattttctttcattgaaagtctctctttttgaaattatcagcttaatacaacttaaagtcatacataagatgcagtgattctgcgacgtatacatgaaaactactgactttgaagttactcacttcaaatctttagctatatattgttcaaaagcacagtcaaaatggtacctatatcttcagtgtggaggtgaaggcagtattaacaatatcctatagttgactgaagagttggttacagcaaagctctccattgcccttaaattttctctctccttaatacagtaggatcaattttaagtgcattttatgtgtgcattttaaaactcttttttttaaaaacagaatagaaatggttttcagagtgatgctgatattggttgatgatgccaaggcaccaatggagagcatattttttaaattgaatatgtttttattttcttgtttgttgatttttaaagtgaatccaaatgtgaagaggaaaaaaatcaaattctgccaatttgaaaagaacaaaaccagctaaaaccttcttttaaaatttctaagctattatgagaatactacagacaaaagattgcatatgaaagatttttttataaagaatcagattgctttgcctttctttagtcatttcaaaagtctttgtcaggtatgaaaaagaaatatactcaaaatgaagagtaaatataattaaaacagttccttgccttaacatataaccttcttatgggcaaaaatctttgtaaggttaatactgtaaaactttgatttaaaagaaggaataagaaagagtaggcagagagaggaaggggagaggaagaagtttgatttttgtaagagtaaacagaaaatgatagtaaatgaaatgatattaaatcattagctgcttttaatgatacagttttagacccacaatgtatatatatatatttttcaaatttccagtatttggcatgtacctgacatacagtcatctcttttcaatagttaacagaatgagtgatattgtctgggccagcagccaccaacgtttttgccaccagggaccagtttcatggaagacaatgtttccatggactggaggtgtggggatggtttcaggatgaaactgttccacctcagatcatcaggcattagattctcataaggagtgtgcagactcaatccctcgcatacacagttcacagtagggtttgtgctccaatgagaatctaatgctgctgctgatctgacagtaggcagagctcaggcagtaatgcttgcttgtccactgttcatctcctcccgtacagctaagttcctaacaggtaccagtgtctgaagcctggggactggcggctgctggtcaaggccacattagtttattgttaagtgcaaggtttctggtaacagaaataaagaattcaattgattcatcatcaagaccaaatatatttactaaagatctaccttaaattcattttttagcaggtagtatggcattgtggttaagaatttacatttgtgaacatttaccagctgatgaccgaggtgagcttctgtttcctcctgcataaacttgagattataaaaatcccctagttggctgggcacagtggctcacacctgtaatcccagcactttgggaggccgaggcaggcatcacgaggtcaggagatcaagaccatcctggccaacagggtgaaaccccgtctctactaaagatacaaaaattagctgggcgtggtgttgcacacctgtaatcccagctactcaggaggctgaggcaggagaatcgcttgaaccagggagtcggacattgcagtgagcccagatcgtgccactgcactccagcctggcgacagagtgacactccatctccaaaaaaaaaaaaaaaaaaaaatcccctagttcagaggcttagagggagaatgagataatgccataatgcacttgtccagtgagtaagttctcactaaattttagacattggtatattatatcatttataatattatgggtaaatgtaagtattacctgacagagttgttatgaatgttaatacacgtgatttcagtagtacctaggacatctaagagttcaacatactgaacatttgggaacccctacacgagacaaaaaagattcatattcacaatttttctgaaaaacaatctaattggaaaaagggattctatttattaagagataaaaatcaataataatgaacttaatgtttatagaacattgaccttccattgagctccaacatacattatctcatttaaccctcacaacaaatacatgaaattgcttttattattactactttatacagaaggaaactgaggcacagaaaagttaagcactaccaatatgtggcagtaaaccctcatattagactccagagcctaagtttttaactactgtgttattctaaatggacggtgtgcaaatgaatacgtaatttgttgagaagatcaaatgaatgctgcaagctgatcagttggggaagaggatcaggagaagtaaggaagatggggcctttagcaaccaaaatattcatcctgtaacagagtctggcttcctaggtttgaatcctgactcctctacttactgactgtgtgatcttgggcaagtttctgatctctctgtgcctctatttcctcaccaataaaatcggagtaataacagtactctctggtagagttgtgaagatttagcgagttaatacatgtgattacaatggcatctagtatatctaagagttaaataaatattaactgatattaatattattgttattgttactgctgttgttgttggtgactgaaatactctgaatttgtttctttctttcttattgagttagcatctagaattgtaagcgaagtgaatatgtgaaaggtgtggatcattagaacactaaagtgcagtttttctactttcagcccaagaactttgctttagtttaatatgatgggaaaagaaaacatacaattcagagcattccattgtatatttaggtgaaagaaattcagtaacagaatatgtgtggtagcctcatatgatttctttctctttatgcccacccattgatttttctgttagcctccttaagaaaatagtaatgtcaagtaaaatataattgtgattttacttcttctgaatacataaaggaatattatttttgaagatatacacacaaaaactttaaaacagaatgttgggaatgctaaccctacagctcgcattgtcacgtttagtccattccacaaacggaatggtaatgtgcttagtagctaagtatgtagaagcctccccacccccggcccagcaaaaaaaacacagtaaccttatccatgagaaaaatatgataatattcattgacaggggagctacaaggagcaattttcccaagctgtgtctttcagacaatgctgtcagtttttccactttgatgactacagctggggttgtgatgcaaggacaagaaattacagtgtggctagaagatcagggcattggctatgctgttagctatacagcaaataaaataaaattaaaaattaaaaatattgtgtatatatataatatatataatatatattcatatatatatatgaaagatagattttttaaatgtttgtaatagagattattttgggcagcacttgcctcgatttgctctctactagagacctcagcaaaagcagtttataggataccttttcttctgttttttccagagaccctttgaaggcagaaaactataccagaacacccatatttttgacttgtgtgtgtatgtgtgtgtttatgtatgtatatatttaaacaaataccacatttgaaatgtttttcagtgttgtgtattatatacccaaggccagttttatctaaatcaaaagatatttctaatattaatatttactacttcatgcaaagaaaatcagttacaactctgtatctttgattttttacttcattcattcatttattcatcacccttccacatagacaggttaaagcttaatttcacattttacaaaataatttgagttataccaattgactttattttctagtactccttcattgtagtttacatgtgtttctactaaatggaaatctttgaggctacaagttaataattaaaaatagagcaaggtaccacatgctcattcctccccttgttttcttttctttgattttcaaaatattcatctgcaaactttattgcatgtaagtacagtacctctttacatatgcaccacaactattttgtatgagctataaaacaactagaattaaaacttgtccaagaccccaaagcctgttcttcacaaaggaacctttcttgcccgattgttagaaagtgttttgaatgatgcataactaagtagagtaactaaacaattgcttttgagcatctggagcttgcccattaagatttctatagccctttattttcctttctgtggtttaagaagtgattcacattcaatatatgaaagttctgggttcagccccttgagcttttggtagaagaatcttcatgaatctaataaataaataaaacaaataatgtaagagctgaagacggttgagctcatgtgagtttatataccaaagcattttcttcctgggaagaaaaggtatcttctatatattttggtttcctaaatttagatctagaaatacaccattgttttgttagagtgtattcttagggtgtgtatgtggggaggcagattgtaagcaaccgattcaaaatttacctggaacttcatagaataatgtcaatgctttttaggtagaaaaatcattacctacaaataggggatacattatgaacgtatttcaactaagcaaaagcatagtcaagtgccttcataatgctaaattttagatgttgcactgatgagatattttccctacaaataaaagaccaaagtgtacaaaacctcaggacatgtggctgagttagaattacaatgcagctgtcatttttgcatttcctggctttcatgaatcattactagtgatcctctgtcatttaaatcagttgagaacatggatttatcttaattttcaccctttgtttccctttttcgtgataacagtttgagatatgatgatgtaaagtgtttctacttataatggtttcagccttgtcccttggcagcctaaatcttctggctaattcactgatcagttaaatagtcgaggttattattattataataattattttacatttatatagcactttcctccaaggggctcaaggcattttacacacagtaaattaccaaataggaattaatccttatatcaccctgtggggtaggtacagtcacataaatgaaattctacggaagtactgcctgtgtcacagtgctgagctctaccccaacccccagtgaacctgccctgcctacctgaagatgaagaatgctgttggcatggcagggaaaagctggaagaaagatcttgggaaaatggcccgctgtccttactttggtgctttgggctatctggaaaatgatactattgagagcagctaagcatgtcttgatatgcaatttacagataagtttcacctatatggttttatttaatcctgacacaagacaaggtgggatgtggttctcaaacttctgtgtgtatggaaatcacttgggagtgagtttaaaattcagattccaagaatttctagctcatggaggttctaataagtcaagaaagggccattgacatctgaatttttgcctcagttgattttgagtcacgtgatgtttacccatattttgtgaaacttgagctgattaaggaagaattgttagtcccaatctacatatcagaaaatgatggctcaagcaggtaacatgtcacagtatttggcagaggctggactataaaccaagttttgaaattccaaaactcatactcttttaattacgctacagcgcttccaggaaagggaaaacagagaagccaatacaacaggatttaaatgtaaaggaaaggagagaacagttagatatgcatgtgagacactttacagtaaggtaggctggcgtctactggccctcttggaacctcgagttgatttgtgctgcctggatggagaagaccatcatcttttgggcagggctggactgttccttggcagcttgttccttggtttcagaactaccttgttccctgtagccaacaagtcagtcaactaactctaatccagcaagtacctgatggatttgcaatgtttaatttttcatcctgcccacaaaatgagtctcctccttaatagatgctgccaccaaaataaaagctggattttgccaggaaaccaagaaaagttcttttaataagcttcctgtttacgtgagtgggccctttatgggatgggatgggttttacgttttttatttgaagcattcttactccatttctaaaagagaaaaaaaattaacaggaagtggttatgagcaatttgactattatttttcaatttaatattccatttgaggtaatttcattcattttttttcttgaattaatttttattcagttttcttcaaaaactgggacaaggcattataggaaaaactatagacagacatactgcatccaaagtttttattctgttctgaacttcttactcagaagtgtgagaattccatggtggagtttagaggcgcttgtgggatttatttggggttttcagaaaccagaaaaacagacacgtggtgttactggtggtaaaaattcccacactctgtgtaaactcagcacagttttcagtaggtactactgtaaattgtattgagagactttccatgcccttccttttctcaaatgcatgtactccttaggtatggataataattattgctgttttagtgaaacattttgtgagtctctctaagatatcttttcattcttggaaattatcttctgcctctgaatttttcatcttttttttaacactctggttattcccagtcactgaacagaccgatcttatttaaaagggtctaataaccttttaacagtgaggtaaaaaaaaaaaatggcatttatttattggcagggaagggggagcgacaacaataagagagatacatttggaaaatataattgatatgatatccttgtaaaagcacattttgtatctttctcagcatcagccttttagaactatcagtttggatcccttcaagattattttatacctaggctagatcaagattttaccagaagcttaaactatttggggggtcctcttgaagaaaaagaatacaaaattatgattacagagttaagtacaggaccttggaaggggggctgcgcaagtgaaggtccctgaggtttaagctccattaaatatgcagtaaatctgcctctgcagatcccctttttgggctttacaaaagcacttttaataaatattactgtttcatataacaacaagattacttacagataataccctactttaaatgcgtagtctttaggttaaaaataataaaacatggtaaaaataatgcacgcctacttacaaacaatctaactaactgattccatgtagcgttcctctccatttattcaggctaaccctaacataatgtaggtcaacaaataccattagagcagacatctctgcatgtaccctggtatttcaagcaatacttgagacaataaactccagggcagcaaaaaatgtcaacagttccttcaagttctttgtaatgggattatagctgtgtaatgaaactaatatcagagactagagtaggctgcatttgacccattgtctcttttctctgtgttggaaagatgtaagacacatgggtgccccacagcattttgcttctaccacccatttttacacttaattatactgtttcttattgttcttcagttattttaagagggtttatgtttttctctagagcaagatagtaaccattttgagaacagaaattagactttttccccaaatattttacagtaccagaacattcctgctttctaccttttatttttctgcaccttgttctagaaataaattttagtggtggtctcttggtaggaggtacttggcagtttttaattgaacttctgtgaaaacctaaaactatctctaccttctctatctccatctccctgatcctagaacttcccttaaggtagaaaaaggcaagtgttttgaaggtaaatctagaaatttaaatggagaaaaggagggtgaaaaatattgccaactcagaaattactgagctttcattctttgtgaggctaatccagttattccacctcttatttcctcctcagtaagatatgattccctagtatcttcctaggaagtaaatttttggggttctaagtgtaaagaaataaagtcaacttttgcgaagccctcagtacagtttagtgcttgctaccactaaccaaagtagaattcaaacacaagagggtaattgcagaaatgagtaaatctgtacaacttcacattggtagtatccaaatgctcttatgaatgtcaacttcaggcatcctctttcattagaaaaatatgtgttgtctttgacagggaaacccttaaaaaaataaaatgtcacatatttgaattttagctgtattcataataattctcacaaacttttctcagaaaaaattttcttgattttcaaatttcctttatatttgttcttcctttcatatataattgacattctttaacagttgagaggtgctaggttaaatgtttgcagaataattgtggcttatttagaaaataaattttactctagggcttatgttgtgctaaaaatgactcatacagaaatggttctgcaactcttagctttagcctgatttgtcttcagagaggagttgtattagaaatgtggtgctatgttctgcacaaatgaatgtttgcggtacatatggaaaatactatgcacaggaaaaaaaactggtcctagaaaaaatgactttaactttgcataactcatttgggctagtttttttttttttaatgtgttcactgcttttataaaccatttcagaatgtctccatagcaggataatgttgcatagtcgatgacttcatatttttatacctcctggaattcaaagggaatattagtctggttggttcagtaatctaaaattattggtttataataatgggcataagaagctttcaaacaactacctgttttaccagttttttccttagtatggtatccagatttgtcagtttatatatttttgaagtagttccctctaaggtgtcttctttaactgttagactatcccataggctgagtgtcttacgtgttgatgtggctgatggtttaaggccagtggctctcagatgttagtttagcacagggtttttcaacagtggcactatgatactttggagtagataattctttgccgggatgcagggtagatgtctgttctgtgcactgtaggatgtttagtggtatttctgacctctccccattggagcacccctcagtttggattatcaaaattgtctccagatgttgccagttctcccctggtggggaagggggtggcaaaattgtcccccagttaagaaccactgaattggtagtatatattactggagtgaaccacaactacagttttgttgttgttgttcacttgtttgcttttgtttttgttgtttataatggagtatagaaaaatctgatccgatctgaagaaagctggtagctctcaactgagaatttcttccatagaactatgatgtgtgtaaatgttgaatcacataggcagacctcagagcttcctttaatgacttatgtgttagagaaagggttctaagattctgcatagatgtatattttatactttttatttatttattggtctcgttattactatggtgatctttctgaaaggcagactaagctggcacactgctattgacttaacaattaaattcccctttcaacatctcctgcctcaaatagtttaatagttgatattttacccttagaagcacctagctaaagagagacctagtgaaaactaaaaccaacaggtaaattaatcttggctttggggcaggaagatggcagttacacaaacaaggttttattccactgattttaggggatcagaacctggaaatgaaaattggagattacttgtcaaacaaagggaccaaagctctgcttaatttaattaacctgatttcaagtacttcaaagacccagaaaggcaacttattattgacagtatgaaacccactaatcctcatagtaaccataggagcagggtactattattgtgctgttctgactgatgatgaaactgaagtactgagaagttaagtggcttgcccaacgtcatacagtgtgtaagagacagaggcaagttccaaatcaggcagtactccacagtcatcttttaaggtcctttaaaatatgctagaatttaaagggaaactgacgggctggatttcagacatctatgtacaggatatttatccaaaagaataaatcaagaaaataatataccctttacatttaaggaagaagaataatctgaaagaaaggattacatatttaataatcaactatgttataatcatagtacacaatttttaaaatatgtaacacaaaattttcatggaatttatcagaaatgttgacagagtcttatagcattttataatccccatttccatttgaggattgagagaatattattttgcttgtgagcatgtgggcctgtaacagatgatttccactctccattaactatcaaataatgctacctctcattaatacatttttcccagaaaacacaggaacttggataataaataaatcagactttattttattttcaaaaaagtatacatttcttaacactcttatgccatatcctctacaaaattcctaaatctggaatatagttgttgaaagagcatcttgatatttataattttctaagcatcattattacctaacacataaatgcctttagttattagtttataccctgataatagccactaaatcttttgtgtcatgttttttgattatccataattttcttaaaaagccaaaatgatgtcttacccaattctctaacttgttggctggaggttaggctgccataaatctgtagcataagaagaacagaagggtgggcagttggaaagtatagtatggacccatttcttttaaaacgtgttaatcattgcagcctgcaatcagatcacattgaggttcatatcagaataagttgattcaattcactggctctctttaagtctaataacacttgtgtttctagaagtaataaaattatatatgtaggcatattttttaaaagttattttgtttacagatgtgctctgtttatcatgaacctagcaatttgtgttttatcccatttatgcctagtgttccattattggaacgctaagcatggaggagttatttatatcctactgctcaaggtcatcgccatggtctgattgcagaaattcaaagaaattgcaacctcaggcatagatgggttaaggggcacgattacagtgtaggaaggaaattttgatgcagcttttaaaaagtagagaacttttcattttacgcttttacacatttcatatgtaatctagaatatcaccaaagcttttattgccttctatctatttttaaaataatcttgtccagcccatatctgtttttagtatttgcatctcacaggaaaaggaactggtggtatgactctttgcaaagcattgttctgtggaatttcaacccatagaaacgagacaccacgttctctgtagtctgtcctatctctaaagggaacctcatggacagttttaaaacagaaagtgaacagtttatcacacattctagttactctaaaacctcttttaatgtacctcctggttctttgcaagtgaaaagaaaaatgcttcctctcttatttaagaagtcttcagcaacttaccaatccctagcatgtgcaaaatcacaagactatataggatcactgttcttagattctgaatttggaattcctgataactgaaccatgattttcaaataaaaagaagggttttgaagtctatcaccacttactagaagtttttattggcaaagaaagatcacacttctttctgtctgcatacaaaaagaaatagctaatctcctttgttgccaggtgaattaactgtattcagaggaaataggcaaacttgtagaagaaagtctaacagattttttagaattctttcatgatatgatagaaatattatggtttatatcaggtgaaccactgttaacttgtaaaatttctactgaggcaaggaaatcaaatcatttcttgattgtagaaagtgtattataacactggtgctgttggatgccaactctagatagcactactaccgctactaagaactatacagtcttttggcttctcacagggaaatagacaaagggaaaagggaaataagtcaggaaaaacggatgagaaaggagatagattagagacttggatgtacagccatgatagataacccccagcgaaaatcagagaatgcaagggacaaaggaagcatgcggtccatttaggatagtgacaatagctaaaggattccatttgatcttaccagattggcacagctggaggaggcacgcaataaaactccgcccaataaataaacaaaggtaaacacccaaagctacaatattgctatcttataaactcagagcgtgggaaaaattagacttattagaaagcttccatggcagtcagtcactaagaaatgtcagtgtgatgtctgttaagtaacatttattaacaagcgtgtttgtttgctttttctcatgttcaatgaattgttataataccgcaaaataatttgttctctactaatgcagattattttaatctaccttaaactctttaatgactgtcctgtgtaagacaccctgagttgttatgttataggaacatggcatttgaagtacagatagtttcacataattgcagagggtttaatataagggaattataaaccttattttcattactttacttaatgagtgccaaaattttgaaggcctttttgcctgaaagagctcatagcctttaagtccctttcctaggtaagacttataattaaactagacatgcatcacttgatgatggggatacaatctgagaaatgcatccttaggcaatttcatcattgtggaaacatcatagagtgtacttaaacaaacctagatggtatatactactaacatataggctatatagtataacttattgctcctaggccataaaccttataaacctgtacagtatgttactgaactgaatactgtaggcaattgtaacagagtagatggtaagtatttacatatgtaaacatatctaaacatagaaaaggtacagcaaaaatacagtattataatctatgggaccaccatggtatagatatatgtggttcattgttgaccaaaatgtcattacacggcaaacgactgtatttgaatattttgtttttctctatttgcactggcacctttctgcacacctggataaatattgtgttccatcagtttagcttttccttgctcagaaaagtttcattccatcaacatttttggataatttattttacattccttgttccagattattcattcagcaaaaattaattgtgcttctgctatgtatatgcaagaccctggaataagtaagtcattttgatagatgttaagcaagtttagtcctattaccagttcctagggaatcctaacttgttctgtatatgtaccactgcccattttcctttaactttctctaagcctttttttgttttcttttctttgtgatattacacaaaaaccatgagtaccccagttttctctctttcatcctatgctgcatatataaagcagctgctcagtggctcacagatgcaaacttaccacagtagatatcggcctaggctagtacgtgtgtgtgtgtgtgtgtgtgtgttggggaggtgggcaaataatagacctatgagacctgttccctacagatgcaattcaagtagtgcttcaagaagaattgtacacaaaaatacttttatttctttctgccgccatcctttggttagttttattgtaatgactggctgcatagtgacaggttgatacagtactacttttgtttctaaactccaatattgtttaatcctgttctccttcttaagccagttatatttacaggctcttagttccttggttaccagcattaatcctaatgttctgtctaaagtatagtagtgattttcttatacttcagttcactacaatgtttgtgtggtagttgccataagtaatgattttgctttactccttaccagggcaaccacaaacttgacagtggttcaaaatctcaggttttgcaaggggttgtgagagattatatgtagcctcagggaagtcttaaaatgctcagattaattgtctagatacaagttcatgagtctcatgaacatttactttagatttagaaggaactctgaaatcactaaattactactaaatgtcagggtaaaccacttggttttactggagaaaaatgacatctacttaagaagcaaaatcctgtctcgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcctcttgttgaattgatccctttaccattatgtaatggccttctttatctcttttgatctttgttggtttaaagtctgttttatcagagactaggattgcaacccctgccttttttagttttccatttgcttggtagatcttcctccatccttttattttgagcctatgtgtgtctctgcacgtgagatgggtttcctgaatatagcacactgatgggtcttgactctttatccaacttgccagtctgtgtcttttaattggagaatttagtccatttacatttaaagttaatattgttatgtgtggatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcttggtggtgacaaaatctctcagcatttgcttgtctgtaaagtattttatttctccttcacttatgaagcatagtttggctggatatgaaattctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattgtgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtagattaaactaaagagcttctgcacagcaaaagaaactaccatcagagtgaacaggcaacctacaacatgggagaaaattttcacaacctactcatggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtgagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaacaatgatagactggattaagaaaatgtggcatatatacaccatggaatactatgcagccataaaaaatgatgagttcgtatcctttgtagggacatggatgaaattggaaatcatcattctcagtaaactatcgcaagaacaaaaaaccaaacaccgtatattctcactcataggtgggaattgaacaatgagatcacatggacacatgaaggggaataccacactctggggactgtggtggggtggggggaggggggagggatagcattgggagatatacctaaggctagatgacgagttagtgggtgcagtgcaccagcatggcacatgtatacatatgtaactaacctgcacaatgtgcacatgtagcctaaaacttaaagtataattaaaaaaaaaaagagaagcaaaatcctaatctcagagataaagttaatgtagaatggcacatgcaagggctgaatccatgaaactcgtgaaaataattttggcctctgtagaattcgtttcatatagttgctctttcctttcccaaagtcacattataggcaagtttttatttattcacatgagtagacaaactcatgaaatggtttcaagcagcaaatggttttggaagccaggcagagtaaactaatttttgatttataaatgtgctgtggtgctaaagaatggctgcattaacaatccactttaataaggaatcagggatttgaggataagaagccaaaatgggtgaaggagaacaacagtgctaagagcaaatgacatgttcgaaaagtaaacttcttcatttgaaggaagattatgcaaaatccagcttgaaaataatgaatgagaaatctaacttgatatgtttaacagaggtggttgatagaaggtcttgaattggctctgaaaaggctattactaaatatgggaagaacgggattcacatctccaaaaatcacatctttcgatttttatttatgcccagcaaagatagcaagaaggtacgtttctctccctcattaccaaagctttttttctttcttaccctttttttgtgtgcccagactatgaatctgttaactaggcagggtcattttcgtgagctttcctaatgccaagagacaccaaatgttgaggtagatcaaagggacaaagaattacagagacactgagccacttttcttaggaccctgagtacaatgtgaacagtctacttagctccaggccccaaaccaagtattctgcagcacacccagtctggatttcttgggaagtgctccctgttgcttttcatagtttagataatccacatgaacaatcctgattaaatcagttgcccctaggcaatggggaaaagcataaatggctttttggagagagaggtccaaaagcttctctctctcacttgctgtctctctctccaccccccatccacccgccccatctatttatctagttccttgtgttttcatttattcattttcttctccaaaattatcttcatccaatgcaattaggtaagaagagggtactattgaaaaaaatgctgatccctattcattaaatgattcaggttttaattttaaattacatgacctgtcttgttgtgctgattatgaacagtttttgaaaggctgttatccagggggtggttatccagcgatattatggaaggtcactaggcatttgttttttatgtctgattcttttttaaccaggcaattactctatcatttaataatccttacctcaaagttcacttgaaagaaagctcataagatttaaaggggaaaaaaaatccctaaaaataaaagttaggctaggctaggccagggtgggaaattccattgtggctagaagcccatggcaggtagagtggaatttaatgaaggaaactgctgtgtttttgtgtctttctgtatgtttttcctttaaaaccaagagctgggcaggcatcccattcgacctgacgtgacccaagcaaattgcttcttatataaaaacaactgcagactttgagaatgtgaaaatgcactgtatccttctccaaccgagggaaacgaaagcctgagaaacaggacggccctgtcaatactcgttgagcagaactatcactcaaacttgataaagggagattagaacaggctccctaatgccagaggtattcattataagttggagttctttatttattttttattttcttaaacaagcacaagtggtcaatggaaaatacatttttacaaggcaggttttcctgcaggaaacaaaagtaggcacaatttttcaaagtcttttcatggaactagaatttttaaaaaatttttaataataatattaaataagaaaagacaaagagaatcatttcccttttctaccacagtcttggacaagcaaagaagaagagattcagggtgtgtccactgatattgcattcagatgtgttgtcttggcttctgtactgacagatttatttaaaaaacaaagtttttaaaatgcattgtgtgctagtgaagtcacttcataaatcttttcctttatgaattattttgatcacaaggcttgttgtttaaatcactgaaagactgttctccctaaaagaaaaatgccttcgttttcaaaccgccagttcaaaagccagtaacttcccctgaacagcatgcagggagccagagggcaaagaacaagggaccaagtaagttctgactccagcataaggcataatccagtttagatttgccgtggttcacagaagagccatgttttaaacatttggacccagagctcttacttttctcatagattacttagtttgaaatggtgactctgcttcaggaaaaaaacaaacaggggaacacagcctttgatgcagctggtctgtcagagggcggaaagttagaattagaatattcttcaagctgttgctgaataatgaagggtagggcttcctagttgggcagttaccacagcccctctgggagttcagagaacaaatattacctaatgtgtacaaagactttaaaagttaagttgattacaagctgagtgaggaaggttagataaggcagtgagaactgagttccaccagagggacctgatcttcaggaacactgccaggagccacagggctccatttgaccctctagagttaaaggattgggtaccaacaggaagttagttaggttcttgaagcgaatagtctgtgtgaaattactacaaggaagaaagaaaagcaaaacaaaatattggaatatatgcatacatagaggttgacgagataacctggatgaagattatgactgtgagatgggtcaaaatctccccaaccaaaatgtaatgtgcttgtaaccagaagaccttgtgttgctattcatttgtttttggcacagcacctagaatgttgttaagacatacaagcaaataattaatactggtctattacattaatttgccaggataattggtctggtggaagggtagatggttccagattaaacatgggaagagatgaatgtctagaagaaatgaatttgaaactgagatctaaaggacaagaatgatggacagaagtgaacaggctgtctcaggttcattgattgagagatgcttcttggctattcactgcttcaattgttattctccattttatggctgctccatgaaaatgaacaagaaaggcacggagatgatagagagcaagtttacatgatagaggaagaaagttgttaacatgggagatgggaaagaacattaataggtgatgtatattcttagaaaaaatgatgactgctgtggatgagttttatctcaattctgagcaggtagttagagggaatggttggaatttaactctggagtctgatggcctgggatactttgtagttttgtgatctacaaaataatgttacaatactatttttaaaaattgttatgaaaattatataagttcatatatataaactacttagcaaatgcttctcttagaatgacttaaaaaataatgaagataagagttatccattttccctacacaactgtaccacatgttcaacttctctgtcatgattagaaatatcacataccactgatctcccaagcaagttcattaaggtagttttctttacatacaggtctgtttcattttattcacagattattctgctaaatttaattatagaaatattcattggccatatttagcgactgagtggaatatatagcactttcctagggcactatgagtgatttttttaaggttaaaaaatagtcttgtctcaattttaaaatactgaatattgagagaggaagccctatagacactttgattctaatgcagttttccatatcagttcaagtgctatctaacataaaaccacaattttggtagttgtgattttggtaataaaggagtaacttgtactgtttcaggacaaatatttccacagataacagttccaaaccatggtatgggttaaaaataaaactaaactccaattaaaaacttaaaaaaaaaacaccacaattatttgaaggcaccggagagtgaccaaaagcagttggaatctggagtgaactgtcccgggtaaaattcacgtttgttacagcttcttccctcaaggaacttcccagtctgtatggtatagagaagttagaattcaggcagaaaaccacaatcttattggtttgtgatgttagcgaatggagctggcattggcaaagtagctgaaattgaggaaggaagtattagaaaggatggagccatcgagggaaggctcccatgaatctacatataagttaccctaacattctggctgatataaactgtgcatgtatgtgggagcctataagtgcctggagaaaagcaacaactagaaagctaaaagagctgaacagatacattagatgaagaggagacaaagttaggagtttgagtttacaaagttagaagggtttggtaaatgtctcaggctttatgaatcccagaaggatcaaaccttagaaatatagatgatagctaagaactaagaaattaattatagaaagagagacaaacctgaagcattgaaagtttctgtcaaataataaaaccagtcctcttcaaatcaaagtggtcgactagtaatttaataacctgctagaagaaaaatgcattgcattagagaaagataaccaaacccagagtttgtataaatatcatgcacaatgttcaactgtaattcaaaaattaccagtgatggatacagaaaaatgtgacatgtaatttttttttaaagtccatggaaatagattcctcgatgattcagaagttgtagacaaggactttaaagcagaaattataaatatattcaggattttaaaaaaatatgttttcaggcccggtgcggtagctcacgcctataatccaccagatgtggtggcgtatgcttataatcccagctactcagaaggctgaggcatgagaatagatagcttgaacccaggaggtggaggttgcagtgagccgagattgctccactgcactctagcctgggcaacagagtgagaccctgtctctaaaaatatatgtatatatatagtcataatgagggaacagatgagaaaataagcagagaaatgaaaattttcaaaaataagtaaaaagttaaggtataatacctgaaatttttttgaagagtcattgaagtggcttaacaatagattgtagatggcagaagaaagtgtcagtaaacttgaatacaggtcaatagaaattattaatgtaaagaacagagagaaaaaggattcaaaaatgtgcagagtgatctgtacaacaatatcaaccagtccactatactttgcatgtctcagaagaagaaaaaagaaatgaaattactaaaaagaaccaaaggttaaagtacagaatctgaaataaaaaatgatttgttggagaatcttaacagcagattgtgggtggcagatgagaaaatgggacagaaatgatatttgaggaaatcatagctgaaaatgtccaaaatttgctgagaaaaaacacaaaaatatgcaaagaaaatcacatgtaggcactgtattcaaacttctgtacaccaaagatacaaagaaaaatctcaaaggcagccctaagggtggaaacaatagatcacctacaggggaataatcaaacatcgactcattcctcatactaaatgtaatgccatttcttaatgattgaaaagaaaaacaactgcaaaaccagaattttatgtagagcaatgtgatcttgcaataatgaagaaatgaattttctgttgtcagtggaattcctataagtagtgtgaaaggcagtgagtgcttcagggtgaagggaaatgacactatgaaccaagatagaaacttgtttttacagaaaattttcactaaaaattttaaagtatctatttacatgtaaaagaatatccttttattcttttaatttctttaaaagaaaaactgactaatgcataaattatagtattttctcatgagtctatagtacttgcagatatgaagtatgtaaaaatactacaaagtactgggtggcagtaaatgaaattatacttataagatactcacatttgcataaagtggtaaaatattaactctgtgtaaacagtgataattaaagaggcatattgtaatccttagaacaactgctaaaaaataacaaaaaaggtacagctaaaaagccagttgtgcaattgaatggaaaaataattgatcagtttaactcattaaaaaaggaaaggaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactggggaggctgaggcaggagaatggcgtgaacccgggaagcggagcttgcagtgagccgagattgcgccactgcagtccgcagtctggcctgggcgacaaagcgagactccgtctcaaaaaaaaaaaaaaaaaaaaaggaaaggaaaacagaagaataacaatgacaaaaacccaaaagaaaaaaatcaaaagcatataatgaaataaatggtagacctaaacttaattgtagcaataattccattcactgtaaatggtataaatactacaattaaaagagagagtattaggctgaataaaaaggcaagagtcaacatatgctgtctacaggaatacactttaaatgtaataacatggatatcttgagagtgaaaagatagaaagatatatacaatgcaaacaataagcatgagaaagctaggttggaatattaatattacaaagaatagactttatgccaaggagtactattagagataaggagggatatttcctaatcatatgtgtgaaattatcatgaatgcataagtcataaacatgtagacacaaactgacagaaaactagagagaaatagtaaaatctacaataacaattggagattttaacattcttgttctagaacttgatagaacaaataggcagaaaatcagtaagaatacacaagaaattaaaaacaccatcaactgccttgacctgtttgatgtttacagaacactattcccacttggagaatgtgttctattcccacctggagaatatgtgttctttaaaacatatttaaaacatacaggaatagagtcctgtatgtatgttctactttatttattaaagtagaccctaatctggttcatcaaatgagtttcaaacattttcaaaagattgagatactacaaaatatgcttcttgtttataattaattaaattagaaataaaaaaagaaaacaataaaatatctagaaaagaccagttggaaactacacaacaaacttaatacctcatggttgaaagtcatgaaattttaaaataattaaattaagttatgcagtatattgaaatttatgaaactgattaaatgaaaatacaatatattgacatttataatatgagccagagagaagcttagcagaaattttgagcttttaatcctaaattagaaggaagaagaaaggtttaagatcaatagcgtaggtttccactttaagaaagtgggaaagtataatcattttaaacccaaaagcagtaaaaaaagaaaacaaataacaaaggcagaaaactgtgaaataaaaacaaactacaaagaagattaatgaaagcaaaacatgaatatttgaaaagattaacagaatttataagctataacagaaaagttcaagaaaaaagagatgatacaaattatgaatatcagtaatgagagattatcattacatatcataacaatattaaaggataacaagggaatattatgaaaacttcatgtcaataatttcaacaactttgataaaataggtaaatttatttaaaaacatattaacaaaactggcatagtaaaccaaagaaatcaaaatattcctttattgattaaagaaattgaatttgtcgtcaaaagcattcctaaaaaaagaacttcaggtttagatagtttccctggagaattctatataacatttaaggaggaaataatattaatcctacacggactctttcagaaaacataggaggtaaaaacaaaacacttcctgatttatgagacaggcataatcccaacagcaaaacctgacagatattacaggaaaataaaagtataggccaatattcctcatggttctaggcacaataatctttaacaaaatattagcaaacaaacttcaacaataaaaagtaaaaagtataatacctcatgatcaagtaggatttatctcagaaaagcaactttagtttaacgtttgaaaataaatcactgtaaatgcatcctaataaagaagaaaaatatgatctcaatagatgcagaaaaagcaattgaaaaaatttgacagtcattcacagtgaaaactctcagaaaattagaacagattgaaacttcctcaatctgatgaagggcctctatgaaaacatataattaataccgtccttaatgataaaatctgaatgctttcctcctgggatatagtagaaggcaaagatatatattcttactacttctgttcagcgttgttctaaagatcctagccagagcaataagacgagtaaaataaattaaaggtataagcataggaaaggaagaagtaacattgtgtttattcacaaataccatgattgtttacattagaaactcttaggggatatacaaaacaactaatagagctaacagtgcatttaggaaggtcacaagatcaatatacaaaaattgattgcatttatgtagtaccggcaaataatttgaaaatgaagttttaaaatcaatttacagtagcctataaatataagacatttaaataaaagtttaacaaaagaatgtaagattccccactcaaaattttaaaaggccttagagaaaaatccgttatttatagatgaatactcagtatttctaaagtgtcatttttccccaaattatctgtagattcaatgcaatcaccatcaaaatatcaacatcttgtttttctaacattaagataaattgtcaaatttattttaaaatgtatatgagattgcagaaaacttagaaaaagaataaagttgaaagactcacattacctaatttcaagactttctgtaaatatatagttctactttggaacattggatcagtatcttctaaggttaagcatatgcctaccatattgtttggtaattacattcctagttatttaccaaaaaataatgaaaataatgccctcaaaaagatttgtacaggcaagtttatactgactttatttgtaattgcctaaaactggaagcacccaaatgtggaaagtggatatacaaattgtggtatattcatataatgaaatactaacaagcaaataaaacaaaacagagtatgatacaacaatgtagatgaattccagaaacatggtatgcagaagagccaggacacaagagtatacataagttatgtgaaggcgaaactattctatcgtgataaaaatcagaatgctggttgtttatgggagatagaaattaactggaagggggcacaaaggaactttctatgtctctgttatggtggtaaatatatacatttttatatatacatatttatacataggtgtataaatttatcaaaatcaaaactcattctgtgtacattttgaagtccatgaattttgctgaatataaattatacctcaactctgaaaaatttcatgttgaccctaatcaactctcacctgaagtgcttcatctattttcctaatggctaccctggtccctgtcctaattaaccttcaaagctgttttaaaacttttctcttctgcctattgctctgattccaagagatgtggtagaatgtaaattgtcaagatttggaaatctggagaatgttcaaggttaaagacagaaatatctaattaacaagcccagatacagccttggacagtcgaacgcttgggcaagtgttcactgctcgtgttcacttttctcttttgtgaatgatactgctttctaaatatattttatttcttgagcaagagggagaaaagaggagtccttcaaatttactttttgttttgttgcatattgcaaagttaatatcaaactctaggtttaaaacttcaaagaatgtcaggactttttcgtttttccttttttttttttttttttttttactatccaaccaagggttttacttattccctggatttctctatacttttaaattgtcaaagccaaagaaaagaataattaaaatattcaaagctgaaaataagcaagatttcagtttattttcaaatataagcttaccacttccctgcatttaactgtgatactagtgttctggcaatattacatatgattgagaattctgtttacctaaaccacttttttattgttgtttttagctttcttaagtgccatcaggtcttgtcttctttcatttctttctagctgtccccaacaaatactgcccaagtctgattgtaatgcagcctttctttcatagtgaatatttattaaagcacttaatacctgaattatgaaatgtagacaagtgcacattaacctggctgagttatttcctttcttgttctttttaaacacatattctagcccagtctatcaatgccagatggcaactacattttgatacactgaatatttaccaagtcatgtggtatgcttttgaagtattttttaaaccctttccatcaaacgagctgactcatctctcattcatttattcctgcttttaacaagttgtatttttagaaacttgacctcagttttatcaaaatgataaatgatattgtaaaatgatgcatccgaagttctacaggcctgactacactttacatcctacagctatcacgtttatttttcagtgtttaaaatgttataatgtaccaattttcttattttcatgaaacttgactccaactagattattgtgttagcacagaggaatataatgggagaatatttatacttagacagctttaagatattcaggaaattaaaagcatttatggttgaaataattttaaatgaccatgaaaatagcaacttaacaactgatatttatgtccaagacctttaaaaagcctactggtaataggcagtaggtctaataataatagtaggaagaagatgaagaagactaaaaggctgtcagaatactgactccctgctatgttttttgttttcttgatcttcatgggaatatgcttttgtgggggaaactgttagaatatttttttgtaaatagatgttaatatttcttaatctagggatattaaaaataacaggagaaagtattgacagacaaaagtgcatggcattgaaaatggttagtaaaggccaatgcatattcttagaactcttcctggcctgttgatctctaaagattattttcaattttttaagtttttatggctacttttcaatggtctttcagaaatagatgatattatgcatgttatgaagttaataataatgctttatataaacgagtggaagttttctttgtgaataattttttcagaatttttacagtgttttttcttttaaaaagcagacaatagggatatttggagagattaaaactgagaaacatgaaaggatctattcagttttacaaaaaatctttcatgatactcttatccattttattttctagctctctttgtaattgaaattgtttctctcttgtgtgtggcagagtttgtgtagtgcctagtctggagtagcttctcaaaagcacagattgccttaataatattagtgtatataaattcaaagcatggtgcccaaaatgtagtgtatattgttgttatattattattgctgttgttcttatgactgcttttaaagggaaatctccaatcagccttttaatgttatctcatttagcttatgcttttataaaagatttggaaaatatataatttacctagtgtaaatttaaaggaatgtgacttggtcaaaagagacattctagaggcaaaccaacaacaacaatactgaattcattaaagtttggattagaatttgttttttttctatatatagaaagcttgagatcaaataaattctattcctatgacacatgtggaatttctctctctgaaggtgttgtcagcttattcacctatatgaccccctaaaagaggaagtacatcctgatgaagtacacccatgagtcacaaagcagagacttgagtccattatgcactcttttaggatttgtagatctgcaacattgttagtggtttctttagaaaagaatcccatggaactctacattcttttattaaatgagcccagaagattttctacttaccctttcacttttaatagcccttttgtgtgtaaacagcttctcaagaactggaatttttagagtatatcttctttattttatgagtttcacttgaatgtttctaacttcatggagactcatctgattgaatggtaacattttgtattcaggcagcaagggattttgtagtgaaaacattgtggtggacacccaaaaaataagatttctaatatagtttatagtgtatttttctccttaaagttaacaatgaaggaatagtgtatctttttggctcctctgtcaaattaaactgtggggtaattaaatcattgtattatttgggaagaaagaaaatgggtggacatagattaaatttttaaatggtgagctacttcaaatacaacgaggatcattttatttagtaacgtataggtcaacttcttaaaactatattatttttaagcctttaaatatttaatttctgggtcagctgattagtcaaaagagtagaagctagaataaataatatttgccttagtttcattttaggaaacactactttccatatctgcatagtttgagttagttgcctttgggttgaaatttaatgataatcctctgacagtgtcaatgatcttcctctgctatactttgaaccttgaaatacattgagacaaattccagtagggctaacatgttttgtttttcttaattttctctgtatttcagatcaaatttcactcctctgttatactcttattcttctagatttttatgtacaatttatcaaatgctatcttttagggggtagcctttccatcttgtgtaatataatattattattgcagatagcacaaattagtagttaacagtacacttttatgaatgacactttctaaatttaagatgccatcatgccatcattctgttctatcagtgctttggaagattgtgtggatatggcaagttttcctttaataaataaagattattatgtcttctcgtttatctggtgacacttagctcattaaatctttgaaattattaattttaagaatgtatataaaatgcttagcaaaatgtattacacagtaagcactccacaaatggtttctattattattatgtataacatgtttatagctattaatgatatttaaaataccaataatagtgtaattactacaatgcctactagtaatgaataataaatattaattataattaattgttttctcaataaattttttattgatgagtaataagaggataatggaatgtcataatacattctatactacagtaaaatcaactagtcaaaacatagcacaaaatacatttaatgtaaaataatttagttaaaatttgcataccatgtgattgtggaaaatgtctaaaaggttaactttaataatctagaaaagttttatgtttcttatagttctgatctttagttattttccaatgacagaagttggagattaatcatttttcttctactcctaatgttttctcaattggaagattaaagagatgtcaacgaagtatcacctgattatttatcaagtgattgttacagagactgagtgccctcaggattacatatctttttttttctctcccacaattgtcatgattactagccaaatccaattagagagatactagagaagtactgagtatttactgagtacttacacattgtatatgtaatacaggtttcatagataatcacctctttagaaatgactggactataaagaggttggctaatgtattcaagatcacaccaataataaatagtggagtttgattttaaattgatggctgactgactctaaactcatgctttttcacattgcttctttcactcaacctaaggaaattgccaaaagttttggtcagaagctaacctcactttggacttttgagaactccaagctgccacccatggcttcatatttttggttatttgaatctttgaggaagagctctagagatagagagaggaaagaaaggaagaatataaggaaggaaatggtgaacatttctctctaatttcctctctatgataattttacctttattcccaagaggaacaatgtgaaagttctactttcttgagaagtataaaactgccttggccgggcttggtggctcacgcctgtaatcccagcattttgggaggccaaggcgggtggattacaaggtcaggagatcgagaccatcctggttaacacgatgaaagccagtctctactaaaaatacaaaaaattagctgggcgtggtggcaggtgcctgtggtcccagctactcgggaggctgaggcaggagaatggcatgaacccgggaggcagagcttgcagttagccaagatcgcgccactgcactccagcctgggcaacagagcaagactctgtctaaaaaaaaataaataaataaaataaaataaaataaaactgccttgattaagtaccttcaaatcagtgattaactagcaactctagccctgaattctgaatcttttatttttccttcaaaaggtaactcttaaaccatcccttctacttaatctgcatattgtactgaggttatttatcttccaacgtttgccagttcccttaggaatacccttagcaaccgcctttccatacaaattgcctgggaaagtttaaggggatcaaatcccttgtaactaaacaaaatagggcttttgaatagaaatttaatagcaaattagattggcatcattacaggaggatgaatgaaacttttgttttctttacatttacagtagaaaagtcaactaactctccaatatacaatgagctggaagagagagattttttttggcttattttatgatgtgtcttgctttcaccacattctgtcaacttccacaacaaatttaacctccaaaacaaatcttaaacctggtctctctcactcactgctgctccatttttcctaatggagttttctcttggaagaaggagttttcatcagaagaaaggagtctcctccttctccaaatacaaactctacctacacagaagaaaaatgtatctttcgttctctgtaaactagggcttctacttttcttcatctctacataaaagtttttcaaacttcttccatccaccagtcctactgagtgagggcatcaaggacagggtttgcaatggtaacctcctgtttcacccacagacccctactttcctcccatttagctgcttttcacataacgcttcttttttctgtagaggttttataaaaaaagattgagaaaaaattatttctaaaatgtttatgctctatttttaataaaggaactcagtaaatgactaaggccaaaaagttgactcttctttatcagtactccctatcataataattctgcaaaactgctttattcttttctgaccttctctgtgctttggactttatgccatagttgagggctgtgtttcatcaatgtttcttttccctctgttcctcgaagcaacataatttgtttggcaaaaaactaagaatgaaatatctcctgctttatagatagtttttatacaacattctttgtaattgtgtaaagtctgagaattgtgtctaatgaaatatctggtaaaggcaaatggtaaataaattctcatttaattgataaaattaatttggtttctccataataaaagtatacttgtattagaagtctacttagtttaaggagtcacattacatctccatgactcaacattcccctttgaggcactgggggaaaaatccaatagtaataccaaaataaaataactttgaccctcaacaatgctatgcattgtaaactgatgccacccagaaagatgtaaggaaacagctggctgaaactacagttgaagcatctctggaattaacaaataaagccaatttctggataacaagacaaattgatatagtcagtcttcgagtgattgggaagaaggtgagaggtgaggttgagagatcctcaccatttgcctatataattaatttgccagtaatgctttcagtgatattcataaaggtttgaggtaaatattaagtaatcacatatagtaattatttattagtgaatgggtttgagaacagttggtagtaaagaaaatttctgtaaatagatataatttacacaaaaatatatgaactcttaaacaaaagatgatcttttgtattaactcgccaatatagtctcctacaattggtccttccaaacactaacattttatttttatatggatggctcttactgtaatttcgtatgtctttaaactttgtaatagttcaacgaacatcgtggagctcatagtgtgtgtgtgcaataaactatattatattaataataaatgtatatgatttattacagtatgtccttgaatattcattatccttagggactatacattatccttagggaaagaaaaaaatttaatgtctagattagttttctgtttattctttcattttcagagctagtgaattcatttaaattatatcctaaatattctttatcctgactacccacaactacataattctgtgatatgagggattagttccatctttattaaaatttcaacttttattttagatacagagggtgcatatgcagatttagtccataggaatattgtgtgatgctgaggtttggaataggaatcccaccctaattcctatggtaatgagcacagtacctaataggtaggactagtttacattcccaccaacaatgtgtaagcattccctctcctccacaatcatgcagcacctgttgttctttgattttttaacaacagccattctgactggtataagatggtatttcattgtggttttgacttgcgtttctctgatgattagtaatgctgagcgtttattgacaaccgtggcaacatcaataattagacacaaaatgaatgaactgcagtgatggcaatgatataaatgaaccataacataacctgtaactcttaaattccaaacatctctctctattctgcccttggtggcactggcaaatttgttcttctctctaaagttggaccagaaagaaagaacttcctgcttttgatgtaataataccaatagatttctaatttctttccatttaattttttacaataatatattagcttctttctgcatacatgtgctttcaatggtattgagctattttatttcgttttgttttttatgattctaaaatttctcatttttaatcttctaggctttatccttcctaaatatccttggaattgttattcattttgttactatcatggcttttttcccaaaggtatagacttattaatttgcataattaaggttttttattgttcattttataatatttgtccaaatggtcatttgtgcactcaaaaaatagttaaagagaacctataatgtgccagaacagtagaatctcactgttaaggagcagttgaaaggattactggtaaaaatatatagggaaaaagggaagaatgttacaaggagaggtacgggcaaaatgtaaagttagaaattcagttaaagagttagaattctcatttgttctaaaatactcttctatttgaaaaaactgtacttcagtcatgccaatttaatagttgactgttacactcaaagatcaactgagaatcatacaccaaaactccaagaagaggtttagtgaaatttcaatacctctggggaagtttttcactcttccttatgggttagataccttaaagtgttgattcaccaatcaaactgtgcaggaaatcaatcaaacatgcaggaaaacatgtctagtactttctgagtaaccaaagattagccacacaaacaatccttttcccactattgcttcactctttgccaaaatgcattcaggtgaataaactacaaagggatcatttaattgaagaatgtgcaacacagcatttgctgttcccctgtgtcctatatcagttcccagtccattctacaagaaagggattttcatcagagggtttctttgttccttattagaactcatttcattaacaatggaaaatgaagaaaattatttagaacaagaagtcatcagcacaacaaagtagcacatggagcaactaaggaaaattttgcagcctcaaaaggggaacactcatgaaggagtaagcatgttccaaccatatgttttcatgtaatagtttacaaatgtatccaactacataaaaactaaaattagccattttggcaggaaaaatgaccccttttctgaacagtgaagagtttagcatatttattttttatataaaaggaggggtgattaataatgttacaagaggccataaaatatttttttccttgaatttctgccaagctaagatgtgtagcttaagtcaactaaagtctaattcaaattttgcaacctttttgatatatcgggtcaagtgacatttactaagacacatagagaaatactgcatcctgtgtattcttctgaaattgcttacagtatgttctaggattgcattccaaaatctctgaagtgaatgactagggagacagtaaaaaaggactgggccatattcactttttttccttggaattcatttattggttgaattttaaacctggaaggttgaaccaaatgagtcttagaacccaaggtcaccgagttgtagagctattatgaattaacttaaaacgttttcagaaaattgcaagcttgattagcttgctatggctaaatatttaaaacttaggtttgcaggcttccaggctttttctgatctcaactagacatcggcagtcgggaaaagtgctcgttttgtggtaccgtaactactgccattctcctagacaaaacttcagaatatcagtatgctctatttctcacaaatgaaattctcacactaccacctacagccccactccaacaaaattttccttttttcaccctgagcaatttgttcattcctagattgccaatatcagttaagtgttgatcatattctagaacatcaaagtaattaacaataaggtgtgaatgaggtttacaggttcacaaggcaaatttgcattttaaaagaggggcttgttaaacacaaatgaagttctaatagacagagtgtgtgaaagatattttttctccaagagattggagaagatttctaatgctctttttcagccctgagatattaaggatgttgggaatcctttcccctctttagtctcttgtcagccactcctctttttaccctaccacctttgcaagtagagtatatttaaaataaaggatcatcagtgagacaaagaattagttgatagaaccttgtgcatacctgaaaatcttgaggcctcaaactaggtactacagacttaattctcagaatagtcaatttaaacaaacaaaaatggcatgcataacaggattagccctttctacctggttaatttggagggaaaatttatgagaacattttctataattacttcaaagttttaaagaaatgtctgttaaacaatgaaaaacagtgagagtctttttttaaaaaataaaattatttgattacattcatataaataaaaaactaaagacaccctccatatactttttgatgtcaggtagactaagagaattaaatcagaacatcattttttttctagtcaaattaagatttcagaaaagaaataggaaaatatcagcaaaaagaaagaggaacatgtctatagagatctaggaatctcttttttaaaatttagctagtaaaaacaagtaaaataaaataaaatctacctagtaattagaaaatctttctgccttacaaactagtctttctactccagccacttttcgcctcgtttccccttccttccatggaaaaattatctatataagaaaccctattttatatctatataagaaaaattattcttatatctatataagaaaaattatctatataagtggtatatattatactactaacaaaactgttcacaatacttttgtactttaaatttcagccttttagtctttggccttggtgtacaagatctatagtctttcttttctagatctttgcaggccatcaatgtccatgtagagatgtcacccagaaatatcatggatctgtgtcaaaggtgattacagttaaggacccttgctacaacatgcttggccaaatttttctacagtctgtaaaagtgtcatagaagttgaaagggaaaaactatcattatttataaagagaaataatagtaactgttaataacttacagcttttcacagcatatgtagttctttcccttctggtttttaaaatgtttttaaacatattttagaaagggttaataataatgttcacagaaattatttaaatttgcacaccgagtaaatagtagaattagaattcaaacctaagcttcaaagaactttatttcagatattgtacttctttctccaccacaaatcttaagggcatacgtgcttgcttgtataaaataaggctaaaaaaaaatgacctaaaattagaaatcctaaataattcatagaaattttgttgtcatcttaaaataaactttttctgattaaagctctgagattaaattaataatgttttagtttatctctttctctttatagaagttggccaatagagtctactttaatttgtcctaaatagaatgattatcactgtaaatggtgttatgactaacttttttaaagcttatatacagggtaaccccatattttatcatccaaactaggacacttttgaaagtgaaaatgaacactactaataattgtgactgggccattggaactgaaactggaaactctcctgagtagactgagaggcatggttatccataattctgagtctgagaatgatgctgttttgaatgaaaaagtccagcagaatgaaaatccttgtatgttacctataacttgccttcattccacagttcccttgaatttggttcttaagcgctataagcattattgaatgattcagtctcacactccacccaagagatagcagaatgctggtgcattcattcaagacctaattagaaggaagagtgccacctgctgagaatcattcaccccgccctgtccctgtagtttttggatagcttggtagttgggagcttccatgcaaatttagactattcacagcccaaactgttggaccaaaagacatgatctatgcaatatcccccagtaaacctgagtcaaccttcatagaggtctaagtgataagtattaaaccaacatttgaaatgtcaaatgggaaaacccatttggcagttaaattatttttataactgaccaaaataatgttgtaaaatgaaagcctcaagttagtaattgataaaaaaaaattaaactactaaaaaatagatttttgtatatcaaagctaaatttgacagtattaggactgtaattaatcttagaatatctttataatgggcaaaaaaataaatattcttttgaaaacagataatatttatgagaacctattgctatgtgccatccatgtgtcttgctatcttccaattctgcctatgaaatgctccattgaaaggtgacccaaaagtgttacatgtgtaaacagactatcagaaaatgatagagacagagagggagagagatatgaactcgtattgctaactattgctaaattattgccaactattgctaaattatttggaaattcttcatataagattacttatcatccacctaacttaaaaagcattttcccagttattataaagttcaaattaatttgatttgttcctaaaaaaatgtcagtttgcttacaatttaaacttttatttaaggtagaaagtttcccttctgagcaacaagttacgggctggaagtggtaaaaaaaaatctctaggagagaaaaaaaaaaaaactaatgaaattttgttgtggactagttcacaaagaaatacaagattccttacataatgcagccctttgtttgtggagcctctgacagaatcctgcagttttagctcaagctgaaagctgccaccaaagtcctccctaactccagacagctctgagtctttttccccacctcctgccataattactctggcttctgattaaatcacaccttatgtttaaggtcactaacctaaaatgacccaaagctactcatttctcttctcaacagttccccactacttacttgtaatatttggaagccttgaaaatagcttctgtcccaacttatgtagtcttttctccaaaagcaaatgcgataatagtttcctaagtcatgggttcaaacctcaggtgaaagattttagaaataatgagcatgctaaggagcctgtagcattggggtgaatcacagtcatacaacctaaaggacagagaaaaagtcttattgctggtggtatttgacaaacgctggttcctcacttaggtttcagtagaactgcatggtattgtcttcacatttaatagaagacttgtttatatcatctctcctttaaaacatttatcatttgggggcttattctactgtcttatttcttaaaatatgttgctattaattttggaaaatatttaaaaatttgcttttattgtatataataattgagctacattgtaacaaatttttgtcatataattttttattatagaatcaaattttccttttttgacctggtttcatcctcttttctgatactaatccaaattccccccttcctttctgtgtgagaatttcattacatataaaagtctagcatatttaatcaagatgtgaagcaaatgaatgtttatgaagtgccaagaatgtgaccaatgtctgttatctagttaggaagaacagtttggtgaattcaaattatgaatgttactattattactttggttagaaatgtgttcagcagcaggtagcaaatcctgacttaagtggcttaaacaaatagagattcagttttctcacctaacaggaagtccagaagttgagaggtaggaaattcctggtatatgataaagtctgtgctgatatctctgggattctttttgtctttctttcatgcttgtcactttatgatcacaaaatagctgccacaactccaagcatcatgtctatgttcaaagagggaaggaggaggaaacagaaggattgccttttaccttcctctttgtaacggaaaaaaaaagctttctcagaaacttgcctctcaagtggattgccacatagatcttattggctataactgaatccctaggccacccttctttgctagagaagcaagcaaattagagaatacacttgtcataattggcttataaatttcaaaactcatcatccagcactgagcacattgacactctgcacaaaatagaggtctgcggctaggaagaatgagggaatgaagtttggttagggaatagtgtccacttccactgtaatagtggggggaaaaggaaacagtgtgggctataaaaagtaaaaattaatttatggaagaagcagaacataagctggactataagataattaaaggaattcaatcaataaaataatgataggatactctaattatagaaagaataaaagcttaaaagcaggaacacatgttatatatttaagtggccactgtattgtgaattcctttattctttgaagataggaaataagtcttatttgtatcttattcctactgtctcacacatagaagatgtttattgaatcatagtaagtacatgaataatattctaatccagaagtctagacataatttaagaaatcatggagatgatagaacagaaaatttaaaattaggtctcctgtggaaataccaaaataaagggaaacactaacatagtctgcatacaccacagaacacttgttgggaagtactggaacctaggatgcctaagcaagatagagcaagtaatggaggctgaaatactaagttaataatttgaatttgatctgtgaaaccccaattatgtttctagaatcatgtttttttaatacacaaacaataatctttaacaagctatacagccatttaaggcataaagcctactgctgtctcttgctcactttttctccatgttcagttctctgtgatctccaggaaagctttggaaaaataaaaagtagtgtattggagatctctacttcataataatagtttacaattattcagtttttgttctactccagtcaagaggattccaatcaaaaggatcctaatcaaggggattattatatcattttaatgaattaatcactttcttgttatataatgaccttctctctgtctcttgtgacaatttttggctgaaagtctattttgtatgatataagaatagccactcttactagcttttggttatcgtttgcttggaatatatttttcccaccttttactttgagtctatgtttgtccctaaagctaaagtgtgttgttgttgttttttgttgttgttgttgttgctgttttaacagcatatggatagtcttcctcttaatctcttcagccagtttgtatcttttgattggggaagctaatccatttacacttaattattaataggtgagaacttattactgccatttttaaattattgtctggttgttttgtagttcctttgtccctctgttgctgtctttttttgtgatttgattatcttttgtagcaatatgctttgattcctttctctttatgttttatatatctactacaggtgtttttcttgtatttaccatgaggcttccataaaacaacttataatcatctattttaagctgatagcaacttaaatttgatcacatacaaaatctctactcttttacttctcctatatacacacttcatgttattggtgtcacaatttacgtctttttatactgtgtatccattaacaaatcatgtcattacttttatagttttgtcttttaatgtttataccagagttgaaagtgatttacacactatcattagagtactagaggtctctagtatttgactatatacttgactttattggcaagttttatactttcatcttttcatgctgctaatcaacatcctttcatttcagcttaaagaactttctgtagcatttcatgcaaagcaggtacagtgatggtgaacacccctctgcatgtttgtctaggaaagtctttacctcttctttattattgaaggatggcttttctgagtatagcgttcttggttgacaggttgttgttgttttttgatcttcagtactttgaatatgtcatcttactctctctttgcctgtgaggattctgctgagaaatttgctgacagtcttatggggactcctttgaatgtgatgagttgcttcgctcttgtttctctcaaaattctgtctttgacttttgacaattggattataatgggtcttggtgtagatctttggagctctttggacttcatgaatctggatgttgatttctctcccctgatttgggaagttccttaccattatttctttaaataggctttctacccctttccctctcttctccccagaattccctaatgtgtttattgattcacttgtttgagtcccataagtcacttaggctttcctcacttttcatccttgttttttctttgtgctcctgactacataatttcaaatgatctgtctttatgttcactgtttctttcttctgcttgattaggtctgcttttgaactcctctagtgaatctttcagttcaatttttgtattctccagcttcagtaattctattgggttctttttaatagtctctatctctttatttaacttctcattttgttcttgtatctttttcctaattttatttagctatctctcagtgttctcttgtaactcactgggcttctttaagacatttattttgcattctttgtcagttaattcagggatctctgtttctttcaggatggttattggagatgactctttgtgttccttgtagattttctttgtgatctgtatatttgaagtagcagctacctttcccagtctctacagatgagttttgatgagtagagacctttaccagttcatggtgcttaatatgagacaagatagagacatacaccttggggagcacaatctaagactgggggcaaggccctttacacttctttccttgccttctcaaggaaaaggctcggttctatgtttttttcttattatacagagcagtgccagctgcaaagggatgcctgctccttttagtttttgctaactatccctcagaaccaagttctaatggtcgcacaaggctcagtacaaggtgaaatggaaactggcttcacagagggaactctgaaatgctgagaataaggcccccttcattccctttcctccctcatctaagaataacctcagttctgccccattcctaatcttgcaaggcagctctaactgtaaggagttgccctcctcatttctttgctcctacgcatccctgggaacgaagttctacaggtgcgtcagtacacagtatgaggcaatataggaactgacccaacagagggttctctgagaggccagaggccaggaagccagatacacactccaatctcactttctgtggcacaggagaaatcatgagctgaagcagtcctctcagtgttgagctaagccagtctgggggaagtactgatatgacattctaacatgaaattgcactttttacccatgcaaatgcaactgcttttagtttgggatcctctagggtgcctctatttcttagctacaatctgaatatatttgcaaggtattttggttccaacattgttttatcagtatttctgtggaagaatgagaggtagagttttccactctgccatcttgctgacttcacccctattatttgttaagacattaattttacttgaaaaaaatatgccatttggactggctgatagacaaagtattaagatatgcacccctcagtaacttggcatttctaacatgcctatgggtctatagctatttaattatgtttacttgttactttaggcttcagccttcttgattaggttaggatacatcggattatttgagctgaatagtgcttcttattttgacagaagaatgtctattttgttttaattcagtgatatattttcagtggcagatctttaaaataactcttctaaaacttgtaatatttttagtattggacttagttaagttacttatctgggcctcagttgtatcatctgcaaaatgaggcaacaggatttaacatggtctctagttaattcgagctctaaaattgtgcgatctcatttgtcatttcaattcaacatatgttaacgaatggaatacttacataatgtaaatcaatgaggtagaacttgggtggatacagagatgaatgtgattccttcatgcaaatagcttataatttgatgccttcaaaactgagatgtgtattccccaacacatcctagttccttatgtttgacatgtcatttataaataagggtatattatttatttttgaagtggaagaaatttattcctttgttactatttttcatctctagatttggagaaacaaaaatgtggcctaaactatcattttaataatattgtgcatttgtatttcctcttcattgcaaagcatttacaagattctggaatcattttcttatccatccctaaagtagcccagtgcaagtagaaaaggacagttattccccttttagtgattagaaaactggaccctgatttttctggagttatataatatgccactgaatgagaacaggtaaaaatccaggaactctcatttcaagactgcccagccaggttcctttgtatgttacagtttcttttagtaagttctgcagagcctgattcctaaatcatctttcaaaccaaattctttcttattccctatccaaacagcagcatagccattgatgatttcagatagatcaacaggaaaaaaaaattgtagtgaaagaatagaatgtatgcagcaagaaatgtgctgtgcaagctgtgatacagtgtacaatgtttcagtctttagctggaattaaaattagaagttgaaaaaacttggggactcctccatcaatctaatctagaaacatttgactgtaggcccagcagcccacaatgaaacctgcccttttgctaggtgagaacatcattctgaacatgccaccttggaaactttgcatcagttcttggtatcactagaattttcctatcctgcttttgagaagagtcagtgtgagaacaaatatacttctttttacaaatcttgaaagtagatccttagaaataggtgattacatttccttcataacctaattctttctatgtagtaaaaaagtcatattcatgtttggtctcatagtttccttagtcaaaaaatttgcatctaaaagcctaggaaaatgtttggcctgcacagttgaatgtttaaacaggtgcgcactgcactggtctggctgaagaaaggtagtctcctccacttggaaaccctgacattaagagaatgattcttgtgccagctttcaggaaagcttgtgaaggaaaagttcaggtgattcttaagtcttattacctgattatcagcccatgtgcctcccttccattctgtattctcatgaagaaattgatttaatagattgaagatattattaaatacattctgcattaatattatatgtcctctttgaatccaagtggcaatacaatagaatttcattttataaataacacctttcaagcgaacaccacagggcacagtacaaaagaatcaaaatagaacacaaatgctgtaatcaaatgcagaccccaggaaggctgattaaaaaggcatgttgctactaagaacagccgacaggttaagtatagtgggtcatagcagaaaagccagcagaacagaagggcaaactaaaataaaatggacttgcctgcctgaatcacacggacttatgacattcctttgtcttcatctctttttgaactcaggaattgcaggggagaggggggtgtgcatgtgtgttggaggagagaactaaacatagggtcattaaatttatcctcagtactcacgcatagcacaaacaaaaggaaatcataaggataaccacctgcagctggcagagatgcctacagtgtgattgtgagacaacccaacatggcttgctttgctggataccactggctttaagaaaacacaactgtgaggtaacaagtagaccccttccataatagtgagaacagatagtgctgatggccagacataggtaaaaacggatgaatggtgagaaagatgttctgtggtcctgacctcagtatagtctactctctacaggactctcctcacccaattagcttttctgctctcagcctctcacaaccacgctccttgctaatgtcaggtgtttgtggttttaaactctacctgtaattatacagcaaaagcacctgttcccttcttaagggaattaggcaaaagtaggggaggtattttggaatatactctctccccatatgtaaaactagttctaacaatgatcacagtatcatagtttaccaaattggtcatttattgatgcttctctatttaatattaagagtagaacaatataggaccagaatcataagaaaaaatttctaaatatgtatttttctgaaaaacagtaacctatattttgctgggcacgtggctcatgcctgtaatcccagcactttgggaggccgaggcaggcggatcacgaggtcaggagttcaagaccagcctgaccaatatggtgaaaccctgtctctactaaaaatacaaaaattagctgggtgtggtggcacatgtctgtaatcccagctactcaagaggctgaggcaggagaattgcttgaacccggaaggcagaggttgcagtgagccaagattgcaccactgcactccagcctgggcaacagagcaagacgccatctcaaaaaaaaaaaaaaaaaaaaaaaaaaaagaataacctatttaagagccaccccacccctccacaaaaatgtcatagaagaagcaaatatgagttctagagttaattaaaaagaaaaggaaagagaaaggaaaaatgataatcgaggcaatttttacctctctcaaagcttttggttgtttgtaatgactcttctgaatacccacttagttgagattctggtgtgagatcactgatgcatacatttaggtcaatagcttagtacttctgtatatttttttcttaagtaaattataaacatgtaattaaaatgtatgtgggcagcacttgggggaaaaggttatgtacatatactagtactgtcactttaaaatattctattataggtatttatctactggcctcttatttttcttaattctgacagtatttgcttaactatgcaaagggagttggtttattagtaaatgtgaacagtagtgcaatcagttgaaaatactggattataatctctaatgtgagttatttcatgaagtgtgtgagcaaataataatatctgtgccagttaccaatgtattacctcccattgcctccttccaaatgtagttctccttgcctgctctgcaaaaatgtatctggattctttaaatattttttctttgctagctggtttgagggtgctttgtcagtagagaaggtagggagacgttgcagaaagaagaaattttccttcctggttgtcatgcactactttggcagcctcctgcaatgtgcacggtttctccagagcctggcttctacaacataagcaacctttacagcatgtagctcctgcagcaaatgcagctaacctggtacccagcagctgaagcacaggtagcttctccagtacgtggcaggtagcagctacccctagcacccaccatacacacacacgtacacacacatgtgtacacacacattgggcaatttatagcagagtgcctcagatgagatacatccctgtaaatagctttcattagcaccctagagtgcaggtgctactgatgcagctccccagcaacttctctgccatccaatgagttatggctgtgtgttgtccaacaaggtctggatcctggtccaggggtccaggagatttttgtcttgagtcctacaatgtctagatctcagtccagggatggaggagactcttccttggatatgctatcttagccctgcaaataatggctgttccttacatttgttattcttctattcttttttattttttaagacaaggtctcgctttgtcacccagggttgaatgcagtggcatgaacacagctcactgcagcctcaacctcctggaatcaagcgatcctctcacctcagccccacaagtagctgggactgcaggcacacaccatcatgctcgactaatattttgtagaaacggcatttcaccattttgcccaaactagtcttcagctcctaggctgaagacccacctcggccctaagtgctgggattacaggcatgagcccctgcgcctggcccatgttattcttatattctttaaagtattctttacttcttactagctactcttattactttaatcccgttattattaataatttaaactaactttctattcaaattgctatatggtctctgtatccaaacagggcctgactgacacatacccaaagaatattaaaataatctatattctttgggagtaggagaagataaatatgataagtcatctttttatagaacagattagtattggtacaatgtgccttatctagggctggctattagatggacaaaaacttttgagaatttgctgctgcactgaaaagtgctacaataataataatatggtgctatatattagtctaactgtacatacagtttaaatatcaaatttttaaatattttacatgattttactgagactttttaaaaatgtaagctatagtgaagcaaacaacaaaggctgtactaaaaaataatttgttgaccctgaaaagatgttgcaaaataataattctataatgtgaatttgtagattattaatgctaggataatgatagccatcatttattgagaactgagaaaatcctcagcactttatattaatttattggatcctcatattaattaatagaagtggatattattatcatccctattttacaaatgggaaaagaaagacttggcaaggttaaggaactggcctgaggtgatatatataataaatttcagagccaaaatttgaatctagatctgcctatgagccctgaatcttaaccactgcccactgcttccagaatactgacactgaagcaaatggcaagtcatttgtgaaaacaaacccaggatacttgtttttgttggttttcatcaaagatccagaaaaagaaactctgaagtatccctagaatgtatagcacaccctgagatatttctgagatagctaacctattactttttttttaacaaaatatggacaaactggatgaacatagtgatcaaatccccagaaccaaagtgttaacagtctatcaaaacctagcagcctttattcagagctgaattgaaggcagatgaaatattaacagcagctctagcagcataaaatgaaatatgagatcctgtatcagaaattattagtaacctgttaaaagaaatgctgaaaaatggcagttaccaaattaaaactgggaaacagagcccaaatgggaaatttcaaaaagtttggaggaaaataaatgacagatcgtcctcttggctcttattagtatgccatcctaaatcctgcttggcaatgggtggtggaggtgaaataagaactgcattgctgccagtgctggtcctcagatttgtagtcctaagtgtctgtgatggtgtctgggattgattggaaaagtagttagaagttggtagcattttagctttatctaagttaaagagtgtggagactcttattatgaaaggctttctctcatttgtgaattggcccctttgctccacttttggatggctggcttcctccatgccctgctacactaaatattctacatgggaaagctattttccttaaacgccttcaaatttaaagcatctatttggatatgttggtgtttatgactcaaaatatctagcatcaaataaaaaaagagagagattacaaatacaaaataccaactagtaaatgaaggacatatttttccattagtaactgagagcatagagattactatgagcggagttgttgagcagttgatgccaaagggagaaaaaaaaggaaatgagctatagaaccatagaatcttagtgttggcagagactatggagtttatgcagtcctaccctatcatttttcaatgaagagactgagacatggggagttaagggacttgacttgcccaagacacatagttgtttactgacagtcaggccaaaaacatttcccaactcccagcccggaactctacagttcagcatgctactgccgtcctctactgaaaattaacactaactcagcctggaacatagaagaattcagcatctgtggggagtgaaagaaaagatgaatttagagctggaaatcaatctgggaaaagaaaagaggaaacggatgatttgtcattgtgacttgttggtcaaggttgtataagatattttgtgtcagttactcccctgtgcattcctacaaaatacaatggaattattttgttataattccccagggtttatatttatatgtacaggttttatttgcttggtgaattctccatgtacaagtcatctccaggtgtagattggtttgtggatggcattgctattgaaccttgtcatttacatgggtctgactttccttctctaacagtaaagtatgctccaggggaatcttcttcatgggatactcctaactgagggtcagaagtaggcttaagatgtaagaattatcgtctattaacccttgtattctgataatctcatggaaaacttgggccatatgtgggacttttaatcaggctaatgaattaggtaaaataattttctttatttggaagcgcagagtaatttgaagtaaaccagtagcaaataagatacaataaacatgtcccaataggatcccctgtgaaatggcattctagcagtatagatctcctagtttagtcaaatatttttcagaacagagcaaccagaaatgagagaatcagataatatgatgaaaactacagatggaatgctttgcatgaaaagtgattatatacaagagagggcttaggagtgggtaggagtagagttggaaaagagtgggtaactgaaataagagaagataatgcttgaccaggtctagtaaaatattccctgccacaaccactattccatgaagagattgagccaagaggcctgaataaactaaccttaagttcagagttgccattattgtgggaggcatcagggagagcacatccggaattgtgttacacagtaatcactgctgggtgtcagcattcatcagccagatggtcagacccacaattaatcaattaggctgcgatgatcaactggactacgttttcccctttggtaaaaagccctcatcatgcggttaaggccaataacacttttatcctgttgcttttggagaagcttctaaaaattcctcttttcttttttgggcctctagttactggacaactgttaggctccaagttgctttgacaacatagatacccaaattcaaggatttcacataatagattttcaacatcctgtgtcttcaagtataatgtttaacatacccagacagaaataatctttttaaagcagcagtgtaagcagtgttactcaactgattttactagagtcttcatattgattcctctcaatccagtggaacaacactggagggggattctttcactggatacttataaagatgatatgatatgataatcaaataatatgaataataagcaatttactgaatgttcaccatgtgacaggtactgctgagataagggttaatgaacattgattcagtgcttacaatgattccatgaggatgataatattatttccatttcaaagagagagaaactgaggctagaaagctcatttgcccaagattaaacagttagtaaatatgtgttcagatgacttaataccctctgaaatgaaagctgaaagtttattttacatttccttacccatatacatctgtgcatctctgagggacaacatttaggaatatgtggtgggtcctcattactcctcttaaaaggactttaaagaaatattttactcgtgttcccgaagtctgttgctctccttctgttttccatgctgttttattctacatcatgtgacttgagattgctttcttccttctttatggccattactaccatttcctgatagttatcagtctccacctggcatcttcatctagatatggtttctctaagtctgttcagataccaagacttttttttatcagttgacttatagagcaatttgcctcctctgaaacaaaatgtctatcactaattttttttatgttgaaccttgtttttctatctattttattttccctctccccttgctatattacagtactactgcagagggagaagtgtttgaagtcctgttagtgggagcatcacttcttgatggaggtctaatggaggtctatgttggccccattgagtagaaatatggtcacagtgtcatagttcccctatgttttatcattaactggtaactctcttttctctaagctcttctctacccccacccaagctcaacttaaagagtactcctctttaaccatttcatacaggctatatacagacactattaacccaaatgtacacctttgagatatcagactcatattattttatgaaatatgaggcttttcttgctatttaactgcagtgccttgcattttatttgttttgctacttactgaattgggaaaacagtaccaaaatactaggatagtatataggaagtcaccatttcttaattcaagtttgggagcatgtggaagaaaagacatttcagaaaccttaatgagcatcttttatcctccagggctctaccagtgccctctttttctgactgtggtactctgttttgtccttgctatgtttggtaggcagcttttttttttctcttgatgcttctttttttacagtcctacaatcttcaccccagagctgatgaggcgctttcattttgacctgcagtatttctgtgtattgcagaacagagccctgccatctagactgcctttctgcttcattttgctcctgacctaaacccccctgctattccaggcctggcctctcatgaccagagactgctgactcatcctggcctgtgccaagctgtgcagtcgcttagtgatgtggacaggagtcgaaggactagaatgagatcactgaactcatttcacttgttgcttacggtacagtccagcatgagctggaaatgtaggaacctcagcctcccgagcagaaagagtaagtagataaaacacaccgcatcaccaagtcctcaacaagcagtagtcgggtggtgggtgggggctcgctctatcatggccgtggctagggcattctggttcatcaggagttttcctttgtcctctcttcttcctcttctccacagtcgtacccttccccccttccctgaacttcccttctgaaaatgtctggatggtacagcagtgatctgggcagaaatgaaatttggctaataagcagcctctgcacaaaattctggaacagtgacactgttgaaattgcttagtttagtttgtctactgggaactcacatgaacttcccaacagaattcaaggggatgaaatcttttttgttctgttttgttctcctttcctttttgattctctttttctttctgttttgagggaggtagtttcaggagacatggctgcattctggtgtggtgtaaagttttccgtcgggagacaataatgtacattcctctggcaggacgggatgggttttttttttttttgtttctcttactgttgtttatttataagacatttcctcccagttagtggaagttagatcgtaagaggctccagtgattttccttccacctcccctccctaatttctgtgcttcagcactctggaacactgtgaactcgacaaactaatcagagcagggagcttaacagccaggcctggacaccctcaagagactgtgtgctgattctcagtcgtcactccttggatcaggaaccatagtcctggtgagtggtgaggttccagaatttgatgtgtcaaggattttattcttggtgtctctaaggcaagcaggaaataaagggtgtttttaaaacaaacaaacaaaaaatacaattaaagaaatactaccaaacagtcaaatggaatgatgaagatttttagcgggcacaacttagagcactctacggacaatggcagagccttgaggctatgctcaggagcagcctgtaggcataggtttcatactgccaccgatggatgtcagccttgacatgcctagcaaacatgcttgttggggggaggaagataggtgagtgggggcagggaggtagtattcagggaggtagatgggggaagtgaaagtggaattaattgttcatttggagtttcactccaccagctttccatgcatttctgttctgagtatttacattatgctcacagtacttacatgcctagctaagcaggagagaatatctatagtggatgtagagcaaacattcttgctaatactgttctaaagatcactttgctaacaactggttgcttttaaacgttagggaacctccccacacccgacctttggaaaatatgatttgtcacaccctcttctttattcttctgcattcatagtatcaagcagaagaatgcaatgagaatccttatttggttcccaggaaatttatcatcctgccacaggaaaactaaatgactgtcctcacagtattaaacccaaatatagtattgtcctcaatttaagggacactgattgaatgtgctctgggaagttgtcgaaggaatggagtggggatggttgcatcctgtctgatgtgagactggcagaggagtccacggaccagctttcatagccaaaatgtgccttccacatccttcttaataactcatactctccctaaaagtagaattcctgttggaatgtgtttttatcctttaccatcaggtccctgcctagtttcttttctagaggtattccatcttactgggttttctcatcttctttctatttcaagaatctggcatgttcattaagcatggaaaaaacaaaagacgaaacaaaaaccaaaaaaacatggtggccataaaagcattcgattgtgtggcagcatctgaagtgaattgctttttggaaagagggggagtctttgatgtcgccaatatggttctcataggctgaaacttccaggaatcacaacccagcctaaggggcacttacttgatgttcttaaattttaggaaagagatgttattttattgttttggttgtccttgctgttaacacattgccagtagatttctcctagaagtttaaaatgctttagcaatggatgattttacatttaaccagatgtatattgtatgtgcctgttgcatgtactcttgtccaagtaggtacagcgatccagcgtattacattggtactcagctttggaattttgtttgctatactgagtgcttcagattcttaaccacagaactcatacatgctcatatagcccaagtttcctatagagactgacccctgctacagccttatcaggtttgtcagtggcctctaggacagagtcagcttcctatcacaattcctatagtttgtgaggcacattaaattcatcagctgtcattgtgatagaaaatagtctcagagttttattagggctagtatggtaaaagtttaatgttatattaatagtaaagtttgcctattgtagttagctcgtgttaggactatactatttatatgtataatatttcttgggtaattttcattagttatcttgttttctaaagaaaaaaagttgaaagggaaatggtgtttacaatacgttataaaaaatgtaactagctcttaggccattaccaccaagacctacataggaggttaacattcctcagttaatattcaaactgcccagactcccaggaaaactgtctcatagtttctggtagggatgtctattagaactgcgttgaaggcaagctagatctctaacactttgaaaacatgttattaatgactacatatgaaattatataagcaactttaagaagagaataggtgaaaacaaatatttaagagtattcccaagacatgacatttaaaaaaatataatctgccagagagatttttcttatagttgctaaggcttggagttccaagtggtcgtggaagaatttcatgactaaattgaaatatataagaagtcagaatttgattagtgtacctctgatacaaaggcaagacgatgtattttttgtgcttcaatggctatattaatattacttattttttcaataccttgatcataagccttcacaatgcactgtcaataactcaatttcctagtgctcacctggaaattctaatttcattaaattaatgaggatgcatgttgtgaaatgtgtattttcttgcgtgcatattttagctgtaagtacttcctatatgctatattcatttaattaggcagtcgcagatatacacaaatcaaattgctaaataacagaattgttgttaccccaataagaaattgttctttcttatttatatagaagtggtttttagtatttatgtgattcccctaagaaagacatatattttaaaaacttaaaaaggagttgattgcttgtatcatatgattgtatatgtatgttagcttataaatgcctacatatacgcacaaccatatatctatattcagctattaaaaatatgaccaaattctagccaggcttacttgcctttgatttcagtcaaatgttttggtcataatgaccataaatgaaatgtagctgactttttatcacactgacaacaccgaaagtttacacaaatatttatgaacagtatttgcaaaaagaaagatgtagttagctgataagtttggtaattatccttcagcaaatatacatattagcttatcaacctaaattctattatgtacagcttcaaaatattaattgctatatatataaaagtttaaaattaagtagaaagaaattaattgatatcttaaaattgagcatatgtttaatgaattcattttattttataaggctgagtacatatacagatgatcccattttagtttctcagctattttactatatgttaaatattttgatgctgtatttacatattagcatcagcaaccataatttttctgataacttttcaagatcagccaaatcatatccttgacaagtcacactttttctctgaagttttccataaaacccaaattaaaagtgatctgacactggtagcattttacaaatctaccttcatttagcatttatatatgcttttaagttgaagttttttctatatatgaaactgcaagtggttagagggcaggttttgtgttttaggtttgttaatttctctcccaaccagtgtcagattggctcagtctgagtggaggatcaatgaataggtgatgaatgaatggatatctacatgtcagtgcattgacagtgaatacatcttgcttatcatagtgaaagaaacagccggacacagtggctcatgcctgtaatcccagcactttgggaggccgaggcgggcggatcacctgaggtcaggagttcgagaccagcctgataaacatgaagaaaccccctctctactaaaaatacaacattagccgggcatggtggcgcatgcgtgtaatcctagctgctcgggaggctgaggcaggagaatcgctagaacctaggaggtggagattgcagtgagccaaagtcgtgccattgcactccagcctgtgcaacaagagcaaaactccatctcaaaaaaaaagaaaagaaaagaaaaaaacatgtccatgtctagaacacaaattggcagagtcttctatatctgagcctccttaactcccacattagatcttccaactatctgacagcatttccaaccatttactaagattgctaaggttccccacaatgcttgggtaatttctgatggaacatgggatcttcagtttgcagtagttccattcattttcctggacttatgagggtgaccgaatatccagcttggtcagctcatgtagtcagaaagtaccagacttacctataatgcatcatattaaccaacagtccctccagcttgtcaatacttgttcttcctttcctcaaacttccacatccgtggaggtcaggctgatgtcagttatggaaaggcatgaagactggctatggatgccctgtgaactagacaggagagaggcggggcagacatacagcacaataaagagcaggggcaagaagactggcagccaaatcatttgcactgtcttaacaagcactaattaaatgccctgtttgaggtaaataatagctgaaaatagcctactgcagttgtttctcatcaatgagtagagaaataggtggaatcacttagtgctgtttcattcattaagctgcagcacactaagccttcttcagaggagaggggcaccaagtcgagctagcctctaaagtaccatttgctaaatgcccattctagcaccctagatggtattgtgctgacaagaatcacatccagagagtaactgcatgtactacaaactgaccctaataaacaatttaaaaaaaaaacccaaaatattgtgtataataaaacatgctttaatcttacccattttcaattgtcaatcaacttagcaatccccaaactatatctcattctgtcccctaaaccaatttttttcctggagtttatatatatagaatattccttttcgtctctttattttccctgctcactctctagtaaactgaattcctagatgtaagcagccacagaaagaaaagtgattcacataatggataattaacccttgaacaatggaaagttaactctccatagaaatgccaaaaactgaaatgttttgttattgaatttattctcctttgggagttaacactaatggagaacatctccattagtacaaacctggcaccaaacaacctgttcatccttaagctatgaatgctgcactcaccttccagttcattctggcaggatttgtaacacaatgtcctcctgggtagtcatgtacaaaccactccgaagggcaaaattatatgagtgcctaatccacttgtgaaaattaaagaaaggggatcttttttatgaaaaacacctaatatggaaagacataaattgtaataaaaagtgttagcaccttgcacctcctgctaattgcattcctagtcaagaggaagcaaaattgtataacaaatgtcagaggtacatcatgaacaaagtgcaaagaattgtctgttcctttcaatagtgaattgaaaaagagtagcaaacctgtttaagctatgtatagtagctttaattttggctcctaacctttctgggactcatctatttcatttgtctaatgaggataatagtaacccattcaacttactgtacacagactgtactgtacacagactgtttcttcattatattcattaaagatggatttaacattaattcattcattcacccatgtattttttagtttaagaaatatttttgggccagatgcagtggctcacacctataatcccagcagtttgaaaggccaaggcaggaggatcccttgagcccaggagtttgagaccagtctgggtaacatagcaagatctcatctctactaaaatttttaaaaagtagccaggcatgatggcacatgcctgtagtcccagctaccgaggaggctgagatgggaggatcccttatcccttgagcccaggagtttgagcttgcattgagctatgattgcaccactatactccaacctgggcaacagagcaagactgtgtctcaaaaaacaaaccaaaaaaaaaaaaaaaaaggaaagaaacatttttgaatccctactctgtgtcagttattattcaagaagctaaagattgattcatttattaataaatatttattgaggaattcatattatgtacccaacactattccaggggttggggatactgcagtagatttagaaaaaaaaaaacagaaatctttgttctccttgtagttactttctagataggagagacagaagataaaatatatatatatatgtaaaatatgtggcattttatgataagtgctatggagaaaatttaaagaggagaaagagtgtatacatgtgtgtttgtgtcagggataagtttgcaattttaaatagggtggagaggtagagagggaagtcttcattgggggacagcatttgagaaaagacctcaatgaaagtgaagaagcaagttttgtggatatctaagcaaaagcattttcaacagtggaaccatcaagtgcaaaggccttggacatgaatgtatctggaaagtttgagtgacaacaaggaagtctgtgtggcagaatctgagtgggtaagcatgagactagtaggagatgaagtaagggagacaagggtgtctgatcacatgggccctaatatgctgttgtgaaggcattggctttgtcatttacaatacaaagatgaatacaacatggtctcaagttgctcactagaggagaggcagatagggaaacaagttggggtaataccattatgctaagtgccgtaactgaaggatgttcaaggaaccatggaggcacagtgagtgttcagctgaacatatcttggagtgggggatcagaggaagtttcacagaagagctgataaatccgtgctgggaatggaaggattttcccagatggtcagagggaggaagaacattcagtaagggagccagcaggggcaaaggcagttaactagaaatagcatggcagagctggggaacactatcacttatgtgtagtaggggagtacagagaaacgatgctgtagatgcaggcagggaacaatcatgttggaccctgattgccatgcaaagaagttttaacttcatcttgtggcattcagggagctattgaaaggttttaagtagagaaggttaatgatgaaattgtgtgatacaagatcaccctgtcagcagggtagaggatagattataggagtgggagaatagaggcaagaaaatgagttaggaggcaactgaaattgttcagacaggaaacaatgaagccctgaactaggacaataactgtgggaatagacagagaggaggagatatgttcaagagataggcaaaattgacacaatttaataacctttgggctgggcatggagagaaggaattttggattgctcccaggtttctgccttatacaactaagcaagaaaagctatgaggaggaagagtagattttggaggatgggggaagattacaaatttacttttgaaggtgtttaatttgggggtgttaggggagcatccagactggcagttggatttagtcaggaatgctggagatgtcagggacagactttggcagtcatctgaatcatccaaatcatggtaatagttaaaattatggagtggacatttctcaggaaaaatatattgaaagatgacaaaagggagaaggtcctttatatacagtgcatttctggaatggagagaggaagaggagcctgcagagattatcatgagcaactattatgtgccagtcattgtgctagatagtgggagaaccaagatgactggcacccagatcctgctgcagaagtgtccatagcttgtccaaatataagaggttcttattaccatcatcaccaaccaaaggataatgctaacagagggaatgcccaaacttaactaggaaaatcgtgcaaaatatttaatcggcatcaagggagatgattataaaggcaaaatcctggagagtttgctgcattcatttttgctatacacctcatttctgatctttctaaagcttgtatgtgtatgttccagtgttagcatgggttcaagctattggcaaaacaagccaggtgtaaattatggtagaattgaaatcgatagtgctttgaagtactggagtgcccagttcacatcagggcatgcgtctgtgttcactgaaacatggctatcaagtgcacctcgagtcattagatgtgttatccagtgaataacagcataatgatattttagcagagcagccttatgataaattctgctttagtgaaactccatatacagagcaatttctcctggccgtgtacattgcatggcaaagaaaggatatcctgctgcgtatcagaaggctgtaatttcatttaggggttctattgacatcgtaaactgcaagagcagagctcaagtggctatttaagtcataggaacttcaagctaaaattactgcctagtcctaatcgccacctccaggggactcctgcctatacatatgtgctttatgtttctatctttgtgtctataaatactcaatcactccagaggctgaggcgataagctgttctaaaatatgacaggtatctgtcacgtttgcagctgatacaggcttaagggctaaacgcagttatattattcattgacgatcaaatgataaaaggggccagaactccccaacaaagttcagagtacaggagttcttgtttctttgctttaagacattctctactcagtttaaagtcaggatcttccagcatgttgaggctagaaaaaaggaacttttacatttacctgtgcagcaaggttaacagcctatacatccttaccccaacttgcccttctttgccttgacccatgctcacttgtgaaaataatagtactgtagtcttggtatttagtaaggcattatatagtgtcccctaaaagtgattccctagatatctaacagggacattctattttgatatttactcaaactgaaaataggaaaccatcatattggagttgaatgcttatactctaaggaaaatacatttatataaatttgcaaattgtcaaatagtatttattaagtgatactttaaaattgactccaggaaaccaataggaaagattcaaagttaagtatgtttctccttagtttgtaattaaattttcatgttcatgctcccacatgaacaatcaactttgtcaaaagtgggcactacaggctgggcgcggtggctcatgcctgtaatcccaagcactttgggcactttgggaggcgaggcaggcagatcacctgaggtcaggagttcaagaccagcctagccaacatgatgaaacctcgtctctactaaaaatacaaaaattagctggatgtggtggcacacacctataatcccagctactcgggaggctaaggcaggagaatcgcttgaaactgggagggaggtggaggttgcagtgagctgagatcacaccactgcacactccagcctgggcgaccgagcaagactccgtctcaaaacaaacaaacaaacaaacaaacaaacaaaaaaagtggccactatgagattggacactacaatctaactttcttcagtcattatgctacttatgttttatttgtttgctcttttctgggcttgggattaatctgtctacatgctgtttaataccagatcccagcagaattatcatggttcagaaaatcccagcagaattatcagggtttgaaaaatctcagtaataatgggatttttcattcttcataaggtaactgcattttacagtcatcctattaacccttatgtcaccccgttgaggaaaggaagcttgaagagatagacagccacacttaccaggctgagactaaactttttactttccatattaccttttccattgttccagtgctcctcacaatactcaatttttcccttaaatagtacaattaaaaattaaaatctgtaagagccaaatctctgatatatgttaccccaatactctcattttatgtctaaacaatataatataccattgtgataatttttagaatggctactgctctggtaagaatatccttaaatcatttctcatatatatttctcaatatattctgtagacatctataagctccaagatgaggcagggcaactcttttgttggttacctgaatttaggcagtagagcagtgtggttaagagtgaagactacgtagattctacaacactgtaaccttaagaaaactaattctcatgactcagtttctttatctgtaaattaaggatgaggagaaggaggtgggggaccataaatttgtttttattataaaattactgtggggagtaagtaatctaataaatgtaaaatatttaaaccaatacctagtatataataagcactcaataaacagctgctgttatcatcattaccattatcatcctcctcatcatcactcactcttatgctataggatcatggttaatacttgttaggaaaaaaacctacatgcacagacaccatcatatgtgaacacactcccccgacctaggaatccttgcttgtcctagctgtgtaagctttacatacagattgatcttaatattatcccaagcagagaacatataaggaatccatgctttggatgaagtgagcttggtactgagtttacttttaccactggtttcaagtagctgatatatgatcacttctttggtgggcctcactcctattacctactcattgtctctggctgctctcatcttattacttaagtctttcatgtctattttccctccaaactgtaaattctgttaagcatggtctagtctaggtctgttgatccactggtttaggtctatagatcagtctactactattattcaataaaaaaatgtaaggtcaaataatgaatgaaggagtttccttctatttccagcttcttggttaggtcctagtcctggccacctgatgtgctaaatgctgacctcattgtacacctaggccatcctattcactatccccagttatcattcccagtcttccagtccaaactcttttaattatttttgtcttcttgcctaatacaaaacccttaataccagtacctagtccatacagtaggcccaccctcctatctgcttcatcttttccttcatggaactgtgaacaccacactagaaccatgtttgtatgcctttgccaatgctttctttccatttggaattagagctttaatcttacaggtgattcattattcatctgcattttaatctgatgcccttggctctaatcttgattctgatcttcatattatgttattcacaaacccttttctatatttattatattttaagaaaatacacatatatcaataacaaatgagtaaaagctgatatcaagttctatctacaaaaatcagcattaaaaatattcggcatactatatggtgtaccatttgttttgcctttcattatgcttcttatcttagctgcttgatgaatatcagagatcttataccctgaacttggtctcagtggccctaaacctaccctatccctaggctagtgctgacaacatccaaagcttaattaatgtcaatttttactggaaaatgttggcattagtgtagtagtatgtctaatagtgaatatcacgtaaaaaagaaaggagctaatagcaaaatgcagcattattgtcactggaaaagaccactgaccattacatgtggatatatatttattgtgttcctgttattgtcatcctcttttggacttttttttaataaaacgatggagaaaattttgttagaagtggtacaatttaaatttagaaataagtatgatgctaaacttaattcacagttatcacaacagttaataatgttactatcagaaacacaatacctgctcacagagagcttatggtttttatactcttattgcagagactagtaattagatcctaaaactaactggaaattaccaatctgccattatgcaccaacatgagcaataacgaaaggtagtgagtactacaagaatctgcattatggtggcctagaaaggagtatagaaggcttgattaatagtagacggagaactttagctgtagatgtaaaagctggacgttgaaagataatggaataaaaggtcttttggaaagaagcaaagatggtagccaatggtttaatatgggaaaacagagaagtagggaggatgaagaaaaatatcaaccaatggaaataaagttggtgtatacaggaagtagtgaaactagaaatgagagccatgttattgaagactaggatgtgaattccaaaaggcaggcagagtccagatttattttttgtgggtgatgagaacaatagctatcagacagttagaatgcaataaggatttgctgaataactgaaacacttacagagacaagcaaaaataatgaaaggcatgttttagaagttaacctggctatagtgtgcagagtagattgagagggttgggattagtcagagatgccaactgaggggcaatgacaataatttaagtaaagagcaatcaagactcaaatacactcatgactgtggggatcaaaaagggacatttcaaacaacatttaacagcactttccatgtctccttccccaccaaccccaatcctagtccaacctaggattgggtaattgtaactgtaaaatacctcctaaatgcctgatttcctttgccttttgatttcatgttagcaaagtccgttgctccttatggggtaagtccaggttgggaagtgagccctcaggctcactgaagcctccaacctgtgagagctttgttatagtatgttcctgaacaacataaattactcttgatgtttgacagcttgagcataaactcagggacacacagactcttctgtgttcccgtttgtgagtttctgatatgcaagactctgtgagatctcatataccatagagtgtcgatctgcacaggggattctggaggagcattcattctaggttcttaactgtaccaccggtatagataggactgccgcctgaaaatagagagaactcttcttctatgtgttctcccttccttcttcagttcaaccaaatcagcaccaaaaagaaacctcagggcagagcatatgctagcagagatttcaaaaccatcccagactcatgttatatgcttgagatagtcccagagatcccaaggatattctgggacttggttgttagaaacagcgctggttaacttgctttcgttgtatgcctaatccacccatcattgcctagcatgtatcctgttggcctttctttggacaattccaaaattttttgaaggataaaaatttgactaatatattacttatatattcaacttcttggttaaccaagaattgtgtgtacacgttgctatgttcctctcttacggcaagtgccccatttttatattatggtatttgagtgagtgtctttcactacttacttacccatagctccttctagataggaccaagctttacttttcccttcatcttctcgtttcagcaaaatgtatatgccccacagtagaccaccagtacacatctttggactctcctgatttcatggatgttgaatagggacaaccctttttgagttttctatcttgagttctgagtttctaatgtggaaaatacctcttaaatgccaacctctcctgccttcctaaccagtcaaccccagttacgtacaaggcctaattttgccctgcagttgggatgaaaaatgtgaaattgacagctctgcttgtcaaacctgtctgtctgcactacacagctcagagtagcaccatttagagaaagggtgtttggaaaattaaacaaggactgtgtgaataggagacctatcggcctgcaatggaatgacaggtttctgcccacaaactggggttaagacctgcatattgatgcttcttttcacccatttgtgagtaatgggtctcaccccattagtgggtgcatttgttataccactagaagctgttatgcattctctgtaagtctgtgtgagggaactgtagatacacataaatatgtacttgccaacagatctctgtatttatctgcctgtcagtgggagcagacagggcacagctctttgatgggcaagaactgcgggtcaaaaccatgttcttgctgctgctgttgctgcttcagctgctgctgttgctgcttttgctgctgctgctgctgctgtgattgccatggctttatcatttaagtcctgaaggaggctaggggcagcttgttagttctcgttctcacttaacctgggaggctagctctggtcactgacataattaaacagaccttgcaaatgttgactgctaattttcttgtggctagcagagatagactctcaaaaccatgctcacctacaatctgtaatctttcagtgttccttgagagtccacatacctctgctatcttcaaacactgtgtttaatgctgtcctgatgctgtctgatcctggtggattctgccatcaggtgtatttccggctgtatttcactgtctttcaggccctaccccattcaggatatacattgtctcccagcaggaaaaaattattgtgctccaagcgtctaagggaaatagtctactaaaccaagtgcttattttagcagcagttatatccctacaactctctacagcattgactttggtcttcatcatctcaatatgcaatatgccttatgaggaaaaagagtttttttcccccaaagtgaaaccatactaatgataataaactgaatttaagattactttgtgtataacagagcaaaacaagcagagcaggcttgtgtttttaatctaggcctgtttaccagtgtaatttgatagtgggaattaattgtgcaatttgtaatataactacagtacaaccaaaattaacgaatattctttatagtcattgctcctccatctcatgcttgtaagatggcatagaccattcttttcttcaaaattcaattttcctcaagattgtggaattgttgcaaaagaagtgacaggaatatttttgtttcttggttagttttcttgttatccatttaatagaagtctaactgaaagacacccagaagtgagctcatcttagatggtgtttctgactgtgcctttctaaatggtaagtggaagagcagaagagttttgtctcagaccaaatttgtaaggaaatagactgatttatcagagagatgaggcgatgtgaaaggtcttatttctgcctgtcaaaaaggtataagacagatgtttcactaggcaggacaaagactggactcaaatatggtggtttcttttcctgtttatttatgtttggtttactttttaaaaatcattattattgttaatatctctgtaatgcaaacatggcagacctgtttttctaaagatcacttccagtagagtagaaattagtaatctgatcaaccagattgacagacaatgaaataaaagtaaaaaaagaaaccctctgttacatgactaagcatatgcttttatttttgaacacattagaattgatacttgggaattacaggttggtgcttctgtgggaatgggctagttaacagccctatttgactttttgctaatcctgaaaactgagtaaatgtatcttaagctattttaaaggaacataggagtttatggtttgctatgagagtctgcacctgcttaagacacaccacagaaacattaaaatgggatgattcattaggaatgaagaaatgtttagctattgtacaaagttttctccagaacagtgtttcccaaacatccctgaactaagaatcatcagggtcacccttgaaatatgcacattcctgagtctaccataaacctagagaataagaaattttcacgaaggggccttggcatttggatctgaaacaagaaactagtcaattggtatgattagggaagtttgggaaatattgttctaaaagatttcttagagaacataggggaaatgatttattaatttactcatataaaagtgatcctatagttacatttcttcctatgctcttcccaggaattcagagccatttcaagtgagtaaagaatagtcttcttttagactggtgtttttgtttttttaaagcatccttgtttctctatatcaattgccttatgctttttactcccaacccttcctagtaaatggtcatcacataaaagttcctagattaaaaataatggatcctgagttctagttttggctagaacacagagctatgttaccttatatcagtatgtaccttctcatcacttcagttgtactgttaaagaattacgaggttgcacaaaatgtaattatactagctgtacattgttacgaatgttaaattcttctgcagccttgtttggggactgtaaccatatatgatgatttttgtgcttcatgagaatgtatgttcaggtttagatatgtccatgagtatttacagagtgttccctatttgtaaaaccaacttgagtcattagtttagtctaagataatcaactctttggaaaaattattttctggttctgggttgccagaagcatcttccaggagaattattgacaagggtttgtcatattggcagatacaggtttgtcacatgatacatactgatttattaaaagagtaagagaatgaggctgggcgtgatggctcacacctgtaatcccagcactttgggaggccgaggcgggtggatcacctgaggtcgggagttcgagaccagcctgacaaacatggagaaacgctgtctctactaaaaatacaaaattagcccggcgttgggggtgcatgcctgtaatcccagctatttgggagcctgaggcaggagaatcgcttgaacccaggaggcggaggttgcagtgagccgagatcatgccattgcactccaacctgggcaacaagagcaaaactctgtctcaaaaaaaaaaaaaaaatgaatgaacagttttatgctttttctagttattaacacttttaaatccatagaaatgattataacctcatattgcatattgagattattataacctcatattgcatattgtgaattataacctcatattgcaaattgagaattataaacttcaactaaatgttggggcaaaagaatttattcatttatttatttatttatttatttgagattgagtctcactgtgtcactgaggctggagtgcagtggcgtgatctcggctcactgcaacctgtgcctcctgggttcaagctattctcctgcctcagcctcccaagtagctgggactacaggtgcccaccaccacgcccagttaatttttgtatttttttagtaaagacggagtttcaccatgttagcaaggctggcctcgaactcctgacctcaagtgatccacccgcctcaacctcctaaaatgctgggattacaagagtgaggcacagtgcctggccgcaaaaatgttttttttaaatattcaaaaatagccatggcttgcagttgctataaagctatatagtaactccttcactgggcacaacagaagaaataggaaagagagaaagtgctgctccagaggttcaaaggtgaagatagagcagtgtagtggtggggatttatgtttcctaatctcccttgtcagcccagcatgtcttcagtataaatacacacgtggcagtggcctatgcactcattcacacttcagggaagcccatggtttccttttctcttccattttagcagtgggcagcctgcaaccttttgatcaagctgactttgtatgttacatgactgaactcagctatgccagacatccttaaggaagttgacatttgtgtactttgaaagaaaaaaaaagaaaagtgaatcccaactgcttcctcctgcccttttgattaaaagaacggtaagtcagcaggagaggtgctgcttttaacaagcaggggtgtgcagcaactgattggtatctttctttgaaaaaaagtagaaaagattgatgttaaacaacactaatcagagttgattacagggactgaatgaattcattgatgggaaagaaccatgcttccagagacaacaaaagagattagataattgtcaggggaagagtatttggaatagtgctgctcatctctgacaaccaggaatcagttcccctagctctttaaccattccttaaaataggcatatatgtgcaataagtacagttctctgctgggaacgttgttctcaccaagctcttcatggctgtctctttctgttcattcagatctccgccttcccttatcaccttatctaaagtagtgcttccatcacaatctggatgggcctgaaaactcatttcttggcattcccaaccatcactctatcctctgtctggaaccacctgcagttcatgaatggatcatattctgtcttgctctgtacttttttttttctgttacctatacctagaatccctttctatcctctcaaatctttgccttgttaacttcttccatcctttaagtttcagctaaggcacccactcctcaaaacttgttattgagcctcctcattaaaagtcagagtcccacgcctctgttctctcacagctatttatgcttaagtcaattacagcaggttattcaccctgtgttataattagttggttatttactttcctttctccccactagattgaaatatttgggggcaaaaattatgtcttttgtctctgcatttctaatgttagcgaaatacacagaacatacttggtgtttaattaatacaaatgaatgattgaatgaatactccctacttacctacctccatgttttaaaatcattgcctaaaataagaacagaacccagaggaagaaattcttacacaaaatgggtaattcactgattatctttttaccaaaaagtcatgggacaacggaaataggaaatttaggagctttcacccctgctcttgtctgtggcttctagattgttctagatggcattctcaatacaaacatgagaaagcagcttattgaattgaagctataatttctgactagtggataaatgtgttgcttattttacaaaaaaattatactattacatttattattaattataatgcactgtctttataggcttctcctttaggaacttctaagtactcaacatacatcatctgcctaatgatgtattctgcctcctgttaagaatgttatgcatactgagtacatcgcctaagtattatagaagattgataaatattatataattaataaatagattttacttatttttaaaaacaattttacacattaaaattcctcaagaaatgtgttttgttcttattacgtagcaacaagcaaacatccaggtcttctccactcaacacatggaaatcatcctaggcttttaaagggattcatcccaactagttcacagctgcaacactaatgtcattttatattttactggtaactcgattgagcttagaaaggaataactgtttaataacatctgaagaatgctacaaagtcaaagggaagaacctgaatcattttttgctccaaagacgccatttggaccaaactgccaagttttttttaccacgtttacccagatattggctgcaccggtagctaaaagttgggagaaatttatggagctcaggaaccatttttatcattgctatgctgttctcatttttactttaatatgagattatctttcatttagtttttaaatatatttgtttaaatatattttacatatattttaaatatatttgaagaggcaggctatatatttccagggttcaaaaatcaaaactatgtaaaaacgtcttcacttctccccatccacctttttctctttctattcccattagtaaccacttttattcattattttttttgtgtaactttccagtggtctttttatgcaaaaaaagtgaatatatattccctccttccaccttcttacacaaaagttaaaccactttatacactgttctcaatcttgtattctccagtatctcttagaggtcttttgctattgatacatagagaactgccttaatctcttttatagttttgcagtattccattatataaatgcatcatggtttattcagtcccgattgataaacaatttttttcatttcaaacaatattacagtgaacaaccttatatataaatcatttcatagatgtgcaagtttatctgcaggataaattctcagaaataaaattattgatcaaagggttatatgcatcttgaattttgaaaagttttgccaaattgatctcgacaggagttggatcaattagcagctccattggcatatataaaagtacctttttacccaagcctcaactataaaatagtgcttggttaagcttttggatttttgccaattgtattggtaaaagacggtatctcggtatagttttagtttgcatttttaaaattataagtgatgtcaaccatcttttttaatatgtttaatgtcattagcgtttatttttccataaggtgtctgttcatctccttagccttttctttctattgggttgttagtctttctcttatgtatttcttgctatttatacattaagatgataatccttttatctatgtgagctgcataagtttttcccacttttaaaaattacttatggattttttggccatactgaagtttgtttgtaaatataatcagatttactaatcttttctatgtagcttctagataatgagttataggtaaaaagtcctttcttatgccaagattataaagaaatttactaatgttttcttttagtacttttataatttcattttttatattgaaagatgtggttcattgaatgagaattttaatccagaagatattttaagggtaaaagaggatctgaggaaaaagaaaccatactgttctcagaacttgataagctgtggtggacctactataatttgcatagtacactaaatctcatctctttctgccagtagaatacaatacaattacaacgaaaatgaacaatctggattttaaaaataagaacaaccatgttcacccctttaagttattcacctttcctctttctgtgttgctctttatttatttgtttgcttatatctgtgagaaggccatgtgctagcagaaagagcataagttaataacattatttattggtacaaattctaggactctattcaattcagcacttaaatctcactggtagtaaaatataaactaacattaaatagtgcatagaatatagatggcccttagagtcagaagctctgaattcatctgctgtactccagagtatctctctctctgccatgatttccctttgtataaaatagagagaatgagattgttacttcagtaacaggaagaaaaaatacatacttttaatttaaaagtgctttgagttttatagaaaattcgtccgtgacataattagctgatgatattttcaaattatatagcatatgagtttttggggggagttttatacagaagccttttttcccccatataccagttaatatgtgcttaccttcctctatattttgtcttcagtttcaaaagcagtctttcaataggtatctcttctacatgctggagatacaacagtgagcaaaacaggcacattcaaataatccttgttttcaaagacctaacatttggagaggagaggcagaaagtaaacaaatacatacataaaaacaaagcatatcagaagtcagtaagtccactagagaacaataaagagggagcataacagaaggtgctgggaaacaccttctatcaaagaatcctaaacagttaggagtgagccttaaaagatgtgtaaggagatctcagagttccacgtatactataatgactttctgtatcatagggagaacctgaactagacatatataagtaaccaatcacttatgaacaatttggctttattcaaaatcaaatgacagcttatgtcaaactttctacagacatctcacatgtgcttgggatactcaccgctctcatctcagccagcctcagtgtcagcctttaggtaactctatagaacttgttattgagaatgaagggccaatgctagtgtgattaggaactagtgagattcttgttcaaatcatgtgagatgattaacttcaatagatgcagcatgataatctcagctggaggaggactcattaaatatgaggaccttttctctaccactgatctaacgtatcccctgtggagcctaaagaccagaggtttggtggattataatactcattacttaaattatgaaagctagagagttgttgactgtgctttcctcaaacctagattattgacagagtaatattccttggttggcactcgaactctcatgtgatctaaccctaatttaccttctcagttttatttttactactctctttcacaaaccaaataatctgcttttcccaacgtgtgatgacctttttgttcatgcagtttattctgctcgaaatgatttctccttgctctctatactttgaaatcccaagtatccttcaatacctagtttaaaacatcctcaatatgcaatcttcttccttagccatttctttaggccataactcatctctgttttatctagctatttatctattatctgtctatatatttagctatctattaatcatctatcatctatttatttgcccttttctgagatacttaatatttattgtataatgaatacatgaataaattagatttcttatctttagaaattcaagaaagatataagctgagaaataaaggacggatatgggaatatgggcaaacagtgaaatagagatagttttgagtagattctatcgtctgcttacagcaaaatattaaatataatgtaaatgcaccttgtttgaattgttctagaactagagagttttgtcttaaggactcccaggctgctgccatgtgcgagataatctggaagaaggtctctttttagaatttatgaagagtacttctgagctgatgtgttcaagctatatcataagggtgtagactgtgctgacctctctcacttgatacctgttggcatgctgaggtcggctcttacttcctacctgagctctaaagataagaaagctaacacagttaataaggcttttgtgcccctcattagttgaatctggtattttcaaacataactgtttttcttgaggtctgcgcagcagatggcttattttaaaaattccattctttctgaatattttccataagtaaaaggatgtccctagagaaaaaaaaaaaaactaaggcattaatttaagagtaagtcccagtacctcaagaaaaggcaagcaacaaaatgcagcaggttgttagtatgaagtgaattgtgtaaatatatagcttggcctcagttagtaacatgatatacttatatctgatgagactggagggagaaaatagcactttaagcccagagttgggtttagttatgagttgaaggtgaagttcgtactatttaaagtttcattttatttataggcctcactagtgagtgtagggtttccaagaaagtagaatacatattttctaactcagagcctttcaatgtaatgaatatgaggaagttaatgcaagtattattaataatatgatggaaacctgtaaccaaacatccagagtaaatagagcacagtgaatttatctgattgagaatctcacattaaaggaatttctaactattttatatcataatgtgtgggataaggccttcaagtgaagtatcatcattgcaaataaattccactagactttgtaaccagataaaagaaaaagaaagcaatcatctctggaaactgctgtagtacactcaggaattttcagaccaaggagcctgaggagagagaggtaagaggatctagaatgtgttaccaacccacagagtgctcccagtaaatctgtagacccagcctccacctgaacccctgccttacatcaggtcttcatctcaatctgttgggaatccttctctgagattttatagtgtaattgctctttgatttgacaacagaagttaagcctataccttttcataatcaccttatccagaacatatccattatgcaaaggaaggaaacttgtagagcaataatggtgttttattttagttgtactagatgctttcacttatattatctcaactggtcctcaagataaacctctgtgatgggtgctgtccattttagaggtgaggaaaatgaagtcttagataaattttataacattttatttggaatcttatgtgctcgctcgctctctttctcttcccactccccttcaccccccatagtattagaaaaataagaaagctctggacatggtttggacctcttagtacagtcatgtaaccctaatctagataataatcttaaggaagatttggaatgagtctgatgtagatttcttcgtctacttcttagtagatttgtgacattgggcaagtttttcaacatttctatgcctgggttttctcatctataaaatgggaataacagcaacaataataatagaggtatttttggaattaaatgcaaataatgtaagtaaactgcccaacctatagaaagcaaccaataagagttagctataaaaattattattgtcattattatcttcttttcaataacagcaacaacaaaggtaggaaaattctttaatttgccaaaaggcaaataagatacttaaaagatgaacagttataccaaggtattttgcatgaaagagaaggttcatacccttcttcagaaaatgatcctcagcaaagaaaatatcaaaaggtattataattaataggtcagttgcttaaaatatcacaccaagtatatcacctttctgtgtttttccttcaactttattaggctttgaagaagttctaagacagagctccttacagggaagcatctctgtgcattcagaagagaagaacatttctgagtcctcacgaaactatttcagtatgtatactataataattgtggagcatgaggccactgttgccttcaactccatggcttccatcatgaaatgccatgtactattatgaaatagcacagagatcatgtttttcagggggcaatagcagatgaataaagaacctgtgtaatttagggaggtgtcacatatagcatgctatttcaacaatgtcctggcaactaaaaacggtgtggtggtgaaggtgtctaagaaggtatatagcagaacaaatgacacataaagctgttttgggtccccccccgttaagggaatgtaaaggatctttcttacttacactgtacaaagcagaagagactttgcaaactggacacaacgcagcaaaaattcgacagtggttattgttgggtcagagaattacaaggctgtttgttgatatacttcatgcttttttagtgttttcaagtttcttgtaactaacatgaattactattacataattattttgaagatgcttccgttttgaaatatgatatattaaattttccagtatataaaaaaatgaagagaaaaaaattcctcataaccttaccactcggatatccctattggcattatattttaaacatgtttgaagaattcaaacagaatagaaaaatatgtaattagaagtaaaattctccatcttattttccccaaatacatcaaaagtatcttacatatacttccagaagaaaatgtttgtgtatatgcctatctatcataaatatgtgtatatatgtatactaattttctttatacaagagggattgagcatatataatgtcatatcctgtcatatagcacatttaagtctatttttttttttagcaactttacagtattttctgtagggtgtataacacagtttgtgttaaccaatcactgaatatttggtgaacactattacttatataatgaaggaaattttaataatctttattaagtgtcttctatacctatgtctaaagtaagccaaaacctctctgcttattatatggttacaggcaaaaatcagtatatttatgtgtatgtatgtgaaagttagagaagatttccttgaaccttaattttacagtataaaaattttacagtctaaaatgacagaatggccacaggcaaagtggataatgtctctttgtgatcctggctgaattgtggcctcacatggaagttggcttccttcttgagagttttaatgcagtcactgattacagtgtctgagattttactgcaatttccatttgagttaaaactgattttgtcttcaaaataaaagcctttaaagacagggaaaataattatttttcccatggcaggaaatctaaatcctttcattttatctcctaacataaaaaagaaaagtactaagaaattactgaaaagttgatgcaaaaacaaaacctctattgaatatttgagctatggaactttattctccaagtatatacctgctaaagtcccatgtatccaaaacagagagagccagatgtagaaaaataacttacaccaaggctttttgtgatgctagtaaaaaggcagctagggctttgtgaaaccatgttgctgcaggttaaaaaccaaaacagaaaacttacccatgtgcttttgaattggaagaagaattttgtttgtgtgccttggcatgatcgctttatgtaaaacgtggagattgtacaactctagtatagaacagtaaatgcacaaacaagccatattctaaccttgaaagtgtgactgctttcaatggcacagtgtatcaaggtcaagagaagctgccctcagcagatggaaaactttcaaagtaaaaaagcttcctttacgtttaaaatatattgagttacacatgatttctaaggaatacttggtcgttctagttataaccatggctcacttttgttatcatgtgtcaagtaactgactcgtatattttcctggcagatgttttctgtggaaaggcaggaaaagagaggtgaaggaagaaggcatcccttaatatcgtgcaataaacccactaggggtcactactttcagtaggactgtggagaagaaaatgtcagaggacacatttgtgtcttggcataaaatagatttcatgacaccttgacttttcaccttttatgcatatggagaactgcttagaaggctccaatgcttatctgtgcctgtgggcctttatatatatatatatttttttaatttgctttaggattgagtcgggaagtatttatatttgaactgtattttgctcagaaatagtttgttgaagctattctgtaacatgtatctcccttaacttttaaaataccatgcaatgaaatgattaaaagtgtttgagtgctttggtaatgcaatgcattcagaaggcttgatctcacatcctgtgtaaggagttatgattgagctttagagatgagatgccacatgctttcatgtcagtgttatggaagtgattttcttctttcttgtttctttcctgcctctcattctgtgttctttctctcctcttgctcttcctctctctcagtttcatgaaaattcatttatctgtgacatttaaagactctgtctgagaggtgtctggagctgtggccggctgtgtacatcaatagtttcttagaatctggcactctgtcaatatttgggggcctcgataaccgcacttaaatgcagagcctgccagccatcatgctcttagtgaatgaatggatattagcatgtcaaatcctttcacaactggcaacacttggtagacaatatataggcatcttgcatttgccttctacacctttctgtttgcctgcctcatttatatgatgtcatgtttcccattacgtataaaaataggaatcttcaaaaagcagtattataaaaattgaagtaaatgacatcattgtgcattctaagtttggtgggttttatagtatacatggtgatggcatataggcagtactttttaagattatattctaggtagttttcgtttgtttgattttgtttgtatttttgcttaggttatgatatttgggccaaaattgttgttgctgttttatagtagaaatatatatatggctctaaggccattgagaccttctaggtgaagtctctatagcttctgtgtgagcctcgtgttagagaaatttggctacacaaagaaaaaatattactgtgttggagagataaggttgttctctgaaacaaaaactatttacatcttcaaacgtttctcagttgtcctccctactctatcagttaaatgtcccatttataaattgaataattgaagcattattatgtcaactttcccatgaactgccctagatgatagcatattggactttcaaggtctacaagggagaccagtattacagcaacatgtttgttattggactgctgtgagctcttaacccatgtgtaaccttgaccgtatcttgtgacaagaatacatcaggaatatgaactctaaaggaaggaatgggaaagatgagagcttaccaaataccagtcttatcttagagatctgtgtccaacctaggataagcatgcaagactttgcccagtttttagtcatgctcagatcaagtaacccaggtttccagatatccaagggaataccctggaactcttaatggtccttggaggaatcattaaatggcctcttccctggactcattgaaccagcagtaactcctaagttggatggatctcaatcttgatttcaattcaggtctctaacatttgagtacttgcttttcatgtaggtgctcaggatctgctatataccatagattttaaggtgacttgttgagactgagaaaagaaatgtctaacgaacagtattaatgcagtcttaatacaactcaggacctatgtgacctttagtttctcatcagaaagggaaatttacatgttattgcctcataattatgagccagccttttgtagggctaacagtgcatttgaccagctataaatgtggcctccagatattatgtcatatttatagaagttattttttaagtccaatcagtcattgcctttggtagaaggaagttccctttggagtgttgtactaaactaggcagcatggatggacaaatgaatttcccaagggcttcaactactagaaatcatctggtaatataagggctgaccccaaagttttttaaatgaaaaaagaagcatgaaggttgaaagaataagaaaaaggaaaatattatataagtataaatggatttatgacatggcctgcatcaagagatttagtattgttttcctaattcttatacattagactaacatgcacagcttctaatgaagaaacacaaatgctctcctgcccctatctatagttagatccgtttttgtggtcccagaatgaaggcaaataaaacataacatacacagcattaaccataattttttacacggccaaaacttcacctcaagatataatagagaacatttttggtattttccatgggtggcttagaaacatgcctttattattgtcaataagacttacctgctagactaagaccttaccctctttttgctgtggattcagaattttatgactatacattatctgttctttattatatactgtttgttttatgctagacactaatcctttctggagcagaggaagaaacaggaatgagataagaacatagaattagcctgcagaatatattttaataatatattgggaggccgaggtgggcggatcacaaggtcaggagatcgagaccatcttggccaacatagtgaaaccccgtctctactaaaatacaaaaaattagcccggtgtagtgacatgtgcctgtaatcccagctacatgggaggctgaggcaggggaatcacttgaacccgggcggcggaggttgcagtgagctgagatcgcaccactgcactccagcctggtgacagagcaagactctatctcaaaaaaaaaaaaaaaaaaagaatatgagaaattatgtttgcttgtagatcactatagacacactttggaactacattttaatttatgggttgcaatttaaccatctcttttcaattaatactaaaatgttttttgcctaaagtaggcaagatttggattcttcttctttagaaatcctagcaacttcctcagctttctttagtatatactttgtctactaatcacatagtaaagtgagagaaatgagaacagtgggacatatgtgttgatggaatatgcctgattctaactcagcaaggaaggcacatgtattgactttagccttgactactcctactaaaaaagaagtagctgtctgactgtctggcaggaaatcaacagaaaacttgaaggagttgtttaaaaggtctaccttaacacaatgtaaaatctactatattacggagatgagttttgttgatgttgctgtgatgcctaatgataggcaccactcaacagagagacccacacccttgctccaaaagacactagaggtaaacagactatctatgaccagttatatgtttttagtcacagagacacctttattccaaaatctcctaggccaggcgcagtggctcacacctgtaatcccagcactttgggaggccaaggtgggtggatcaccagaggtcgagagatcgagaccagcctgaccaacgtggacaaaccctgtctctactaaaaatacaaaattagccatgtgtggtggcgcatgcctgtaatcccagctactcaggaggctgaggcaagagaatcgcttaaaccccagaggcagagattgcggtgagccgagatcacgccattgcactccagcctgggccacaagagcgacactccgtctcaaaaaaaaaaaaaaaaagaaaagaaaaaagaacaaaaaaatctctccctctcccctatttttgggccaataaattgtcattcttctttttagtttatgaatttatagtgattcccaccccgccttattgaaaaatctacttgccaactttcatctcaaaacgaccccaagtaagaggtgttatcactaataaaagaacgctttttaatacctcaaaatatctacttttttagaagaggttgacactgaattttcaattcacatatcccaggggacagtgtcgttgttccttttggaaaaataagcctttgagatagctgtacatgtctccataatgaaaatcctcttttactcaataattataaaacatacacttttcagtttttccctatgtcatagtggcctggaagctacctatttaaacagccgtcatggacccagcaaccatttatatgcccagaagtaatgaatgttgatttatgtatgtgaatctgttcaaattatatactaagagtagaatagattgtgaatgtataagaatagacaaggcaggtagaaaatgtataatatagatttttatagaataaaatattatataaacaaaacactgggcaaaaatggggaaaagattggacaaaagaatagattagaataagtaatctctttagtggaaggttctctataaacttaatagataagccacttattaaaaacattgttatgtttgtattcaacgaaatttaaaagtaagttagtatagaaattcagactcttgcacaaatggtgctctatggctgatcacccaggaagattgccattatacttgagttcagcttactagtttgtggttgatgatactttcacatttaccttcattgtctcttttctgccaaaaggaaactcactatttgggaaaatgcacttaaatacaaccatttttaataattctatcctgcaagttatagacatagaactctaacttttattccacgaaatatcctaggagagacctaatgaaatcgatttgcccatcgtttgatgataccaggacacaacgccttgataatatattatcttctttcttagcccaatgtaagttttgctgaactaaggcaaagctagtattatgatataactccacgtaaccagcagagcctttaattctgtctcaaatgaccaaaaaataaaaaattctaacctatttattttgtggccagcacttcagaattctcaggaaatgattagtaggagatgagactcagtattgagagatatagaagtgacatgctattgaggtcggtcctggattctggcttgataatctagactacatacatgttttccaatattggcaaattcagtgtattctaaattattgttagaggcatttcaaaacctcaaaatgaaattaattttcatttaaaattatattttaaggaataggcaaggaagagtgatgcaaaaatcacattaacaacaggataccagaacttctaaatggttgcaaatcattattttagatgttgaggacaagaaatgcatgctttcaaagtgcaatgcttttacgtacagtgtccaaataacaacaatttgagagataagtataactaaccacttcagagggaggactgaaatgaacactcagtaaaactgggaataaacaaaacgttgttaaataaaagttattgttagttttcttcaggagagaaagcagacctcaaaagtggcatttcatccactacttcttcatcacttgtatagagaattccatatagctgtattagttcacctatactaatagctggtgagctagcaccaaacacctgagcatgcttatccatgtttcttcttttgtgtgggattgtcttcttttttccacatatttaagactctgaaataatagacatgtaactttgtttcttttgaatcttataagtcttatatttttcattatccgtgatggtttggtaaatgtcattgatggactgaaaataaagaatgacttcctctgtgggaaaaatagcatctagaagtagattatagaaagtttatcaagagtgtgaaatgtcaaactgaaattttaaaatagctataatagtggaatgtataagaagcatgccaaatatagatatttctctgatttcttatgagcatagattacatacttattcatgcttgttctgatttcagataatactgaatacaaacatcttagagagacagaattatcaaacccctccaaacaaatttaaatttaacattttggaaaaaaattctcaaggaagagtcaaaaacattgactttttttatcttggaaaaaggaatgttaaggtagagcgctaatagtagctgttaagcaagtgatgagaagtgggaaacaaggctttctctcttttcttcactgaggtctgataatgacaaaatatgctgcaacagaaaatcttaaggtttgataatgagataggttattaatagtgagtgctaaacactgaaagggaagttgtgagattatcctctatgaagctctttaaccagtatagagtcatatctttctggaatggtctgcatgtgtcagcgagaagggaagaaatgacttctctaagtggttcacattttccaggcactttctccttacctttctttttcttaaagccacagttactcagaagcaaaaaaactgccaaaagttaccaggacttccaaatgtgcttgacgagggtgaaagcaatagaaatgccaccaacattttaatggagattaaaggatcactcttaaattaccatcatttcctataataactcatttactacaaacttgaaattgtggatacagctgctgaaatttttatttatttatttatttttatttttgtttattttttatttatttttattttttattaaataaattaataaataaatttatttatttatttttattttttgagacggagtctcagtctttcgcccaggctgcaggctggagtgcagtggcaccatctcagcttcactgcaacctccgcctcccaagttcaagcgattcacttgcctcagcctcctgctgggataacaggtgcccaccatcatgactggctaatttttgtatttttagtagagacggggtttcaccatgttggccgttcttggtctcaaactcctgacctcaggtgatccgcccgcctcgccctcccaaaatgctgggattacaagcgtgagccttcgcacacggcctgaaacaatttataatacttgtgaagaaagcgattaaagcttattgttcagtgctttgttaaaaaaatatgcagtagacttttagtggaaaatttatcacatttcactttctgtttgttgctgtcaatattaaaagcaaacccattaccaatatactcagaccatttccttcctatggcattaagtgaaatatttttgattcatctccaaaaatatgaagttaacatgtgttggtggtatttgctatgaaataaggggagaggtccacagaatgtaattatggaaaaatataccatcaattcaaacacatacacatgcatataggcatatgcatgtgcgtcagtacatatttacccccaggtctttatacttacaagcacttttctaggaactgaagctgcataggtaaaaatatgtttctgttgctaaagagtgttcacaggttggtgggaaaaatagacatgaaagtttttatgcaaaaagatgggtattgaagtaaaagtatatgcaaggtgttatgtaagtttgcctgggaaagttcttgtttaagtctgtagtcttggtataattatttataaggccctttcactgtcaaaagtgtccctgcttggacaataaattaaatggtcaatctataaatagccatatcaatcaaagatgcctgaggttgtcaggaaagattttccacagaataggacagaaaatcaaagagattaagaatgctttgccaccagtactacctgcatccaaatggaaatgagaaatgggtgtgactggcttttatttctccccggcttgtcagagggatagagtgggaatttaaatcatgttgggtgaggagaaagggacaaggcaggacaatctaaacccagttgttggtatgtaatacacacaagggttgtcattaaatgagtcattaaactaataattttctgaagctctgaactgaaatttagggtgagaaagaactagacgcactggggggattttagaaagatagattatgatatggtttggctgtgtcctcacccaaatctcatcttgaattgtagttcccataatcttcatgtgtcgtgggagggacctggtgagaagtaattgaatcatggaagcagttactcccatgattttctcgtgatggtgagtgagttctcatgagatctgatggttttataaggggcttttccccctttgctcagcactcattctctctcctgttgcccggtgaagaggtgccttctgctatgattgtaagtttcctgaggcttccccagccatgcgaaactgagtcatataaacttcttttctttataaattacccagtcttgggtatttcttcatagcagcatgagaacagactaatatggattaagattcagcataaggaagaacagaacagaaagaagtatcctacagtggagagttccgtgccctggtggtatgcagcagagactgaatgatcactgtgagcaccagattaagacccagaccatgggttgtttaatgttctttaccatatttttgccctgggatcttaggattcttcaggcatggggatttttcagtagctattaagaattctgtgtttgggagacatcaagaagttaaaaaaaattggaaatactataagaaaaaattttacataagctaaaaccactcttgtgacccactctgagcatacactaaaagagaccagggaatataatgcagatctcactgagtttattatttgccacccatcaaggaaaggagccattccacacataatgttcaggagacattcctcactcaggtttccactggttggacacatattcattttaagactgagtaactgcaaatgcttgcttaccagcttgatttgcatagctctgagttacatacgaatgggactcatggcaaagctatcattaaagagaaacaaagcagaagaccgaacaaaggatacattctgtgcaaagtttgaagttgagactgtttcagtgatccttgtcatggtaagaaagctgtccgccccttcccccacctaaaacagaatagcagacaagtgacaaaagaaggccccctggaagtaatatgggagcaaagagtaggatgaactaaaggctatacacatgaagagagagaaaggaattgtcatggacacaaggagatgccgccaaacaccctccattcatagcacggagatatgtgattaggttagaatcacttacctcttccccagtgcattaaagtaggaataggtcaggcctggagaaaggaatgacatcttgatgaaactcagctttctcagaggcctaacaaggatggcaatacagatagagctagaatcttctcactggcccttttgtatcaaattagtgaattcctgtatttccagactgaaatgttttccagtaagcaagagagaaaaggcttctggaggcagtggaaatgactttcgttcttctatggttaagagtacatgggctttggaacaatggaaaactggtttcaaatctctgcagcttacatatttatggtgtgaagtacttaactccctacattttagttctcacatctgaaaaaatattgagcatgcatatgccatagaattattgtaatgattaaattacacatgtaaattgtataatacacatagtgtctggcacaggatcattcacaataaaatttttattcaatgagtactattatcgctttctgtaacattctctagtagccctttctaagctctgcttcactttacatcattacttttgtctagtccttgacattccacctgttccggctttgacttgcttccccagatagtgtacatctgtgtctgcttcaaagcctcattctgttatgttctttaagagttatacctagaattgggccaggcacggtggctcacacctgtaatcccagcactttgagaggccgaggtgggcagatcacctgtagtcaggagttcgagaccagcctgtccaacatggtgaaaccccgtctctactaaaaatacaaaaattagccgggtgtggtggtgggtgcctgtagtcccagctgctcaggaggctgaggcaggagaatcgcttgaacccgggagatggaggttgccgtgagccaagatcacaccattgcactccagcctgggtgacaagagtgagacttcatctcaaaaaaaaaaaaaaaaaaaaaaaagggagttatacctagagttatgtataaattcagtaccaacaatgggcaaaaatgtaaaattgtagaaagaataaatgatgtttagagagtatcattcttgttcttgagtctgaaggcactcttcatcttttgtaatattgaccctgagaccatttatgtcagatggaaaggaacatgtgctgttattttctaccttcgtcccaggaggttaaaatgacttgaagaaactcagcaacttcaggtgaaggacctaatgagaggatcttgaattcttgatctcaaatctgccagggtctccattcactattaaaaagtcagcctagtgaggatggccctagttattaatttgatattatattactttattttaccacagttaaaatgttctctggattagtattgaccctatagttacccacaaggtatagagagaagtcagtggaaattctcttctcaacagctaaagtggtccttgtcaccaaaacagtcatatgctaaatcacatgtcagtgtgacatcgccaggccttagcttctcaggatctacttgttacaagtgagtttatgtggcttgaagcatatggccttgatatatgatcccagagcaaaagggcaaggtatttcaagctggccataattttattgtctctcacaggcttgctttgtagtcattccaataaactagatgggaaatttttgatgctccaagctatccagtcttcaggacttcatttcatgattcagagtccagctaaacaactcaagagtgcttttgtgtgacactgaccacaggaacaaataattgcttagtaattctctttgaggtagaaaattctaaacatggaggaaccatttccccttaatgggagccagaaatcctctaagtgcttgaaatggcattcacaagtctgaatggtaaacagataaaaacaggagcgcaccagttgcacaaatgacttgcttgtcacaaacttgtcattgcagtaatctaacatttctttcacagagcccgatggaaagtatggaacaaacaggccctgctgacgttttggctctgctaagccttcctccgagctaaagcatctgcagcatcttcctgttctagaccctttatctgctgaagttagctgatactgtacatgtcagagaaatgtttgactattgcattaacaagttgatgacaagcaagttattcctgcaactgaaatactgctgcttttagcaggctgccattttgaccttcattttattatgcagaagaaccctaacagagcagagcactggggagaaaccagtgtggttgccccaggcccatacaaagaccacctgcctagggattaggtatagtggtacagggggcataccaggcaggtccattagaagtatggaagggattccttgtaaaacataaatgtgaatacattagacggtttcaaagattgttcttgcaggggtaaaatgaactgcacagaaatagatttcttcctgcatcctctgaaccccacacacatgtgcacatacggctgtgtatgctttatagaatgatatgagatgggaaacttaaatgaaaattgtatataccagctctacacatagtttttgtcaattgttggagttcctgtcatcagtagcttcccttaacctcctcctcactcagcataatatctggagttatctaaacctaatcagacccatgctcttgtcccctcaagagcactgttatctccattagcctcctcatagaaaatttaagcagccctctctaggacatcaccagttcatttccaacctcagctgccagcagggagtactcctacactgtgtaacttcagcctctcgccgttctgtttgaggaaacttcctcccctcagggacccacacttggggttcctcgagtgtgtagtccagagggtcccagcctttaacaggagccttgcctgtaagagaagccttgcctattgccccctatggtgttttgcctttgttgatgccataggtatatcagcacttggaacaacagagagtttgccctaagactttggccttttcataaaactgagctgctcttattcaccaaggtgtcagctgccttgtattctttctagacgcttcaggtctgttaagggtacactgatagtgttttgtctgatttaaatattgacgcaaaaaacttgcattctcgtacttattttctggctggtgccccaggtactttcattttcaaaagttctgtgtaaaaatgataatcattgtccatccatgagaaccacatttcttgccaaagtggtgatgaggcttaactttcttttagacttggcaaattgcacacattactgtctccagggtgaaatgttttactcccatcccaaatatctcttgatgtaatctataccttagctttgtggaacaactacctcagaggacaggtgggaagggtgtgagaagagagcctttttttttttttaacagagttagggatattgtccctggaaaaagaggtgaagatagtttgaggcagcatttaaagtttctgcaaaaggaaatacgtgaatgaacaatttgaattgtaaatggaatttcatcagctttttctttctaaagttcctaataggatttccataatgattttgtgttttccttcttagtagaacttaaatggcaaataaatgatacactatttttgatttagaaaaaaataaaaatcttttctgtgggagctctctttttaaatacacattaggggatagataatggcaaacaaaaaaaagtctttcttcctattcagatggatagctatcagtgtgtgtatgtctttttaatatttatttatttgcttatttgatcatttatttgtctatttattgtaaggaaattaacaaaggaaagaagaaaaacacctcatgataaattaatctcattagatacgtagaattttagggctagaaaggagtttgatgatcaagctatgactttatatcacactcactttagaaatgtgaatgtatgtgaattttgagacccaaagatgtttaatcagatgaaccaagatgcgcaataggattgtggcagagctcggcctaaaactttcatttcaggcaatactccctcagagattacattacattttttaaagctttattttaaacaaagacagtctcattttaataatttgcactgatgtgcttaaatctaatagaacatttgctattatagtaactgagacctcacattggttacaccaactaaggaatatacatttcaacagtttgaagacatttctttctaagccgtttcttatttgcatagggtaaggaaccttagttagttcaattaatttttatcttttgtaagatttcaaagaaacacttgcaccgttcctatttacctaaaaacatgttttttaaatgaatctgtttctttaataagtattcacttaagtaggtcatactgtaacgttcttggtgataaaaaatcttttatcaggataaaagaaatcttatttttattcccacttttagccatgtttgagttggtccttgtaattgttggtttcaacaaaacactaagtcaaaaaatcaatgtttgtgtttatttttgtttaatacatgagaaaaaagtccattgatctttttgcagttatgatacataaatactgtatttttcacttatgcgaaacttaatttttgagggtttcctttttgtttcatttctctgtttcacatttttcaaacatctgtaccatggttagtggttagagtagcagtggctggcacttttcttccacaatgtgagagaaagaaaagtgactggaataaaactttgcttttcatatggttgacttgaaatgcagcattgaaaaggtatcatctctttcttttctgaaaccagaggtgaaacccgccagccaatagcagtactgataccaaatcacctgttgattctgttaattcatgtaagtaaagtctggcaatgcatgcctcacttcatcaactgaaaaacctaaatggatgatctttgtgcattggcagcatctgtctatatcaacaatatatccctctggtcactcacttaaggaagcctgagattctatagtcagtcaagaagtgaatgaaaacttttgcttttgattcaacaaaataatcactttgtaggcatgtttggctgtgaagtgcttactaatattgggctctattatcagagatagtgaagagaagatgacactagtgctttcctttacctcgattaattctagttaggaaaatctatggtgtttgccttatacattttctaatgtaaaatatttaaaacacaggctgggcatggtggctcacgcctataatcccggcactttaggaggccaaagtgggcagatcacttgaggttaggagttcgagaccagcctggccaacatggcagaaccctgtctctactaaaaatacaaaaattagccaggcatgatggcacgtgcctgtaagctactcgggaggctgaggcaggagaattgcttgtacccaggaggcggaggttgtagtgggctgagatggcaccattgcactccagcctggtggacagagtgagactctgtctttaaaaaaaaaaaaaaattaaaacacatggaagtataaaggataatatgaaatacaagaatccagaacccaggttaaacgaagtttaataatttggaacatttgtttctgaacctattttttattattttattataggttacatacagtgaattagacaaattaagtgtataccttgatgagtatacatgtgacaacacccaacccaaggtgcagaatatttataatacctaagaagaatcctttgtatgtgccccttgaaggtgaaattttccaaagttttaacaaaaggtaaagaacaagcaaaaccactgtaacctctatcatcatgaattagttttacataagctatatattttggtttatatgaaatgtattcttctgtatgtattactaaaatttatttatcaattctctcattgttggacattattttaattgtttcccaatcacaaacaagaccacagttaacatttttatagacatatatacatagaagtagaaatgctaaactttaagaaatatgcattttgaactttactaggtattgtaaaacctccctccaatgtatttgtaccaatttatattctcagtaacaatctatgagagcttctccacatgcttcacaacatttgtgatggtcagactttttaaaatttttgtcagtctgatcggaattgaataatatctcattaactttttttttttttttagttgtaagccattgggattttctcttctgtgttgcctaatttgcatcttttgtccatctttctgttgggttatttgttgtgctgttgttattttggaagagttttgtttggcttgatttggtttttggtattagttgttgctgttgttgtaatattctggattttcatattttgggccatagagattacaaagattttttcccaatttgtaggtgcccttttaactgtggctttagtagtatttgtttttataaagcttttaatattaactcaactaggcttattgatattttccttcataatttgtgcttttatgtcatttaagaaatcctttcacatgccaaggtcatttacctttctgtattttcttctaacagttttaaagatttcccatttacatttagatctctaatccttctggaattatttttggttctggtaccctacatgcaccctattttattctttttccatatggataacccagttatcccagcattatttaaaaaattagtcattctttattaactaatttataatgccatcttttgcctatatcaaatctgtttatatgatctttatttgatccgatggactgtttttctatccttgtactaacaccataacccttaattaccatagctttataatattctttttacttggtaagataagtctctctaccttgttcctttttaagattcttttagctcccttggtcttttgctattcaatatgagttttagggctagttggtcaagtttggcaaaagtcttgctgaattttatttgtaattacattaacattagaaaataatctggggagaattgacatttttataatgtgtcttgctgcccagtgacatactatatccctctatttgtgatcatcttcatatcctataatcatgttttaaaatttccatcataaatttcttgaacctattttgtaaaattgttcctcatataacttagattcttacattattatattcatatctgttttccatttcattgtttattggttattattgttatatattcagcaactttgctgagctctcttactactttgaataactaaactggtaaattctcttaagttttctacagcaacatgtatgtcagcagtaaataatgacagtcattctcttaaattctaattcttaaatgttcaattttttcctgtcatattgcattactaaacctcagtatagtgtgaataggatagtcacattaagaatatctattctgtttcttattttaatggaaatgttttagaaacataacatttgcttgggattttgagaaatcgaaattattgtattaaggaagttcttaatatgttcctaaactatttatagtttactaagtgtttttaatcagaaatactagttaaattttatctaatgcattttctgcatcaataatatgataaaattttccactactatgttaatattttataagatattaatacatttcctgatattaaacagttcttatattcttggaaaaaatattcttgctcttggtgtattttttaatctactattgagtttaatttactgacatgtagtatgtttacatggggagatcaatctttaaattttattttcttaactgttactatagagttttgctgtgacaatactggcctcacaaaataagctgagtaacatttcatttttttctatatcttaaacagttttcacattattgggattttttattctgagtatttgtcatctgaacttggtaattttcatcagtaggttgtaggtaggcagacttgaatatcagaataaaccaataaccacagaggaaatttctgattcttctctagtcaattttgggaagttattttttttaaatacagttcacagtttatacttcaatttatttgtacaaagttatttatatattcttatgatttttaattttttgtccttatgttcccctcttattcctaatatttatttgacccttctgcttttttttattagacactagacatttttctgtttcatttacttctttacaaaaactggcttttgattctgcttatctactttattatttatttgtagtctaaatcattactttctgcttttatcagcattagcgttatttcattccttctttttttttatatttttaggccatttttctttttctagattcttgaattgaattattacccttttactttcaataatttttattatctttaaaaatgaatttcagactctaaatttttctcctggtttctcattaggtgcataccatgttttgatacgtagttttgttcaattttaaatatttcataatatctgttttatttttagcccttgaggtatttagaagggtatgcttttactttgtaaacatatttgctctatttttattatttatttctgaatttaaacgcattaaaataaaatgatgtgttttatgtggttttaattgaaaaactttttttagcttattttgtgattttatctggtacatggattttacttctggcttgaaatctgtaggtggtttatctgtttctttagcactaattctaaaattcttttgtgtatactgaactgtgtatttttctaagaaaatataaaatcgaccttttagtatttctgaccttcttcttagtataaaaaaggtggttaacatagcatcttttaattacctattaagtatcaatcttgttactataattgtgtatgaagttttagttttacctatttgtttttaaccatattcaaaagtggtgatcactgttgtctataatcaatgcttaattatatttactaatatttttagatattactatgcctaccattattcttagatcctgtggcttcctttctgggtgcacttttcttgttacttttttttagtaattatttaatgaggaccttgggtaatacatatatttcatataactaaaaatgtacttattttgttttttatcttaaatagcaatttatctgggtattttttgttgagtattttaaagacattactcaattatatcttagactattgttctgtcaactattcttaattaagagaaatctatcaatctgtttttatctctttataaataatctgctttttctcctggtagcttttaaaagttattctatatcctaaatatcttgtagtttctctgaaatgtgtctggacgtggatttattttgaattattagtcatgaactcaggatatacttattaatctcaggactccagttttggaaaattctcagctattatccttttctttattgttcctttgtcattacttccattttctttttctggaattcttataagataaacattggtattttctaatcagcttactgattagtatctcaattgctatttcattttcaaaaaattaattcttcttgctacaatttttttctgagtgaattccttaacattaccttccaatacactcaattctttccttgaaattcctttatttcatttattgtacttttatattaatgaacatttttaattttttaagatttctgattaagttttactcttattcacctattcttattttatttctatctttaatcatttcttgttcttttttaggtatgagtactttatcactaagcatctcaagcatattcatgctgaggtcattgtcagataatttcataaaatcaaatttatctggagtgaatgttacaattattgattttcttaccattacttggttatgctttagaattttgttttacaggttttgttttgtttgtttcgttttgttcacatgtccctaactaggggttttacagttgcctttatctggatcttctcagtcccaatccagatcttacaatggtagctttcagcttcattcttatatgaatattttatcataatgctgtatctttattcttccagctctcaggtcctgcagccctatataagctgtttccccaggcagtagttggccaaatttttgtagcctcgtgataaagtagtaagccaggttcaggtccaccatttcaaatggagcctctttgacctcattactctaaagagctggaattctaggtatctcgatgtgattctagatccagatttcagcaggcctatggcttcagcaccatgggctgcttttagtagctttctgtaactaatcatcttctttttaagtctgactgtgtttctgtgattttcacattttatatttcacggaatttttaaggtaacaatacatcttggacaatactcctttgattcttatctctctttattatgttttttatattatttttattgtgctttgctttattgcacttcgcagatattgagtttttcacaaactgaaggcttgtggcaactctgcattgagaaaatctatcagcaccatttttctatttttttctttttttttaaatttatatgggtacatagttagatacatcatttaaaacacataatattacaaattacagttattgaatgtttagttgtgctggtcactaagcattacatattattttttcccaatcctttctacgttcagttattcttatttccattttttagagcagaaagttgaggtaaatagtctaaataaatacaccagtaggaaagagattataacaagtaaatagcagaaataatatttgaatcctgtttttgctaccaaagctagtgtccttaaactgctatcctatggttaaattatgttttgttatcttttaacattattatggttattatttttaatgttaattaaattaactaatattcgttttataaaaaatatatctagtactatctcataaatcttttttatattttctatgtttttatgcttgcttggtctattctcactcactttctcactctcactctctgtcttttttgatgtgtgattacctttttagcttttatcaatctagcaatttgaagttttaaagtacagtttattctttcggtaataatcactgttgtttttctgaaaaacattcaagcctgtttaattattgtcattaatgaagtagtatcctacatgaaatgagaaatttaggatgctgtttcatctgtctcctcttatcactcaatttattatttttgttataacaccttatatcaggtatacatttttttttttttttttttttttttttttttttttttttttttttttgagacggagtcttgctctgtcacccaggctggagtgcagcggcgcgatctcgactcactgcaagctccgcctcccgggttcacgccgttctcctgcctcagcctcccgagtagctgggactacaggcgcccgccaccacgcctggctaatttctttttgtatttttagtagagacggggtttcactgtgttagccaggatggtctcgatctcctgacctcatgatctgcccgccttggcctcccaaagtgctgggattacaggcgtgagccaccacgcccggctaaattattattaatttttattttacagcagtccagagtagtcgagtattctgtaacaaaataacagggttacttattttggatagtagagggtttctagcacaaagtaggtgcttaataaatattggttgagtgttaagtgaatggtggacctgtttggttacacacatgcacacacggagaaagaaaacatagctgagctctcattgctgctgatgaactaccattttgtttaaaccttgtattttataaacagttgaatcaccttatgatttaataaataccttttctgtcaattattttgttaggcaaacacatgctttgttaatcagccctttgaaatcagtgagcttctatcaaagttaggtccattcatggctatttccacatttacctcttatgccctacccctcttccacaaataataaatatatttggtaactctcgtttctaaaccagtgactaccgttaagttttcatttggcaaatacagtgggattcttgaatatatatagcaatcatcatatcatattaaatggatgacagcccacattcttccacaatagttcgtgttgtttactatttaaatagaggcattttgaagtagttcctattttttttttttttattttttaaaggtagttcttcaaatccctaactatagtcaaaagaaatcttttatatgaatttgctgggaaaattggattttttattgatatgattaagaaacttagtgaaaatctgcaatatgctaggataaaaaatactgtgcttttattgtggcaaagcagattaaataaaacaatatagattagcaagggaaaaagcaaagtataaataaactaggtcatttgcagatgtgcaaattttatggaaattctaatgatacatttgattgatttataagaagtacatattattcatgttaaaagaacactcaagccttctatgtggcatgattttaacaatcttttatacataacaacagattgaaattaaactgccttcctagctgtttctattttttaaattgtaaaaatgacttttattattctctatctaaaagtcactaaaagagaataatgcaacttagtttctagtcctagttctgtcatttaattggctccatgaccatgggtagttcattaaactctgtaggccacttttttttatttataaatgtagacagttggttttgatgtactttaaagccctttccagttcttgtattctagtactccacattgtgtctccctgtctttatatagaaatacccacttataaaaacgtaagtgcatatagggtccatatagcaataacctaaattattcaacagaactcataagggaatatccaagaatgggatgaattttcccctgaatgaggcagttgaatgtagctgatagataaataaccaggagctgtcataggttcttgatcaggactgacatgatgaaagcatattttcaaaataactgttcggcatcagtgtgcagaataaatcagaatcaaagaaacctggaatacagaccaggcagacatgatgccatcattcagagcaaggtaaggagagctcagactatggtgttacaatcagaaatgaagttgaagcaacagatatgaagatattgagatatatgttcagtcaaatagaatggctaaaaagaatataaagagaaaaattatgaaaggaaatacaaatatctaataaacatgaaaaagtataattcactaggattcaaagtcatgatttatgaaaaatagtaattttcagtgctggtaatggtacagtgaaatagacactcatagtgatagtggatatctatatattgacacaaaattctgcaaagtaatgtagcattatgttatccagaaccttgctttaaaaatatgtcctctgacccattaattttacttctaggcatctgtctagaggaaatagaatctcagacaaagatttaggtacagaggtgtttatcacaatgtcatttataaaagagaaaaaagattttaaaatcttaaattacaaaattcgagaaattattaaattattgaatatccatatgtatcaccacatatcatatatgcaaattagatagttcttaaagttattttaaacaatattttattaggaaaagtttataaaataacacaactaaaaattcctggtccaaaagatacaaataaatatatatacctaaaacaatcccaaatataaaaatgaaagtattcgataatgatgtaagagaatacattcaaatgtaaagaggagttatctctgtatggtggaattacttgatatttctattgcctttttattgaactttcttaatgcttgaaaaatactctgataatttgaaaaataaaagttttaagcaagcagtaaataatctaaacactgaatctcaaatttggtaataattcaacttagaaaagaatacatgtatgattccaatttattcagttactaaaatatgggatacatagattttcagtttccccaaactgaatcatatcatatttcataatttctttttcttttttggatccttgtacctttgccttaagtgattagcctgaacttcgatgttccagaacctcatttttttcttttcttttcttttcttttttctttttcctttttctcttttttctttttttcctctttcttttccctttctctctttctctctctctgtttctttcttttctttctttcatctttctttctgtctttctttctttttttttttttcttttttgttggagtctcactctgtagcccaagctggaatgaagtgtcagatcttggctcactgcaacctacacctcccaggctcaagcaattcttgtgccacagcctcccgagtagctgggactacaggggcgtgccaccaagcccagctacttttttgtattttagtagagacagggtttcaccatgttgcctagggtggtctcgaactcctgagctcaggggatccacctgcctcaacctcccaaagtgctggaattacaggcgtgagccactatgcctggccctcattttctttagaatgtcattttcttcagtcatttctaagattaacatactcaaagcacatttacatgtatatgggatcatcctctcttatcacaaaggaaagaatctagattgttctttgttttcaatcatttgtaatttctaaatttctcttatgaaaatatgcaaatctaataatagcattctgagtaattgaaacaagtgaaaataaaggacacagtatgtcaaggaagaaccacttttattgggtggaataaagtactactgataaaatttattaggcactcatttcaagaatagaatctcggttgctctgtgtaagaatgaataaacataacaacttacttggctctgtacccagaaatttacccaaaaaagaaaaccagtttgatgccagagagaatgaaccagataaagttttattggctcgaaatatacaagtaacttagtctgcccctttagtaacaaaactgtacaagtaaaaatataatctttaaaatctaagttccttacattagccaatggcatagtgctggagtaactaaaactttacagacctcaccctcttttccttctgccaggagaatgaactactctctctccctcaggcctccactgactgtataagttaacccagaaccatttgtacacaagcttgtctctttttcagaactgtaagtctagtgaaggcagagactatgtcctgtttatctttgtatacctcaggttctggcaaagtgcataattgttgaacgaactaatgaaggattcttagcctagtttttgagagtttaagtctctatgaaataatctaaggaaaagttccttgggtagaaatgcttacactttgtgtgttattccataatctatcttactagcatctaggcaagtttctttggaataatgatatcaccaagttatgaacacctttagaagtaaacatctttcaagatatttttctgcagggctgagttaaagtacagtagtatagttcttcagagctctttcagttattattgtggcacccagaacaagttactaagtctctctgaatttcagttttctcatctgaaagatgagaatagtaatcatctttgtctcgtagtttgctgtggggattggatgagatactgcatgtcaaataacatcatgcctagctaagcccttgggccattattattagcattaatgcctcccaggacaagtagttggacttgcacatatgtcttgaagactgggacagagtatacaggtgtagcagcagggctgtcgctggatatagaattagagagcttaagtgcatatgccagtgctttcaggcttaagtagcataagaattacttggggagcctgtttaaaatggagatctgagttccacctcaagagatactaattctgttggtttgctctggagtgagaccctgaaatgtgtctttttaacatgctcagcaggtggttctgatgcagctggtcctagaccaggtactaagttaccctgccatcatgactccatctcagccttgatcacaaaccactctaaccccatggcattattccttaagattggccctgcttaatgctgtgtggcttgactaccaaaagccttgctgcttccactctgtggctttgttaacagaagctttccttcctccacgtcctcaccccaccccgctgaaggcagaaaaaaagaatagggaaggcagagtcaattgggaaaacctgagtagttacagtaaattatgttattttgagttctttgacctaatgatctgcgttagtccaaaagtgggctgacttgagaggtaagcttgaattttagaacaatagttttcccccaataactatggaatggctggctatatctcttgttttttatagaattgctatctatagaacttagatgaataagcacaattgaagtgcaaagtgttaaacgcatgcttcgatttagtcaatgcatttgcacattgaagtaattaggattatttaaaagcattctgcttctaatactttgttctccatttcctacaaatcaaattagtgaggggtagatttgattttgacatcattttgaaaatattttctttctttttttaatttccttagtattacatttttacaaagttcaacacacaaccaactgtgactaaattcataaaaacaaaacaaaaagtccaaagtgcaagaaaatgaaaaacagcacagagtaatatgcagtagaacaacataaatcataccttacaaatatagttgtaataacacaccttatccatgtctgatcaattaataagaaatacttattcagatagcaaatagcttattctttcactttgattgagagcccaaatttaattatctcagtccaaatcaatatgaaaaggcaaccagatctgcattgaaaaaatcttaaccatctcctgttttcattgtactatatgtaatgcaatgaatgaatgtgaaggaagagtaaaaagggtgctttccttatttgctaacaaagcattcaagcaagattattcatttttaaaataaagttagattcagcagaaccaagaaatggttatggagccatattgcatagacaaatacagacctgagtttaaattctaactctgcacactgtctgaattatctttgacaagttacttcagctctctgacccacagttttcatgtctgttagagtaataatatctatctagcagagttgctttaataatatattgaatttaatatttacaatgtattataatatatcatattgtattatacaatatattaatatattgtatttcatactgtatttataaaaataatgtatttgaagtgcatggaatttaatatttactcaataagtggcagttattatttttaagtcaggaaataaaatttggagggatatgaacccaaaatccttagaggaaaaacaaaaacttaaaaaaaaaattctatgatctcactttcccagaggttatttacacaagtcacagattttatcctaggactttatcaggattctacagaagggaatgttttacctttataatcttctttcccccaaattgttatccttattgcaaattactgacctcaaaatacatgttgagaaataccctttatactattgaagtgcgtaattgaatgcatatattttgccaacacaaattattatcatattcttttgtttaaaataaacagtatttcagactggctcagataagtctaattcctcttattttttctatactacttttatagttctagaagtatgtgtttatgcataaaagtgaaggtggggagagagagagagaatggacaagaataataaaatcatctgtgcaacagagatggtgccctgttcagtcctgtccttagtgatcgactctgtgtttcatgtatagaaagtgctcattaaatgtttgctgaattaagtaaatgagggaaaacaaaatgctaagaaatatctgtatagcataaaggagccaactcaaaagtagtgtatgcaggttgtaggcagacaggtaaaactcacctatggacatcaacacctctttagttaggttggctcagtgtggaatgaccgccatctttattcagaactattagttcttaactggaggtggtagctaatccaggagacctgactgatctgcggtcagagagtcatagaatgtaagagccagagaggatcatggagagtttctgatcccagggcctgcctcatttctcaggttaagaaactgaatgtctgccaaacacttcgtggcaaagtttgttggtcctaaaacttgagtttcctgattctgttcaaattcattttgtattgtgtcatgctgcctttgtgaccccaaacttcctgtccacctgggaattcccatctatccactggctcctatggctaaaaaatgtgcaatggagcatccatcaatgcttctgattagaatcatctcacctattatggcattttccatagagcctaaaagaccacaataaagaggttcttcatttgactcttaaaatcaatgttttcatcaagaaataaactttattaaattattattaaccattaacaactcacccaaatcagtttcttttcaagtgatgtagctggaactaaagggaatggagaacaaatacctgttataacttgattgggggaaaatgtaaacgaagagctctgtcttcagggtgttactcaggggaaggcaaggccaggtgggctatggcaggggagtccagagtacccaggaactcacccgaggatttgaatcttagagaaatgaagagagataagaatatgtgaagatatagcaaaaagcggaggttaaaaagggaagatacaagtagatttaatgatttggtcttctggttcattacttactactatcattgtaacttcttcactcagtggagaaggcttgcattcaggtcattcatgtcctgttaacagcttatatttatactctctaagtaataactcaaattccttgaatcaagtattgataacatccatgagagaagaaataaagcatttggtaggtaaatatcttccctatccacttaaagaatgaagtgttgataggctgttgatggtgagttaaactggcataccaggaatttttataaatggttttcccatgctccattgaatatgtggctgagactctagttgtataccagctgtgcatgcaaaatctcataattactcttactgtattaagcattttatagcaattttagctctaaaatgctatgcgatagtttttatgcaagtgtaccagacatgtaagctgttccaatgaaaacattttctttcttttagacacatggttttaggtttccaaacttagctctttgcattgatggaagaatctttaggacaaacatcaggtttttcgtggggggagagggacagtggattttcttgcgcatacttcaagcagccttatcagtagaggggaattttactaattagttgtatagtactcatactagcaagtactgctgctgagcactagttcctcctcagcctgttctattgagaaaggcagcgaagagaaagctagggttatctctccgtctctctggggtgtaatgacaaacaggcagaaggacttggacttaacctctctgcagaaggctgacacctttaacactgctgcacatgctgctgcaccctgcagtagcaagtcttgggcctgagcccaaagctggtgtggagtttgaacccttggcattctggcccagagccaagtgctatcaatggaaccccactgacacctttagttattcttcctagattaggatagtaatttacttgtctctttgatttcaagtgtctggttttgtttccagatgcctcccagctcatctgtattccaggggtttcaaaagattttaacctcattggttgtttcctttgtcagttccgtttggtgaacacaggagggatacggagaaactagagagagggaggcaagcgagggggttttgtatgtgtgatgtaggggttatatgggggagggcttggtgagactgaaggaataaatgaaaggcatattcacttttagaatatcagctattatgccaggataagtcagaatggagtataagagatgatgtgtaggacaatgtagcaaaaagtagtattacatagatgcatgtgtaaaagccctccaaccagcagtaatctcaacttcccccaaaagattgcaatatatgaaggagatggagggaccatagaaattttatcccaatgccaataacataacagaatttggattttaacatgctatagtaggaaacggcatttatgcatggtgtcatttcatatttacaagggcctgtctagcactgtttattgatttcactgcaatttttttcccgaggaccctgtagatagataattgctagaaatgtccatcattagcacagcattgagtgcaaccatcacactaagaaaaagatacacataggaccctgcgagcaagcatcaaatagagagaaaagtcacacaataacatgtgcagctataactccaggcaaacacacacataacaccctgtgtggccattgcactgagaaaatacacacagccccctgtgcagccatcacacatcaggaaaatacacacatgacacccctatgcaaccatcacaccaggcaaaagcacagacataaaatgctaagtcaataggaatgaacagctcataaaagcctactggaatagatcacatcacagccaggtacatctgttctcagcactaaccattatcattagcttaaaatgcttgaaatcactgtgcatcctcaggtctagggacagattattccaagaagattctgctaaatagatttggcaatgcagtgaaggggacctctactacattaaagtgatacattttgcatctcaaaggctgtcaactgtatttagaggaactgtgtgattgaagaacaatgtgctaggataggatagcaatttttctggcccttctaaatctggaggtgctttttaccccgacatgagttaagtgtacaattgaatgggcagctcttagattgggaggtgactaataaaagcagaattggaaatagctttcaacttgtgctgcaaaggaagctgctacatcctgttttaaactggaactctcaggtggtatgtcacatctaaaggtcttagtgaggtcagacttcaagccatcaacttgagataaataagtagcaactacagtccttgcttcatagggttgactgcccaactggggggaataaaggaaccacccacctcttctttagccagtgccttctctttatcctcttgccttggtctgtgatgttatcctcgctgtgtgacccaggggttaccgcactgtgagggaaactcggcatgcccttctgaagagtggcccaaaagaactggttagaaagagtttcaagcttccgtgtttcaattacagtggcattttgtgtttctactgagtgagagaagtttcaagttagcttgttaagaatgatttacaccataattctaggaaaaacaaatgtgagtgactgaaatttgaaaggaaagagtataggggggaagtgccagactaaacgaatcctaagtaaatagggtgtttctttcgggggtcggtagggggattggtttcttttaaaaaaagaaaaaaaaagaaaaaatgtatgtattgttggtaattacttcttttacctggaaagagtgaagcaggaaaaaataataataataattgctccatttgctccctgtaagagcaaattttcaggagagggcaggtgtttcccttacatttgcatgacaacatcttactgggaatgagcagtactggatatgagaactaagaatttcacttctttttttttctctaaatgtggcagaaaaggttttgttggggtgagataagcattttccatgaaacaatgcagtagtgacattaggtaattacgtggtgactgggacacaccgcatggtatactggagaaattgcatgatacctacatgataactgtagtaactttagttatcgctaccgtattatctcctgataactatataattagtttgtgtcatcaaagcaccctaaacgtatgcctgttccagctactctggtagaaaaaagaaaataaactttttgcaaggggggagaaaaagctaatgaagaaagttgccaagaacagatattttgtaatctgtgctaaatctctgctggaaaacatgaacagtaatgaagctgagaagacagtaaaagaaattcggggcaaggtgccagacgcccagacggaaggagaatgtggaccaaaagattgcgacaatcgggtaattatggtttatgaatttcagctttaatctgtagttcagtgagtcctgattaaatatctgttaaacacaattaaagtttgtttttgtatttcaccgtcttgatcagaataattagagactgcgtgtttcatgtcaaaagtagcaagaggaattttagtgaatgaacatcgtttttaaaagccatttgtagcaccagctgttggcattattttatattttagtgttatcagcataaagatggtcctctggatgctgaatagtttccagcaggacaaggatgttatgctgttatgatgggcatgtgctgatgaggcttaaatgtttaagggttagtgttcattggaaacaatggacaagggagatgtaggtcaggcaagcagatattttaggtaagagaaggaagacatttgagttaactttacccatgcaaggcgtgacataagggaatttctcatggtatagtcattggtgttaacacctgcaacgctggtgttatttgcttattgagatgtcaatgtagtgcctgaaggaagagcacaagaaagatgtaatgagaagtgctagaattctgtcctggttggttctcagctaaacacgtgtgccttttattcctagagttaggagaaggaagtgcagaaagcacttactgtactaataattctttggctaaggatagcagtatgaatgctcaaaaaggacaaatttaaatataaatgggattgactaaaactgggtaaaggagtaaaatctggttctacaaaccaaagctaagaccatgatttccacacacttgtgccagaagagaaactggagagttgtacatcacaatctccttaaaaattatgagggtatatgtaaaaatgtctgtgcagcttaccatgctatgaggtttaaagaaataagataccatcttgcttgctatttgaaatttgggtacctagaatatttcggtctctgtgacagacagattaatgcccccctccccaccccaccgaagatgttcacatcctaatcctcagaacctgtgagtatgttgccttagatggcaaagagactttacagatgtgactaaattaaggatttttgagatgggaagattatgccagattatctggttaggcctaatatgattataagggccgtttaaaggaaagaggcaggcaggaggatcacagaggagatgtggtgatggaagcagaggtcagagagagagagagattgaaagatgctgcgttgctggttttgaagagggaggaatagatcatgagccaatgaatacaggtggcctctaataactggaaaactcaaggaaagggattttctcttaaagactccagaaaaaaacataactctgctgataccatgattttaggactttctgacctccagaactataagtttgtgctaatttgttacagcagcgataggaaactaatacagttcccatgaacctgcttcatgaacttgatttctattgaaagttatctagttaagagtacatccagctataggaaaaataataagcctttattaacttaatcttctaaggcccattttctaggctgtctttgtggcatcatttggaggtatacctgctatgatatgaattttaaaagcctatgtattacaaattaaaatcatgggcaagttcaaccctatgtccctagcactagttatcagcagtacattccagactagaaaagttttcagggagggaggattgtagagtgagaataatttatcttacaacaatagcagttaacttaataaggtaagttgattacttaccttaggtttaatcacttgactgtggcaacaattgaccatttttaagctacagaaatggcaatttcataatgtttaatatacccagtgttatctcatttaaacattctaagtacttcatgaggattctaaaactaagattaaaatttttaccgaagattaatacattttagagttatgcaaagttcaggctaataatgtaccttattttcatcattttcagttaaaaatgggattcggttcaaactggcccaaggtgtctttgcagatttgaggatgcaagtatgtgtctcatctgctattcaaaaaagttaacagtataaaagtcatgggaaagttttgtcaaatagacaaagacagtggtagaaattggctacccagcatctttgtattgaaaataggatatagaagcatacctctttctattgcactttactttattgcactttccagacattacattttttgcaaattgaaagtttgtggcaaccctgtattgagtctgttggcaccattttttccaacagcatgtgctcacttcatgtctctgtgtcacattttggtggttcttggcaatattttaaactttttaatcattattatatttgtttgagtgatttgtgattagtgatctttgatgtttctattctgattgttttgaggtgccacaaaccacacccatataagatgacaaatttaatcaataaatgttttatatgttctgactgccttaccaactagctgttccttcatctctctccctctcctgggacttccctgttccctgagacataattttgaaataaggccagttaataacccggcaatgacctctaagtgttcaagtgaaaggaacagtcacgttatctctcactttaaataaaaagctaaaaatgattaagcttagtgaggaaggcccagaaaggctgaaagctaagccccttgcactaaacagtaatgaagttgtaaatgcaaagaaaatgttctttaaggaaattaaaagtgctactctagtgaaaacactaatgaaaagaaggcaaagcaaccttattgttgatatggagaaagttttagtggtgcagataaaagatcaaacaggagcggtggctcactcctgtaatcccagcacttttggaggccaaggcaggtggatcatgaggtcaagagatcgagaccatcctggccaacatggtgaaaccccgtctctactaaaaatacaaaaattagctgagtgtggtggcacgtgtctgtagttccagctactcaggaggctgaggcaggagaatcgcttgaacctgggaggcggaggttgcagtgagccgagatggcaccactgcactccagcctagtgacaccgtctcaaaaaaaaaaaaaaaatcaaaccagccacaacattcccttaagacaaagcctaatccagagcaaggcactgactcctcaattctatgaagaccaagagaggtgaggaagctttagaagaaaagtttgaagccagtggagattgattcatgaagatgaattaaagaagccatctctataatataaaagtgcaaagtgaagtatcaagtgctgatagagaagcaagttatctggatgatctagctaagataattgatgagggtggctgacctaaacaacagattctcaatatagatgaaatagtcttctacttggaaggaaatgccatttagggtttttatagctattgaggagaagtcaatgcctggtttcaaagcatcaaaggataggcttactgtcttgttaggagctggtgcagcaggtaactttaactgggagccaatgtttatttaccatttagaaaatcctagggctcttaggaattatgttaaatctaccctgcctgagctctataaatggaataataaagccaggacaagagcatatctgtttatagcatgatttactgaatattttaagcccactcttgagacctaccactcagaaaaaagagatttctttcaacatactactgctcattgacaatacctggtcaccgaaaaactctgatggagatgtacaaagaggctaatgttgttttcatgcctgctaacacgacatctattagcagcccatggatcaaggggtaattttgatttacaagtcttatatttaaaaaataaatttcataaggctatagctaccgtagatagtgatttctatcatcgacataggcaaagtaaattgaaaaccttctggaaagtatccaccattctcgatgtcataaagaacatttgtgattcatgggacaaggtcaaaatataaatattaacaggcatttggaagaagttgattccaaccctcatggatgactttcaggcacttaagactttagtagaagaagtaactgtacataatgtgatgaaaataacaagagaactagaattagaagtgaagcctgaagatgtaactgaattgttgtactttcatactttcattatcaaacttgaacaggtaaagagtagtttcttatgggtgagcaaagcagtgagtttcttgagatggaatctactcctggtaaagattctgtgaacattttttgaaatgacaaccaaaatatttagaatgttttataaactcatttgataatgcgatggcagagtttgagaggattggctccaattttgaaagaagttctactgtgggtaaaatgctatcaaacagcatcacctgctgcagagaaatcctttgtgaaaagaagagtcaatcatgtggcaaacttcattgttgtcttattttaagaaattaccacagccaccccaagcttcagaaaccaccaccctgatcagtcagcaaccatcaacatcaaagcaagaccctccaccagcaaaaagattaccactcagatggtaatcttgaaagctcagagggtggtgagcacttttcagcaataaagtatttttaattaagatgtgttacatctccaaagtatccctgcactaccacagagggagacaggaaagtgtagtggtgaaaggcttggacatggcatcagacaggtgggatatgaatcttggttttacccctcattaccaagttaaataacccctcatctgactttcctgatctctaagaatagataataataatacctaattcatggacatagttgctgggaggattaagtgaagtaataaatgtaaagcacttagagcaggacctggtacataataagcaacaaatgttagctgctgttgctgtcatcatcatcatctactgaaaagtaacagactcaagagaaaccttacagggaagatgtgccttatttattgttaagtcttcagtctagaaaaacttggtaaacttaatattcttacttactgtagcaatacactatttcccatggcaaaattcactctttactctgctttgatagtatgtggaaaaatatacactgtttcttaatcactgtattagaagattattgcattcattgtttttcataaaacaaaaatttaagaacagaccaaaacaacactgcatcaatgctgataaatataaaatttgacctacatttagaattatatatttttttcatattgtctgtctggtgcctaagaattagtttttcttattattatctaatcttcacagctacaataacatccctgaaattaagctaagaatgctacaaacacaaactaaaagcacagtgggctttccacatgattagaatgatacctcccttctcatcgtctttgaactagacatctttttcccgtgaactccaagaagggttagccagcctgtgaggcccaccattccccagagttggtgctggaaaggaaaatatgtctactcagccagtgataggattttcataggtgttccttctctacagaaaatgttgaagccagcagccttccaatctacctagggaggttaagaataatttgtttcagaatggtattgcttaaagagattcccagcctcttttagtttatggcttccattgataatatgatgaaagctatggaccctcttcccaaaagagggtgcaataccttttcaaaggattcacaaaccccctcaagcctattggtggacctcagattaattatacctggttcacaattgtgttctaagtaaatcactgtaggactgactgggctaacaagatttcagaccagaattgtgcaatacgtatttaccatatgatcttggaccagtcattaatgtaaattgaggtcctggcttttaattagtaaaatgagtacttttaatcctaatgtgcagggaaagcacatatttatttttagagcattttgaggtacatttaaataactactgtaataaagagcattgatattggccttgtttactatttatttactgtttggtcattaatttattcattcactcagcaagtatttgttgagcacctactattccagacactggaaatacaatagtgatcagaactcacaaagtcctccttccttctggaacattctagttaagggagatagttaataaacatgtaaactcactaacacacaatgaagaatgaaatgaagaaagtaagagtaaaatctcacacggatggcatgtaaggagatggcatttggttgagacctgaatgatgttagaaactagccatatgaagatgtgaaggaaaatcatttcaggcaaattggaatagcaacttcaaaggccttgaggctcaagtgagctaggcatgtgaattatgacaggtcagtgaataaggaaaagtatactggtgatgtgttcagagaaggaatcaggaaccagactatataggctgtagagtgagaagtttgaattttattctagttacagtaagcagccattggtgatttttgtagtagaatctaatgtcacattgaaagaaatcactacagtttctgtgtagagaatgggttgtagaggagcaaaaaggaagtaatcccagttaatagttaagaaatgtccaaagttgaagacagaaattaatctcatggcagtgtaatacattgcctcgtggagaatttgaaatgtcttttgttgaacagccaagagaacagaaactgattcatgagatgaatcatgtagcatgtcctatgtctttggccatttataggactatttaggggcgtaaaagtgttctttctgaaaggaaggggaaaaggaattgtgagtacagtccagtattgttcgcaaatgaggtactgttattagcggggagggaggattgttgaagtaactgataaagtccttagcaaccaggaatctcaataggtaagggaattattgggaatatgggccaattttatgaaggttcatcacaagtgtgcttcctctgtttcctgaaagctgcctaagatcacaggtgacctaaagtcttcttctgtccctttttaatagaagtttaaatgtcctgattctttaccaccatccacccctcaaggtagttcccagaaattactacactgaatggtggaaataggtaatgtaatttgaatgaacatcagaaaaggaaaaaattctgttgtgtttataggtgtttcccaatagaattaaaagattaagtctgagggaatgtattaacattagggctgtagtgagtcaccagtattgcttgaaggaagtttagtgctattattccttgtcaaccaactgaaatactttagtaaatggtaaatcataataaatacaactaggaataatgccatgtgtaaaaataataatttattttagcttatataccacttattttcactaataaactaaacaattatcttaatcatttctcaatcacattcatatataatgcaaatttggtgtagtatgcaattacaggtgaaaatatatctagacagtcattcagaaggcaaggagtgggagcctttttgaaaagggcacttctataagactataggttatagctccagggtaagtatgaagagacaagaaactgcattagagttcagggtaactgacttaaagtgatgttgaatttcataatcagagttcctagaatgaccttgcaaattatatttccaggaaaacatgaacataataacatagtatcatagaatagccttattctgtggaccaaaaacaattaggtactatatatgaaaaacatactgcaaatactaaatgtactgagcttattcaaataaaggcttaagaactggttattgttggttgtatttttgtaaatgggagttgaaaaattctataatagaatttctgacccttctgttatcccaggttcttgtgctgttttaaacacttcccctccctttcattcccaaactgtcttttctctggggaaaagaatataaattatcctatctaaatttcaaggatgactattcccacatgagagcatatcaaagctgaaaagagaatacagaactcataacaaccagtaccattcacaccagctcatctgctacttcctaataaaactggttgttaatcttccctaatttgtctacatctttcaggtaataaaagtgtctaaaccataatgcattcttccagagaagataatcaggtaacataatacctctcagctcaaagacacagtgcccctttgtatgcagtcttgaattggattgacatttctggctgacacttcacatcaaaggttgttttgctcagttcacaatctgatcttttttattgtcttctagaacattcctaattctcaaaaagatttctgcatcctcagcagtatactgagagcttcttatttcattatctcattaattttattaattgttaagatgtatctaattgtaaatttctcttctcaggaaagtgtcttaagtcccatctttggagatactaataatcagaatattgtgaataccaaaagtatagttaggttggcataactcatctgcgaggggaacagagatctgtcaagtagaaaagatgctcataactgtaatgatttcataggggccattcattacttagtgtattttcttaatatggaatgaatcactgtgagtaaaatatttcattttcttcatttatttagttgagccattcaattcatacagattggaaaacaatttccacgggaagatcaactggtattttgtgacttcatatggatgctacatcctgaagggtatcttcagggtgtctgagcactgaggaatagatatgttttagatgaaactttcatagtgatagagcatttactgagatgtaaacagtcttagagtgcaagtgatcctattatctaaggtgacttcatagaaaatgtagataagattgggaaggtacaggggacttcaaggaaatcgtcaatgaggaaatggacccattgggagggacctgaaaatcatgagttcataccacataactgttcacctttgttctgctttgtagaaacaatatatgaacagatccagatccagattttcttctggatgaagggaagcttacaagaaggaaacaaatagttaacttttcactggcatgcttaccctgtttagtttttaattgctaatagtggatagtgagatgttgttatcctccattgatagagaggattttttaaaaaggcaaaaaagtggaaggcaatgacacctatgttatctcccaatgtatttttgaatgactgtgatccaacttccagtttcaagctgcttaagtccatttcaaaggcaggtccaaatctagtactcacatgtttgggacaattgaagtcagcagggtctgtggcttcccaacctagactttattgtataaagggtaaacagccacttgtaatttagtgagtaagtgcagatctttcatgatgcacataccagcccaactgaaaactggtcaatttctgtgtttcacagtggcattcataaggcctctatggagcattatcccatgcctgagggtcattactcttccacaggggcactgacagttgtgataaatggtgataccttggaagaggagtgtttggatgtttaaacagattacattttccattagatcacatcttagaatgtctactcatgtggacagtgaggatggaatcaggacaaatgacatgtgaactagtgagattcaggtgtaccaatcatcgtttctatgggggaaatattgtgcatcctgtcacaatattatatgtgcttcaaagcaatggatgataaccatatatagctgctgagatgctgggatgtcgacaggcgtgagattctgtccatcactattatctacaacaagactcattacctgccaaccagtaaacatcccatttacaccatctgcaataaattaaaaagtgacgaaaagaatcaagatcagtttgagttgcaacgtgattgtcaagttcattttcatctctagaagccctttacttctctgagagactttagggaaaaatatatgatgaagaaattgaggaatagccttgcagtggcagatctgataattgtcaggtttttaaccagaaatttacaaatacaattagcttcttcaagtataagaaaagtccaggcctttgtcaattccctttgtctgcacttctctgtctctagttttctggtatgctggagctgggaattagtgtttgatactcctaaattgatgctgactacagtgagaaatatttcataaaaatgtatatttcaacataaactatgaggcaaagctgccactgtaaccagagaggaagtgatgattagtttctaatttacacgtgcagtgatttctttggcaagtgtgaattccatgtcctttggtaaggttctttgtagctgttcctacttgaagcagtttgggggatattaaaaagatacagagatctgctgacacttgaggctatttaatttatatgtaagcaaactagctgcctatccagattacacatgtgggtcatctagtggtagaaactgcagagccaaagatcaaatagaagtcttgtgtacaagccacatgagaaatactagaaggatttgacatttattcatatgcatcaccttttatgagaataatttattgttttttgtcttcctttttcttcatcagatattccatcaatgaggaaataacttttattcttaccttagagatgggagttctcagtgttgcccaaggtattgctctgagcaaagagaccaattctgaaatgaggatattgaagataagcccttctgaaaatagcccttgctttgcagttggatttcactcccagaaatccatctctccctgccacaaaatgcccttgtggtagtaacgtgggaagattatatattacctcatctccttacaaagaaaaggacacgtgctatgggaaagctttgtttcttttaatcatttagggcctcccctgccttcaatatttcactgaagtggtccttggtttcctttagaaagacactctagtgagagaggaagaaacagagtaatgaaaatgatgacctcatctggaaagactttctaaccaaaaagaataaagggataagctgtgaccccatccatgaatacgtgaggctgacaaggatagataggtatatgaagttttgactgcttcttcaatactttgcctggaactggtctatatgatattacaatttggcaggagacatcatctctttatcacaagctcatctgtacatttttaaggggaaagatgcaaacctttatgtaggagatttttagggttactgactttaaatgtgctattataaggaagataaatatcacattatgggaatatggaagctattttgcagaacctagcatgggagtgaatgagttttattgttccttcctcttctcatctactcaatcctgaacttgaacactatattaattctactgggacaaagttaattgctgatgggttcacagaattatagaagtatagactttacttctctagaaataaaatctgattatgtttaagtcatttcagtcctgaatggcacattttcaaactacaatagaaggaatgtaccagataagttatactgtaaatttatgatgttcattttaactaatataaactggacctggctaataataagactgagttaggaaagctatagttcatctctatagcatcagaaaaggaaagcccagtatacttgtagtaaatgtacatataatcaaacacaaaatcccaatttttcagatttttcactgattttccaaggaccaaagaaatgcttggaagaggatggtatgaagaggctaagtgttcatggagtggaagttaaattatactttcaattattatattttttctacaaaattgcctaatgtacattgctagaaattggtataaacagagctactatgctcatgaagtattgattaatactttgtgtaccacatcatacatttatatagagtataaaatggtggagttcttaaggtccttatatgtcactaatatccaattgctgtggaagtcttatcatgaagtcttggattggattgcttctcaaatctaaaagcccagttaaacataaggcattgctcccagttgctttcttggcaaaacatcatataactgtctcaagaaataaacgtggatttggagagaaaagggtaaatttgtgaagctatattgaggacacttcttggagtgacccagcatcactagtttagcttggacttattttttgtgcatttatataaaatagaatgattgaaaacaataattctgaaggcaaaaatgtaacacgaagtaacagacaccttcttcacatgtatcacaaatttgaagcttccacctttgtcatgaatgagcaaatagagagagacctggcctttctgtctagcttcctcttaaaagcctcttaatccaacataagagagttttatatatttttttaacaacaacaaacatgaatcaaattgcctggtatagcagccagtggccacatctgcagcaaagacttttttgtgggagctcccaaagctcataaccatggagtgaaccataattatattgtttagaaatccatgtcagagaaaaagcttttttgactttaaccatttcccattaattttgggcggtttggaaataggccagagaaacattttaccaagtttctgtaacttttctattattttaatggttctaaagcagaactgattagtgaatgactaagggaagtggaaaaaaaaaaaaacaggaagagtcaagtaaaaagctcaaaaaggtgtcactgtccttgattttgtgatctttttgggatagatttcctaatctttgatgttttctctcttcatgaccattccagagaacttcagctagagacaaaataataaggaaatacagttaagctatgtggtagtgaataaatacctggatatctagaatttccaagttttgttttgttttgtttagagacaaggtctcgctccgtcacccaggctggagtgcaatgacaaatcatgactcactgcagcctccaccttctgggctaaatgatcctcccacctcaccccctgagtagctgagattatagacatgagcaaccatgcccaaataatgttttaaaataatattttgtagagaaggagtcttactatgctgtccaggctggtctcacactcctggcctcaagtgatccccccacatgggcttcccagagtgctgggattatagatgtgagccgccactatatttttagctgaagatgagtttccatttatttatagaaataaaagtgttcttaataaaagttctgtgagctttatttctttggaaaccatacctagaagtttacaaacacatctggggtacaattgggacacgtctactctatgtttcacctctactcacatccttgtagtgtttcttataggcaaggaaaatacttcatattgaacatatgataagtggcaactttgctgagactaatttataagaatagaagctgaaatattatccatggtttccaaagaaaagcattttttcctgaatagcccacttccaatctatcattcttcactttgttgcttatgtatatctctatcttcatttccatatatcaaatattacctatcctcaaaggctcatcccaaatgcctctaactttctgaggcccttattgcttacttctctttagctctcccatgcaacgaaagtcattgacttgtatataccacccgcccacaataaatttttgtgcacttcttttgtaaagcttattacttaatttgcataattgtctataaatttgtctaatccctctgctaggtatgaactctttaagtgaaagaactttaatactgtgtcttaggacaggacacagtaggcacacagtaaatatcgttacgcaaattgaatctcttttattgtgaacaggaatttttttccagaattttccatactatttacagaatgatagactgataaatgcatcactatattcaatcgaatatatttttaatcgattaaaaaacaatcgatttaaagacaatcgaaataatttttaatccttgtgagtctacaaaccccccttgtttcagatgctcagtatcctctttaaaaaaatttattttggccagttgtggtggcttatgtgtataattccagcactttgggaggctgagctgggccgatcctttgtggccaggagttcaacacaagcctggccaacatggcaaaaccccgtctctgctaaaaatacaaaaattagatggacatggtggcacatacctgtaatcacagctactcgggacgctgaggcacgagaatcgcttgaacccaggaggcagaggttgcagtgagcagagatcacgccactgcactccagcgtgggtgacagagtgagaccctgtctcaaaaaacaaacaaactatatcttgggatctgtaaaattactcataagttatgagtttttaaaagtagagcaaatccacaaactgaaggaaaataaagagatcaagaatggaaccagaaaataagaaattataactttctttataaaaagtaaatgagaatctttaaagacaaccccccaaaaagcattatttacagagttaaaacaatgcacttattaacttgccatcttcaaggcttccttcataagtgaagaggaaatatcactgaagaattaaaatattgtctggcatcaggcttactcaaagctgttgacaaatcagcttacaatttggacttcagcctatccacagtgaatgtggatcagtttggctagtgcatatactctatgcacatcatcaaccaaactatggaaaaagtgatgtaaatatgactgaccgctgacccaaactgtagtgaggaaatattttaattgcgtaagaaaaatgagatggaatttgataagggaagaaaaaataaataaagaagttatagggtgggcacagtggctcatgcctgtaattccagcactttgggaggccaaggcaggcggatcgcaagatcaggagattgagaccatcctggctaacacggtgaaaccccatctctactaaaaatacaaaaaaattagctaggcatggtggcgggcacctgtagtcccagctgctcaggaggctgaggcaggagaatggcatgaacccaggaggtggagcttgcagtgagctgagatcgcgccactgcactccaacctgggccacagagcaaggctccatctcaaaaaaataaaaaagaagttatatagaagtagaaaaaatattttatggaaggaaaattgaggaaacagaaaagcaaaatattaaaaatcagttagttggggccagttgctcaagcaagtaaaatgtcaggtacaaggtatacctcttaactgatagagtcaccaaaactctattaacagcatcagtcaaaaaaaaaaaaaaaagaaaaaggtcaacttgtaactctgtgaaatcaactctgcccatagctttctagaaaaaaaatccttagtgtgatgattagagaaatgaaaaaagagagaggctcaaaggacagtagtaaactgtttatgtcctaaattggtcatcattagcacttatatagtttggtggaaattgctgtgttaaagccaaatttctgtttacaaaaagaaattgatgctagtagagaatgaattgtactgcatatattcaagatatgaggagtcactgtggtaccagtaatattaccatgttgaaaaaaaattagcagtaaagatatacattgaacatttaacagaattttgctattactttgataatatcttaataaagaacatagaaacatagggctgatagaagaagtgttatatgtaattgtcccactgtactaagtcatatagtacaaaattaacactgaatccatcttaaagaaagtattttatcataaataatatacaagctggcctgcttaagaaaagaactcatttaaagttataagggcaagtgaatgagactatctgaaatgagcacataaaatactctttgattagatatttagtgaaatgtcataaaaggattttgtttcctggaataagaggagcatctgccgttatatagaatagctatagaattgtcatctttcacattttctcagtagccaaaggtcagaaatatatatagtaataccttagtatattaagaggctttcatatgtttgtttacttttttcagtaccttttctctttaaccactgtgaagaagttattttcttattcatggctagttttcttcaatgtaccttttcagttcttaataattatgaaggaatgagcttcctacatccattgtttatgcaacctttgctttatattaatgttaagaaacagtccagtcataggccaagtgtggtggctcacgcatgtaatcccagcactttaggaggctgaggcaggtggatcacttgaggccaggcatttgagaccagcctggccaatatggcgaaaccccgtctctactaaaaatacaaaaattacctgggcatggtgatgcacacctgtaatcacagctacttgggaggctgaggcagaagaatcacttgaacccaagaggcagaggttgcagtgagctgagatcatgcgactgcattccagcctgagcaacacagtgagactctgtctcaaaaagaaaaaaaaaaaaagaaaataaaaagaaaaacaaaagaaatagtgcagttgtgtttttaaaacttgatatccttttggcacacctgtagatgaatgtaattctgagactaatagatctcttaggtctcttcccatccttagacagaagttgcatgagagaaatgagataatgtaaaaggtcagtactgaaggtcaactccctgtaggttttcatcacacctgaattgaggatgaacagagcccacttcagttggatatctacatggtgctttgttcaaaaaaagtgtgagttttcctttctcctgtcacccacaaacaagaaagaatccacaatataactatttgcagttctgataccatggccataaggctaatctgagtgaggcagagaatatgcacatgcacatgtgtctcttacagagaaacacatggccttctatcaggactgatctgggtgcaaatttaaaccaaaagccatcttattcactggcttcatccaaatgcataaccactatttaggaaaaggaagatatccaagtacactaagaaaaattattgatttttaaattgtgtcaaggtggcatatctagcactaatgaaagcactgttatgtcagtggcctaagaattacaaataatagaaaattaatataaaaatgaaaatacactctttaaaaaatgttgcagtaaagtttaaactagtttctgttcagtaatagaacttttttatgttttcttattgtaaaccttgcacaagtcttattgtaaactttacacctagtatgcacttaataaatacttgaaataaagatttcaattgaaagaaaattgtaagctgttatgtaacattagggcaaaggaggtattactcctaaatctgtgtgcctatagtaacacacatgcattcacatgcatacaccccttaatcattgggatgctctaccactgaccagagcatcttctgctctagccaccagttttctttttcaattactgtccataggaccctttcctgaggccccagcactacgatcatttttaaatcttttcttcttttgcccttcattaccattcagtcagtcactaaattctgccagttctcacccagtaatatctcttcattcagcctctttcttttatttattttcaagggctgacactagaccaagtggccccttatctcctttctgaaccgcttgaataggccacccttccttcaaactatcttcacaaaacaatttttttaagcatctaggatacctgctcccacacataattttctatgtctcatttcttggccttggattttatactgctgcttttctacctgaagactagaatccgaattcctcatctagctgtaaggccactctactaccagttatccttcttggcctccttttctttcccaactccaaggtctccatcaacttctgtttccctggaatggaatgaacaagagctttggcttagcattggtaatctttacaaactggttcctcatgcatccccatgcccctgtagttaccccctactctttactgctctgctttctctatgttagccaagttggtgggctttccagttcccatttccatgcctttgtttatgctttctccactctatggtattcttctctctcaccttggaaaatgtatatccattactttcttccaaattctttttttaaccctatttgctctgcttaagtctttgtacactgtgtgtacacacttttgtgttggtctataagtgctgtgcagttttgcctgtataggttttgtttttccctcattcccagcaagaattataaacatcttcagggagtggagggcatctccttaattatgatacagaattctccacgtgcaactttttcagtaaatgtttgctgacttcttcatgccaaaggtgaccactagatattaacaaggcatttgaattctccagtctggattaaaaaaaaaaaaaaaaggtgtatgttgcaaaaggaaggactcactgcatatccatatatccataacccactagtccagactagaaccttcagaatgcttgaggaacaggtaaagcactcaggactcctcctgggtgtttgattggaaggtctcagatgtgttctaccatgtaaagaaagtcaaaggacctatgttgcctggccaggcaatagttttcagaggtagtgggccaggtccaccattcggtagaggaagtttgccaaatgttgttataatattcaaatgggtttatccttaaatgagcacatttgataagcatgcccacccaggctgctttctgaagatgtaaatgggcaacaaagcacaagtgtgactctatccgctgccagagactgactggctccaaaaacatctacacccaccgctttccactgtgtaagatgtaccgatttactctagttgtgccagcccaatgtttgagaattatcaatgaatcagtaagggagaaagaccatcaaaatttttcctgtacttatggatctcaaaaattcttcattaaaaataatttttaagctgactgtctcaagtttctgtagggacagctattatgtaaagaaatctccttctgactctattttagcccacctaataaaatctgatggcagcacatggattgcttcagggaaaatagtttcggggttaaaaaaagacttagaattaaactttatatcttgctccaaaaggactctgtctctgagagtatatggaaacgatgtttttggccatgaattaaagaactgttttatgaagatggttcagatctaagatttgaagaggccattactttaactagaagcttgtaatatgtactcataagtaactgtgaagaccccctcctccagcctgatgaagagaaacagactattgagaagtccttggtgtccctactatgggttattaatcataataacattttaactgccctattgctaatctctaccttatattgcaaggtggatattgttatccctaatttacaaatgagaaaattgttgcttaaagtgatcaagtggctcacacaatggtgtaccactagtaagtagctttggtaaacactgatgtctctggtaccaaagccagtgttcttgatcctcgcaccctgatgccttttaactaaattgcacaatacatgtgaaagcattttgcaacctaaaaagtggtatacaaatggtagtttatatgagagacagaaagtcctgggaagggcaatttccagatcaccctgaagaaggaataaagaaagaatgaatactctaaaagtactagcagctcttttagtcatatacagaactccataaatcattcttctctggtatttggaagcattcagagataaaagagttcatattcctttttgactagactacccagaagcatacatatccaaagcgggttttccgtccttcatatacagagatgatgctcatggataatgcccccaggaagaaagaagaggtgtgagcagaattcttatattttcatacatatgtcaacttcatgagccatttcattttagttttctgacagagtttcttcatgataaccacatgaaataggtactcattcttctagatttattgttggagtaaaattagttcctagacatactatcttccatgttttggtattaaataaacactgaatgaatgactcataggatttttgacatagctgagagatactctcacatatttgaaaacctagttttggggccatttgttgtggtgcacacctgtaattccagcactttgggaggccaaggcatgtggattgcttgagctcaggagtttgagaccaccctggccaacatggcaaaaccccatctctacaaaaaaatacaaaaattaggcaggagtgatggcatgtgcctgtagttccagttactcgacaggctgatgtggaaggatcacttgggcccaggaggcagaggctgcagtgacccaagatgatgccactgcactccagcctgggcaacagagtgagaccctgtcaaaaaaaaaaaaagaaagaaagaaaagaaagaaagtgaaagaaaaagaaagaaagaaagaaagaaagaaagaaagaaagaaagaaagaaagaaagaaagaaagaaagaaagaaagaagaaatctagtttttaagagtgctacaggtaattttattggtgttaggttatgtgcctttttatcttaaatagatttgttcttcaaatcattgtatttttattgatttgttttcataatttcatggttggcaattcttggcattttagaaagaaggtaaaaatttgtaaacaaatacttaaatgatttaaataagctattgtttcaaaatttctttaacataattaaacttaaatggtcactgctttatatttaatttatctttatgaccaaatccagtaagtctaactacagctagtctttccttaagggtcacaggagataagaatgttgttctcactgttaaagcagagttgttcactgcctaccacagtgccagagaatagtaggtgctcaatgaatagttgtggaataaatcatctgtactttgtcatttggttttatgtttcctggagtgaaaagggaggcatttaaattaacaatacttacctacttcctgagattttttcatgcttactctcaaaggtaatttttgtatgaaaaatctttgaagaaaaagacttcaaaagttcttgagttaagctattataaaagagaactttttcactactcagaaaatagccaatgcgttcttcatttttatgaccattaaaatcttaactgtttgcttgattttaaaagtataaactgtattgtaataaatatatgccaatgttgttaagaaacttgagaaatataaatctttgagtatggaaagctagagtccttggctcatgctggaaacagccagttttctaatagagtttatagtagccaagggttttatagtcaatttactagttgttgttaagaaaggaaagtaccaagaagaaaggcaacttggtgcatatcacagcaagtcggagatgggggctaaggcttgaatcagttgatatagtcctgataactctaagtgataatgcagcttattggtccagctgctcccctctattcagagaaatctcatctacaccattgctttaacatagggagagacaaaaggactcagaaattattggttatacagttagccctcagtatttatgggttctacatttgtagatttaatcaaccacacatcaaaaatatttggaaaaaaaacaataaaaaataacaatataccaaaaaaaagacaaattaaaaataccctataacaaccacttacctagtgtttattgtattagatattataggtaacctaaagatggtgagaagtataagggaaggatgtgcataagttatatgtaaatactgtgccacttcatatgagggacttgagcatctgcaagtcttagtatctgcagtggggtcctggaatcagtccctcgaggataccaagggacagttgtatgtttttctggatattatatgtgtatgagatttttttgctttcagtaattgtgattcatagtttcagtatagatctttccagctttcgtttaaacccatttgttgcatcgtattatagtactcccaggaacaaattttggttgtgaatgtgccaggaacagtgcagtaagttaccagtcttttgaagaaagctattaaagaataggtatttaaacctttggaaaggaatttgactatgttattctgaatggttctgattcacctgaacccttcctgtgtacctcactgccagaggagaaaaaccaagtaggtagaacacatgtatcttttgtgtagcagtctgctagacctcaaatgagattactgttgaaaggaaaaaaacaaatttccttttcattacacaaggtaacttagctgctttcaaatgcaaaaacactttctcccacaacctccattctcccttccccagcccctcctctttaattcctgtctggaatggagtcctcccaaatgaggataatcctgccttagctgtttactcacttggttaccttcctgggctctgcaccgtccacaacaggctttgccattttttatttattcctgccagaatgcacttaggagtttttattatagttatggttgaggtggcactttagctctaagctcttatatttatgatttataactttctctctaaattgcatgttgggctagaatttctcaagcacattttctatttagacacaaatgtttcataaaatttgaagaaaatattgggcatggcagcccaatatccaagaattcatttaactcacctgccttcagagttagctgatgcagctcagtgcatcatgtattaaatgttatctgggcattccatagtaggctataaacaaatacctaacttaatgaaactattgtgaaaaaaataattctaggtatctttcaataaaatgaattttaaattatcattgtttcatatttccaaaatacctgtagacatccagatgatcattaaattatgattactcattctttaatagtaatagttgatctattactataaactccaagagagttttaaagagcatgtgttacatatattacttcactcgttcttcctaataatcctacaagcaggtattcttactctgataataacattcagagaggtttaataatttgatgacagtttcctcagctagtcctattaatagtattaacaggattccagtccctattcacctttgcttgttctgctagatgcacccataaacctaaatattctgagttactctttcaacattaatcccacatgaatatgctttgtcatatgttgaagaaaaggtctgtaggtactatcacagtccacaggttgtttggtttgtttattacataaatgctctttccttctctaggggatggctagtgtgtaatcagaagtgaagattcaaggatttttagaggaaatgggcaaatttgtaaacaggaatatggttatcactcaaatagggcattgtagtttaaaaaagaatcacacttttccagccatattgattatgtaaaactaggtatccacaagttgaatcctgatctgttgtgctttatgttctttcctgggaactctacaacacacacatttaaatgaaacatatattgtagaaaaccattggaggaatgttgtagaaatgacagagagtagcactagaaaccttaattttaaatttcatgacttttgtgcaattagaagctcaaccttaacattgcattaacttagattttttgcatttaatcatagatactgggttaaagctatgggagttaacattttaagcctccattaatggttgtaatcaattttttgtattattttttgctaaaataatcaaaagggcatttaacctggacaagaagtaaatctgggattctagagattaatattaaatctgctaatgtatggtcttactattccctggaagcctaggtaatctgatcctatattcaagagtttacaggtaacaagaatctcaggaaaaagtcctagggttcagtatttctctttaaatcgtcatagtagcattgtttttttagcttctcagtgggatgaattttaagcaaatgcagggtggggatacaaggataaaaggaattgacataaaaactaaaggaattgcttaatttgtaaatttaaccctgtaccatgattcttcattagggatatttgctatactgattcagtgccaagcacagggggcaaatgggacagaaagggcactaactatattgaagatgacactagaaatttggagggctcttaataattaggtacttaagctcacctagagaagtgattagcgtttagaagtggagacatggctacaggaacacagataaattagaagggaacaaaatgtccggttttccatagttcttttaagcaactgtagcctgcactggggataagggaatactgtccatgctgcttacacagcatcccacaagtgccagtctgtttggtaccagtacattggactttggtgttacagatgtagcctaggtatgaggagccctgggtttgtttcatatctctttcactaacaaaccagatactctcaaataaatcactcactctcctgatttttccacctttctgcttatggatgtaatgccttcctctcagataatactaatatttataacataaacttaaaaattatgggttgattttctagtttatgtgcacagaggtgttgataatattctctgatggttgtttgtatttctctggggtcagtggtaatattatcctttgcaaactaacacagcaaccaaagaaaaccacagaaaaccaaataccgcatgttctcacttataagtgggagctaaatgatgagaatacgtggacacatagaggggaacaatacaaactggggcctttcggagcatggagtatgggaggagggagagaatcaggaaaaattactaataggtactaagcttagtacttcattgataaaataatctgtacaacccccatgacacaagtttacctatataacaaacctgcacttacacccctgaacttaaaataaaagttagaaaaaaaaaaaaaaggtgggttgaaagcaatttacaactaagagaagatgaacatttatagcacaagagagacttggcaaaaatgtggtgtgatcttacttgggtctagagatacaaagatggatgaatcatttttctcgagcagctcagagtctaatgagggcagtggggaactggaagggtgggtatagccttagcaaagagataaaaacagaatatgacacgagtgataatagagtggtacagtagaggagatgacgtctggatatttgaaaagcagtaagtatgtaggtgtaagtaaacattactaatgatacgatgcaatggaaagaacactagcacaggagctcattctgtcctcgaggcttaccatgtgtgatccaaagtaatactctgttcctgtgtttctttatctgtaaaatgggtataacaccacattgcttatgtcctaaggtagagaagcaaataagagctgtgtatgtggaagcactttgaaaactttacactgctatacaaatgtctaacattattactattgtatcgccaaaaatagtggagaatcaacataacaaaatgggtgattcagaactaaacttatttcaccaaaaatgtcaaataattatgaaagaagtaaaccgtgagacttaaaatgtatgaatgatgcatctgaataaaattttgttacatgcaattgatatgttctggccaccaactagcagaataattgtgactttccaaaattataatcttctaaagctaggaaagagaaacttaaaattggaaggagcctggacacttatacactaaagatgacaggatgaaaaagaaggaggattgtgcttttccaaatgtcaaaatttaaaacgctaataaaatccaataaacaggatatttaccatggctacaacaactagcaaaggttaacttggacaaggactggaaaccattgaaggtacagagggacaacaatcaatgagaatgccaacccccgatgagttctaatctcattggcatgtgctcaagtcatggagctactcctttcacagactgaatgtgactctaatcattatttttgagattttttaatacacatattatttcataactgtgctttttttgcatagcagaagttacttttgaatcaaagtgagaaaacagttcttaggtgatttaactccaacagtttgaataagatgacagaatgctcagacacaaacaggacctgtctctacacatcttagacagagagcagaatattcaaacatgtgtatcttgcacttaatttaaactgcgtggttggttacctatctctttggcaattcagtataaagttttattactgtgaaatagagtagggtagggatttatgtcacacaaaaatgaatttccatggatgggaacacacatgaaataatttaggtaagcagtatgtcaaatgaaaatttaagatgttagagctggtggtgaaaagggaggaagcaaaagaggaagtttgtgtaatagatgataaatatatcacactggggaaagaaaaaggaccacagatactatataggaagttattactaatgttgaagaattgtggaaaacattgaagagtgatttttagggtgaagaaatcaaagcagccgattagtcgaaaagggagtctcatttcaatgtcaatgaaaaatgtaacacttaaaataaatgtgagcctttattattatacccaggaaggaatagaaaccacaggtctagctagagtttctataggtttagccattagatcttttttttattattattatacttttaagttctgggatatatgtgcagaacatgcaggtttgttacataggtatacacatgccatggtggtttgctgcacgtatcaacctgtcatctacattaggtatttctcctaatgctatccctcccctagccccccagccaccaacaggccccagtgtgtgacattcccctccctatgtccatgtgttcttattgttcaactctcacttatgagtgagaacatgcagtgtttggtttcctgtttctgtgttagtttactgagaacgatggtttccagtttcatgtcctgcaaaggaaatgaactcatccttttttaatggctgcatagtattccatgttgtgtatatgccacattttctttatccagtctatcattgatgggcatttggcttggttccaagtctttaccactgtgaatagtgctgcaataaacatacatgtgcatgtgtctttatagtagaatgatttctaatactttgggtatgtactcagtaatgggatcgctgggtcaaatggtatttttggttctagatccttgatgaattgccacgctgtcttccagaatggttgaactaatttacactcccaccaacagtgtaaaagcgttcctatttctccacatcctctccagcatctgttgtttcctaactttttaatgatcgccattctaactggcgtgagatggtatctcattgtgattttgatttgcatttctctaatgaccagtgatcatgagctttttttcatatgttcgttgaccacataaatgtcttcttttgagaagtgtctgctcttatccttcacccactttttgatggggtttgtttttttcttgtaaatttgtttaaattccttgttgattctggatattagccctttgttagatgaatagattgcaaaaatgttctcccattctgtaggttgcctgttcactctgatgatagtttcttttgctgtgcagaagctctttagtttaattagatcccatttgtcagttttgggttttttgccattgcttttggtgttttagtcatgaagtctttgcccatgactatgtcctgaatggtatcgcctacgttttcttctagggtttttatggtttgaggtcttacatttaggtctttaatccatcttgagttaatttttgtataaggtgtaaggaaggggtccagtttcggttttctgcatagggctagccagttttcccaacaccatttattaaatagggaatcttttccccttttcttgtttttgtcaggtttgtcaaagatcagatggttgtagatgtgtggtgttattttggaggcctctttctgttccattggtctatatatctgttttggtaccagtaccatgccgttttggtaacagtagccttctagcatagtttgaagtcaggtagcgtgatgcctccagctttgttctttaggcttaggattgtcttggctatatgggttcttttttgattccatatgaaatttaaaattgtttttttctaattctgtgaagaaaatcaatggtagcttgatggggatagcattgaatctataaattactttgggcagtatggccattttcacgatattgattcttcctatccatgagcatggaatgtttttccatttgtttgtgtcctctcttatttccttgagcagtggtttgtagttctctttgaagaggtccttcacatcccctgtaagttgtattcctaggtattttattctctttatggcaattatgaatggaagttcactcatgatttggctctctgttattggtgtataggaatacttgtgatttttgcacatggattttgtatcctgagactttgctgaagttgcttatcagcttaaggagattttgagctgagatgatggagttttctgaatacacaatcatgtcatctgcaaacagacaatttgacttcctctcttcctatttgaataccctttatttatttctcttgtctgattgccctggccaaaacttccaatactgtgttaaataggagtggtgagagaaggcatccttgtcttgtgctagttttcagagggaatgcgtccagcatttgcccattcagtatggtattggctgtggatttgtcataaatagcccttattattttgagatacgttccatcaatacctagtttattgagagattttagcataaagcggtgttgaattttatcaaaggccttttctgcatctattgagataatcatgtggcttttgtcattggctctaaactgcttatataatggattacatttattgatttgtgtatgttgaaccatcattgagtcccagggatgaagccaacttgatcgtggtggataagctttttgctgtgctgctggattcggtttgccagtattttatcgaggattttcacatcaatgttcatcagggatattggccttaaattctcctttttttgttgtgactctgccaggttttggtatcaggatgattctggcctcataaaaagagttagggaggagtccctctttttctatgatctggaatagtttcagaaggaatggtaccagctcctctttgtatctctgatagaattcagctgtgaattcgtctggtcctgggctttttttggttggtaggctattaactactgcctcaatttcagaacttgttattggtctattcagggatttgacttcttcctggtttagtcttgggagggtttatgtgaccaggaatttatccatttcttctagattttctagtttatttgcatagaggtgtttatagtattctctgatggtagtttgtatttctgtgggatcagtggtgatatcccctttatcattttttattgtgtctatttgattcttctctcttttcttcttgattagtctggctagcggtctatctgctttgttaatcttttcaaaaaatcagctcctagattcatcaattttttgaagggtttttcatgtctctatctccttcagttctgctctgatcttagttatttcttctcttctgctagcttttgaatttgtgtgctcttgcttctctagctcttttaattgtgatgttagagtgtcaattttagatctttcctgttttctcctgtgggcatttagtgctataaatttccctctaaatattagtttagctgtgtcccagagattctggtacattatgtctttgttctcattggtttcaaagaacttatttatttctgccttaattttgttgtttacccagtagtcattcaggagcaggttgttcagtttccatgtggttgtgtggttttgagtgagtttcttaatcttgagttctaatttgattgcactgtggtctgagagactgtttgttatgatttccattcttttacatttgctgaggagtgatttgcttccaattatgcggtcagttttagagtaagtgtgatatggtgctgagaagaaagtatattctgttaatttggggtggagagttctgtagatgtctatttggtccacttgttcccagggctgagttcaagtcctgaatatccttgttaattttctgtctcattgatctgtctaatattgacagtgggctgttagagtctcccactattattgtgtgggagtcaaagtctctttgtaggtctctaagaactcgctttatgaatctgggtgctcctgtattaggtgcatgtatatttaggacagttagctcttcttgttgcattgatccctttaccattacgtaatgcccttcattgtcttttttgatctttattggtttaaaatctgttttatcagagactaggattgcaacccctgcatttttttttgctttccatttgcttggtaaatattcctccattcctttattttgagcctatgtgtgtctttgtacgtgagatgggtctcctaaatgcagcacactgatgggtcttgactctatccaattttccagtctgtgtcttttaattggggcatttagcccatttacatttaagattaacactgttatgtgtgaatctgatcctgtcattatgatgctagctggtaatgttgcccattagttgatgcagtttcttcatagtgtcgatggtctttacagtttggtgtgtttttgcagtggctggtaccggtttttcctttccatatttagtgctttcttcaggagctgttgtaaggcaggcctagtggtgacaaaatctctcagcattttcttgtccatcaaggattttaattctcctttgcttttgaagcttagtttggctggatatgaaattctgggttgaaaattcttttctttaagaatgttgaatattggcccccactctcttctggcctgtagggtttctgcagagagatctgttgttagtctgatggacttccctttgtgggtaacctgacctttctctctggctgcccttaacattttttccttcatttcaatcttggtgaatctgacgattatgtgtcttggggttgctcttcttgaggaacatctttgtggtgttctctgtatttcctgaatttgaatgttggcctgtcttgctaggctggggaagctctcctggataatatcctgaagaattttccaacttggttccattctccctatcactttcaggtacaccaatgaaacgtaggtttggtcttttcacatagtcccatatttcttggaggtttgttcattccttttcattcttttttctctaaccttgtcttcatgctttatttcattaagttgatcttcatctctgatatcctttcttctgcttgattgattcagctattggtacttgcgtatgcttcatgaacttctcgtgctatgtttttcagttccagcaggtaatttatgttcttctctaaactggttattctagttagcaattcttctaaccttttttcaagcttcttagctcccttgcattgggttagaacatgctcctttagctcagaggagttcgttattacccaccttctgaagcctacttctgtcaattcctcaaactcattctccatccagttttgttcccttgctggtgaggagttgtgattttttggaggagaaacgacattcgggtttttggaatttcagcctttttaagctggtttttcctcatctttgtggatttatctacctttggtctttgacgctggtgatcttcggatggggtttttgtgtggacatcttttttgttaatgttgatgctattcctttctgtttgttagttttccttctaacagtctggcatctctgctgcaggtctgctggagtttgctggacatccactccagaccctgtttgcctgggtaccaccagcagaggctacagaacagcaaacaatgctaccggttccttcctctggaagcttcatcccagaggggcacccaccagatgccacccagagctctcctgtatgagctgtctattgacccctgctgggaggtgtctcccagtgaggaggcatgggggtcagggacccacttgaggaggcaatctgtcccttaggagagctcgagctctgtgatgggagatctgctgctctcttcagagctggcaggtgggaacgtttaagtctgctgaaactgcgcccacagctgccccttcccccaggtgctctgtcccagggagatgggagttttatctataagcacctgactggggctgctaactttctttcagagatgccctgctcagagaggagaaatctagagaggcagtctttctacagtggctttgccgaactgtggtgggctccacccagtttgaacttcctggtggctttgttttcactgtgaggggaaaaccacctacttaagcctcagtaatggtggacacccctccccccaccaagcttgagggtcccaggtcaacttcagactgccgtgctggcagcaaggatttcaagccagtggatcttagcttgcttggctccatgggggtgggatccactgagctagaccacttggctccctggcttcagcccccattccagggtagtgagtggttctgtctcactggcattgcaggtgccactggggtatgaaaaataattcctgcagctagctcagtgtctgcccaaacggccgcccagttttgtcttgaaacccagggccctcgtggtgtaggcacccaagggaatctcctggtctgcaggttgtgaagacggtgagaaaagcatagtatctgggctggaatacaccgaacctcatggcacagtccctcgcggctttctcggctaacggagggaattccccaaccctgtgtgcttcctgggtgaagcgatgccccaccctgctttggcttgccctctgtgggctgcacccactgtctaaccagtcccaatgagatgagccaggtacctctgttggaaatgcagaaatcacctgccttctggattgatcttgctgggagctgcagacgggagctgttcctattcggccatcttgccagccagggtcattttttaaacttttcttttgcagaggttaccaaaggaccagcagcaagcaaaacttctctcccctccccaaaaatctttctttccattgattctattttgtttcaatccagtcctgattgtgagaaagctccctctcaggacagctctcctggttctcttcaggctgataatggaactctggtatgatggaagggtatgaaagtctttttctaaatgctgtatgtcttgccttttttgtatatttgtgtaaagaaattcatagtagtaattctctgacactgagttaaaagaagtcttatttttaatctgtcttcacttatctagtcctcaaacttaggctaaaatctcaaatggactataaaagcactacaggatttagaacttaattagataatttagataagggacaagaaagaaagaaaaggagagtttaatgtttctaaattgatgtcatctaccaagagctggaacacaggaggaagaaggtttgacttgaaagggcaaggagtgcttttggtttgggacttgaatttaaggtggcacaaaatatttagattttcttaaaatgcccaggatactataggcaatacaggttttgaagctccgaagaaaggtctgggctaaagatcaagagtcgggagttatttgtgaggaagtagtaggtaaagccataagactagataagatgactcaaggaaaaattatgagagaaagaaaaactcagagcagaacactaggaaattctaatacttaaagaatagatgagaaagaggagccaaacaaaagaggagagaaaactagagatagagaatagggaaattaggccagtattattaaggaaaccagggatgaagtatttcagggaggggcagtgatgagaattaaaaaataaaactgaaaatgtccaataaacttgactcaaaagaggtcagccatgacactgagagtaaagtatcaaaagggcgatgatcattttgagacagtagttaatacctgtaatttcataggtggtaatgatgttaaaaaccctatgtaactaaaagcacttcttttaaattacctagttcttagatttctcaagttagctcttcacttgtccctccctttagtattattttaacttttcaaaatgtagtcacacattgctcaacaaagggaatacattctgagaaatgcatcattaggcaatttcatcgttgtgtgaacaatatagagtgtacttacacaaacctagatgatagagcttactacacacctaggctatatgatatagcctattgcttttaggcttcaaacctgcacagcatgttactgtactggatactgtaagtaattataacagaatggtaagttttcatgtatctaaacatatctaaacattgaaaaggtacagtacaaacacagcataaaagatcaaaagtgtatgcctttatagggcacttacaatgaatggatcttgcagaactagaagttactctgggtgagtgaatgagtgagtgatgagtgaatgtgaacacctaggacattactgtatactcctgtagactttataagcactgtacatttaggctacactaaatttatgttttaaaaagtaattgtgctgtgatgttatgatcactatgacatcactaggcattaggaatttttcagttatcttataatcttgcaggaccacagtcagatatgtggtccattgtagactaaaatgtcattatacagcacataattgtgttttcacataattgtgaaaaaaaataggacttcctttaactcagtgtcagagaattactactacgaatttctttacacaaatatataaaaaaggcaagccatacagcatttagaaaaagactttacactttatttggaaaacatgtttattggggatgcagtacacaaaatatattaaaaggctgtggttgtcacaatacatttccacaccaacaaaaccccaacccatcatccctaccttctacctaaatattataggataaaacacaaagctagaatttttaaaaatcaaactgcttttactaccttctgtaacttctgtactttccaaaccagctatgttctattctgaattcattcaactaactagagttctgtgggtacactagtgaaacaaatgtactatcctcaaggagcttacatatcagtaaataaattattaaaggtggaaaatgtggtaaaagagacataatgtctcggagagagaacaaatttctgctttaggagtgttcttagttaaggtaacattagcttctataatacgcacactcccaaatctcagtatttcaacatgagtttctctcttgctcatgtaaagactggtcagggacccaggttgacagaggctcttcagtacatagcttccaagattgctgtgggtgtgacatccagccagaaatctggtgaagagagagcaatgattacacaggaacttttaatggaccaggcctgggacagcgtatgtcacttccaccaacatcccactcaccagaatttggtcacagggccatagctatctgcagagaaggctgggaaatggaacttagctatgtgctcaagaggaaaagtaaaacagttattgaataattagtaataattagcaagtaactacctaggggtcacagaggacctctcaggtagaatttagacttaaagatgatgggggagtgtgtggaagagtggtgcagaatagggaaaggggggattgaaggaagaacaagctctagcttcacctgcatgggtagagcccacagtgttggtagggacatgttagctttcaacatcagcttcttaacagtattattctttcatcggaggaaattagtctatttctgaggaaaaaaaaatctgcaatacgtagcaatttacttacttggatattgaatgttaaagcagagagagactttgtcctcaaaaccctcccatttcagaagtgaggagcctggggaggtcatgctctctggatgtcacacagtgagtcactgtcaaagccagaatagaacccagacctctcagtttcccattccagtgctctttctatgaggaaagtataagtttgagcatttttaaaccttaaatatgtagaaataaccatgatattttatcgtaaattatttcagtcatctcattttaaattttactccaaactaaaggaaaacggtactgatttaaaacatctatcataattcaatatagcccatatttcttctttaggaaaaatttttttttgttttttatcctgaagacccgtgccctcttcctgtgtctcatgtagacatttcacagtccaaatatacagagcaagaatagatgaaatcaacatgtttaccattattctatctaaattttcaaagaaaaagggaacaaaaggtgagtgatgactgagttgcatggctataattgagtttttgttgcttttatttttataatattttaattgacatagatgcttaaatgtatatcaaaatgcatgtcacagctcttgtacaaagataaatttgactctagagcacattttctttagtgagaatgataaattatctcagagcttgtgattctctacttttaaaaatcataaggtcagttctttaattaaaagataaagaaaagtaggcattgtccatgtagtgaaatcacttttatcaggataatctagtaaccaaaaaaaaaaaaaaattatgaagggaaagacacaatctatcttcagaataattggtccaagaatgacttttttatagtctcataagacccacatctagaagtctcccatcctagtaaaagaaaatgaaaactctactgtgtacaacaaataatttgttctaaatttactcatttcatttttaatcataggccttagttattttatcctattaaataataagtctcttatatatcaacattctctttttcaaaacaattaacatgaatatatggtcagcctccagtataggaaatacacatatttaacatgaagttgcaattactggtaaatatatgttgttaaatacagtacagctgtatgttcccttaccctagcctgacagcctccttcatttgtttccatggaggcagattagacaactaccttttacactcctgagattatggctcagtattgcacagaccattagataatggaatacagctgaacatatataaaaaccagctccaagaatgtctgtggacagaagtccaaaggggtagcagtatctggatgtgtgagtatgtgatgacaatactctacaaacctagataccaaagggcttcctgcccccttcagccctgtgaaataacatggatattgtcttacccacctgatattttagcaaactgccaaggcttattgatgaaccaacactggattgagtgccagaaacattctgctccctaagatttgccctcctgtgagactcccatcagatttttggacctgccatctagtggccactgcagtaacaagacaatcattacattttggccttcttttattttttaaatttttattttttttaaagttaaatgtggctcatctgcagctaaatatggaggtgctccacccattaaactatagttcccacctccctggttagatatgctgccgttttcatagagcagcttcaatcagaccatttgttatgttcaaagaaaaacagatttttcacgcaaaatgatacacttcccacctggatttgaaaaaagaaagtaagtcttcttccattattgaaaaaagatctggaggaggggagaagggggagctggagagcaggcatatattctgtcaagtagttctacttgtgagactaattcttccaaactgtgcacccaacagagtaaacctcttattttgctgcttttgcactgatcccccacatagctgtaatgttctagttgttttccctgtcctataaaccacgtagacatttgctattatacataatgttggcaaaggaacaatttacaaatgacttaagcaggtaattatttgttagaatataggtctatggaagtatatattactgtagcaaaacctggtaaaaggttagttttgtttctgtgtttctattataatccctggttgttagtttttctttttccagggatttatgagtggaatgtaaaaatgcacagtgggctattattattatttattatttatcaaaggaacatgaatatacagagcaaaggccagtttgtgaactatgccagacagttccccgtccaaaagacctcaaaatacaactctgaagcaggtcctaaaaaatgcaggacagaatgaaagcagatgggtgaatgatacttattcaatatcttaaatatagaactcactagtgcaggtgcatcttcagatgttatttgaaagaagagacagaatatcttggcattgtgtcatttattcataaatattataaattttatattatttgagaaaatattctaaatatgcaaggtagtttaaaagaaggtgtgaaagctgattccttcaaatgagacaaagggcaaatcgagtgactgaacataagaaagtggagaagaaccaggccaaggatggagccaaggaaaaacaaatcccacaggaacacttaaagtttgatggaaaaaatgcagggatttaaaaaaataaagattccaaacaatcaaggaggatgatgatcttggcagctatgccttgaatatactaaaattgccaagagaatccaggaacaataatggcaatgacaatgatttagctgtgggaattgcagtgcaagagtgtagaattctgtgtagtggacataggggttggttctggtctcaaagacagtatcatagagcaggaagaatagttagatttagctaacagcagggtaaaaggtagaaaatgtttgttgaggaagatggaagtctatgaagctatctaaggaggccatagtattttttgaatacccgttatctgccctacactgtgttagtttttactgagtatactgtagttgtaagtcaggatccttaggccaaaaataaacctattttaaagtgaaaaggtaagaataacccatatgaaacaattagaaaatataaagcagctggtgttgttagggatagcaggattttagaggagggagaaatcagcaggcctcatggtaatcatagaaaaaccatccgagaagtaagacctaagctgggactcaaagaattggtatgtggggaatagacataaacaagggagaaatatgatgaaatcatctgaatagaaatgaacatggtgttttgggggagtagtgaaatgactttactcggtgaaatggatggtttgagcaggaaaggagggagaagctggtaggatagtaaagcaaagctgttgtgtgaacccaagaatataaggattcatcagcatgttatagggggcatttattaattcatcctgaaagtatttattgagggcatattatgttccaggcacaaattaaacaaaacttttccccttatgaaatttatatttaatgaaggaaaatagacaccccccccaacaaaaaaagcaaacaaataaatgaacaagttaagtttagagagcgattagtgccatgaagaacattaatctgagtgataaaatagagagtgacaggctagagtagtgatggtcccaaagggggagagtagagagtattcaaaattggaggccaggcacagtggctcatgcctgtaatcccaacattttgggaggccaaggcaggtggattgtttgaggtcaggagttcgagaccagcctggccaacatagtgaaacctcgtctctactaaaatacaaaaattagccgggtgtggtggtgcgtgcctgtaatctcagctactcaagagaccgcggcaggggaatcgcttgaacctgagaggcggaagttgtagtgagctgagatggcatgactgtgcactccagcctgggcaacagagtgagactccatctcagaaaaaaaaattggaaattctcaagacttggagataatttggatagggaggagaaagggtagacacaggtgatatgtagctatctagtctaggaaattaaagtttgtaatgccagtatataagctggaaagatggaaagtgagagagaggaaacattgaggaggtagtagaaaagctaagtgttcccataactcccccttgatgcagttgtctaccaggcaagtttcccaattccttgaaaacgttagcccctagctcactaacactctttccatttctaccccattacaattattggttattcactgtgtaaatacacgctccctctaatacctcctctcaatttcttgaacttctcatgattgattctccactctgccatagctactcattcccatggctacatttctgatgttttaattactaataattacaatattccacaatctcaatttcaagcattccattttccaaccacagcctaatgtcttggtagttcaatccctttgttacccctaatacaccaattccttaaacccactaggacccctaattcattgattttacccatagcttctcatatgctcacttcattatatagcgtagattccatggacaatgattttaatcatttccttgtatgcgcctttaacaccattgaccttctctgacttaactgtgctctcttgacaaatctcaactatactgatcatatgcaactcgccatctatttcatgcctgtgtgccagctgaatgtggctggagaaaaacacacaagcaaatgtatgactctcagtttaaattcatgatccctcaaggaggccgttaatgctgcccagcaaatataatatgtttccttgtcatttactcttccatatctgtacaagaatatttcatatttttccctctctcaaatttctaacacctcctcccccatccttacgctcaacttagaacctttctttttacttcactgaaaaaatagaaaccatcaaaagacaacttcacaaatacttgctgtccagcacacctaccctcccatatttatctgtacccatgtattttgccttctctcctgcaactatggataaactctgtgtacccttggctcagcccatccctcattgtgccttagaatctctctcctcttgcacatgcataaacagtgctcctgaaaaagctcacatctttcttctgttttatcaaattttctctttctatcaaaactttcctatcagtatacaaacacataatttatctcatcctaaaaatacccttataaaccatactccctagcagctcctgtcccatttctttgatttccattacagcaaaacttctcaagaaatgcgtatagtcactataaacactctccaatcctatgctctggttctcttttgcccctctagttagcttttgcacctaccagtctagtaaaactgttgatgctaaggtcaccaatgacttccatgttgctaaatccattaaccattcggcagtctttgtctttcctgatgtctcagaattgttttacatggcccattattcattctccattaaaacactttcttcgcttggcgttcagtccaccacactctcctgatttttttcctgcctcacagtctactcctcctcagtctcttttgctagcatattctcatttcccaagcaggtaaacattagagggccctagagctcaatctttgaagctcttctcttcagctccattcactctcttaatatttgcacccaagcttatggtgcaagcttgtatctctagtccaggcctttacacagaattctaggctcacatattcagctgcctattcaacatctccacgtctgtctaatgagcatctcaaacttgacataccagaaatggaattccttattttaccaagcaaatacatagcctccccaatattggtaaataacgctccacctttagggttactcaaatcaaaaatttatttctctcccagacctgtatttctctcacaaacccaaccattgaacaaatcctgcagctctaccttcagaataagtccagaatcttaccactcctcatcctcatcaccactactaccctaatccaagcaactatcatttcttacccggattattgcagtagcctcctaattgtcttccctgcttctggccttaccacttacagtctattctcaaaatgatagccagagtgatgctttgcaatatatgtaatgtaatttcagtcagaccacatcacttctctgctcagaactctctaatggctcaacatctcacttggaagaaaagcctttgcagtagttcacaagaccctccatattcaatttccccattacctctctgtcttcatttagcgctccaccctagctcactcccctcaaccttcattgacccccttcctaacctccagcctaccatgcatgatttcacatttgcacttgcttttctgaccgccttaaatgttttccccagataaggcttgtttgcttatcatcttcaggtctttgctcaattttcacttctaagtaaggcctttcataaccactgtatttaacatttagctttccaccccttttggttcatagcacctactgccttcagacaaaatatatattttatttacacatttatttcctcttgccatggaatataagccccatgattgtgaggtttttttcggttttgtttgtttgttttttgcctgttctatgctctaagaaatcctcagtgcctagtacagagcctggcacatagagagtgttcagtaaatattcgttgtatgaattgaaggaagtaataactgattctttccctgggtttggaggtgttttattaaatgcaaaacataatattgtggcataggctccatgattctccatggcaaaattttcttattcttcaaaattaattttgaaagtaagagtgctttatgcaggcttatccagaatcttagataggccactatttctgttcagcacccaaagcagcaacatccaaagcatttattaacttttttttcattcagtaaatgtttatcagggaatatgggtgttctagacacaggtggtgacatgtgcaaagactcagaaacttaagaaaatatagtacaatgtactgtcgcaatattacaagtgacagataatgatgctctgagctaatgtggtgcaatggggatgagagaggtagaaatgtgaaaaacgttatgaagtgaaagggcactagattcaagaaacctggttagtggagacacaaaatattgtctacctttatcaggctataaagtggaaagtgattataaaagagttagataagaatgaaacttaaacatagaggacctggattgtaaattttcctttgtagggtatagacgtaaaatttctcattttcagagtgactataaaaacattcagtgtgtctactggtgaccttggcaaaatcatttgaaaggtgttcccagatcagaccctaactctcattcttttaacattctgactgacagttgaaatagtttgaggtcccaaatttttttgtctagtaatctcacccttcctgaaagtaatttttcttattttatgcaaaaattgctatattaagacatagaaaaatatatgtgtgtttttaacaggtaaaggtgtaaagaaaactaggcttttaaaatttgtaagtttaataaattaatattagttcaaaacccaattaactgtaaatattgctttctattcaaaaaaggcctcctttggttattaggattgcacatctatatgcacgggtgattatttgaaggtgagataaaagcaaccatgattcttcctaggtatggaactttggcagatgggtgaatggtaatactattaatatttactcacatagggaacataggaggaagagaaagtttgaaggaaaagatgagttcagctttgacatgttgaatttaggatgcttttggaatatctaattgtaattgtctagtaattcatttgatataaagggttagaggtcaagagataagtaatggctcaagatacagatttgaaaggtatttaaaaacagggagatatgaatgtccagtaggcaatggacatattagtctgaaatatgtttaataaagcattacaagatacagacctgaatatcaaggaacttacaaacacttatgtgatattttcctagactgattttctcttaaatccactcccactcatccctcaaaccaacacacatcctatccccagctttcatttaaaatgcctacgatttaccctttacattgcaggtataccttgatttctgtagtaattgtatacctcaaaatctcatgccgaacaaaattatgtacatgagatcacgtagtcagttgactcattactctaagaaactatggaatgagtcaatttgcattgttaatgacgtccccctatttatcaccccctttaagtgtttttgtctgatttttgtgtggggggtacatcatattcaactgatataatgtcaaattattgagatatttaaagagactcctgttaaacagtgagagagaagtcatctttattctttctatttccatctttattctttttttctttttctttttcatagggaaggaagcagaggtactcagaatttaaataattccccaaaggtcagcctacatttaaagttaaatgtaactttaaattttattgctctctgagattcttttttttttctagcattgaatcatttttaaatgttttcttgccatttcccttttgtcacccctataacctcagtaggtttacttgtttacctttttattctagaatatcttgtgtctgttctgtctgacaatacttgaaattttcctgacaggcagccattgagtgaacagtttatgtagttttatagcagtagttgtaatctctgctgtcccagttttctagaatgtatggttgtttgggacttctctgtgctctgcccctttattggcagtctcactttctttctcgtgtcttacctttatctctccagaaaagcttctgcaaaatgtatctttcccaccaatcacaatgctgcagtcttagtgtatgcagtctctatggtaactgggaaacatgccacaacaccaagattactagagcaaccatcagagtggggaaatcagcgcatgccctcctctggcacgacagaagtttccccattgaaactggaatcagatacctgtattttaatatgcagggcaaggagggtggcagaggaaatgctataagcccagtctctctaaaggcacattactggggtttgatggaattcttgaagttgatcttatttatcatgaataaagctagagtcatgtactgatcctgagcagacatggataaactggttgaacttgaggagatttttttttcctgcagatacatgactagtttgtaaacaagagaattttactaaattagtatatatgcttaggtaagctcagggaaattaccaatgtactgtaaaaattatttacttgcattgtagagacagactttttcagatgatttccctagcaattgcattgttgacccagggaggacaaaaggcaaaattggctctctctgagcctgccttagagtgggggcagttctattaggtcttgaagggaatgaggatgaagcaatgaggcttttctggggtgcttcctttaggactgaacttcattccaaatatgcagaggatctgactcccaggtacagcccaatagaaacaaagggcataaatcagagtttcataactttggccctattaacctttggggccagataaatctctgtggaacagggctgtcctgtgcactgtaagatgtttagcagcgtccctggcatctaccctctaaatgccagtaggaacttctctaactgtgacaacaaaaaatacagatatcccctgactgggggcaaaaattagccccaggttgagaaccactggcctaaagcaagatgcagcttgggtaagaaaagagagttggagaatcccttaaagggcccagaatattcactagttgatcattcagcaggtatttattgagcccctgttatctttcaggcactcttctacttaccagggataccactgtgaagagtcatgatcttgtggagcttaccttctagtacatgcatgccacatgttcctaactagcaggttccccttccctccacacagcataacagcaaatgcttcaagccaactgagggccaagaaaagaaaaacacaagttcatatttgaagattcttttttcagtttatgaacctcaaaacggctttgatttaaaaatgaaacttggcaagtgattagttcatatgttttagtttataatatgttttaatcattttgggtgttttcaaaacaaatggtgagattaggggttttttttctcttctatttttggcccctttcctctggagagtccttctcttgtgtttagttcttggtgttcttagtatatttgaagaatgcttttaagtatttgaaatgtgtgtacatggttgaaaggggatgaggaagaagaaaccgaaaacttcatgaccctgctcaaaccaatacccataccccagccctaaagcagtgtccgggcaccacatcttcaaggaaggccccttggaaacccctcatgggccagtcctctgacccaggtgatctcctaaccccctttatgtattcttatgaggatatatgataaagaacggactgtgagatttgttgttcaaatttttccccttagaatgtgagctcagtgggtaatagtaccatgttggctctgtccacagttctactatcttcagcatagggcctggtatacagtaagcgcttaaaaaatacatgtcaaatggctgggtgcagtggctcacacctgtaatcctagcactttgggaggccgaggcgggtggatcatgaggtcaggaattcaagaccaacctggccaagatggtgaaatcccatctctactaaaaatacaaaaattagccgggcatggtagcaggtgcctgtaatcccagctactagggaggctgaggcagagaattgcttgaacccgggaggcagagggtgcagtgagccgagatcgtgtcacagcacttcagcctgggcaacagagagaaatttggtcaaaaaaaaaaaaaagaaatatgtgttgattgactgacgaactgactaagaaacctagcttttgggatgtccttcccaaacactttaagcctgcacactgcctgtggtttaacgtgcctctagtatgagacctcattgtcttccttattactttgtaaactgtgaagtaacatgttcgctatctagttccaagctttgttcagtgatttagaggataaatgcctatgactctcagtgtcagaaacagagtaaaattacatatcttatttacttattttcttgtttaatatatgttccctctactggaatttaaactatacaaggtggagaacttgatctgccaataatgttatcctctgtgcctagaacgatgtctgacacataggagatactcaacaaatgtttgctgataaaataaatgataggcatttcatctattaatatattgattgatagattgattacttattagtgaacaaaaaatgcagtaacgtgatgaagttcttagtcattcattcaatatcctagagcagttcctagcacatagtaggcactcagtaagtacctgatgagtgaaagaactgattccaatatactgaagattttttcttttactgagtatatcagttttctggggctttgtaacgaactaccacaaactgagtggcttaaacaacagaaattttttgtctcacagttatagaagctagatgttcaagattaaagtatcaacagggtcggctccttctaaggctgtgagttccgtgactcccacccagcttctggtggtttcctggcaatctttggtgttccttggcttatagaagcatcagccccaatctctgccgtcatcgtcacatgatgttctccctgtgtgcatgtctgtgtttaagtttctcttttttataagtacactagtcatattggattgcaggcccactctacagcatgacctcatcttaatcacatcttcaatgaccctattcacacatctattcatattctaaagaattgggggccagaatgtcaacatatgaattttaagggaacataatcaacccataatactaaaataatagagatcttcaggtagtagcattttgatggatgacttctatttggaaaacctcagcttctcaaaataacgtatagatttatgattctatatggaaattgatgtggtaatattaaatagcatttactgtgttataccaagacatatatgtttatagagaggaaacataaagaaagtacaaggggcatgaatgtacatggcatatatccttgaatgctgagtagtgtggtgtcaccagacaatgggttatgtggggaagactgctgagaggtgccaaagggatttgtatatgaagcaaagcggcttgggggttgggcttcattttacaggcctccaacatataaggcaaaacttattgaatggtaaatgagtatagcaaggatgaattttattgtatgtaaattatacctcagtgaacctgacctttaaaagaaagaaaacaatgaggttgaagaatggattttggaagctaacaattcagaagtgtttggtgactttggcaaaaaaaaaaaaaaaaattgtttaattagaaacacagctagagaaaccagattgtaatggtttgaggaataaacgggagcttaggaagcttgaaggtggcacaaaagagggaaagataaagtctgcaaaagatggtttgttgtttgttagtttattatcattgttattgttgttaccttaaatgaagacagctaaagcatgttggcaggcagtaggaaaattgaaaatacaaaagaaaggaaaagtaactgatataataagatcctggatgaggttatcagtgctaggcagaaagatctctgaaatgttacaggcggattcattggtggcaaaggtggagtgataggaagtgccatttgatggcctctgttttctctatgcaaaaggaggcaaggttactagctgagagtgaagggtaggggatgggttataaccagttaaatagagtaatgaatgaaactgtggagtgaaaaaggaaactgactaggagcaaattttaaaattgcaaactaattctgaaattcgaacttatgctggaaaccgtaattctgcaggagcatcaagctgtacagttttgtgctttttctccagcaaggatcagcagcctggaagctgaggagaacatacatgtgggttcatctgagctccagaactaggtaaatacagttgagaactgtagatgagggaattgatggagctggtgggtatctctaaagttaacaaccatgggcgtccagactggtagagaagaaactggaaaataatagtctgggagaaaagaggaaaaaacaagaaaaccaaaaagtcagggtgagaaagtagagtacttgttttctggagccatatgtgtccccgtaaggagcccggccttacaaaacaagtcttatgcgacaggtctcagagaaaatgcagaaagtagaatgaacacattacagggcatagactggattcaagaacatagcctggtggtcagtgtttcattcctaacttgccactaatttaaggcagctgtcattaccaccattatcacagaatgctaatccttaggaaaagaatgtaagagtagaagaaatacctgtgcatgtaagagcagaataaataggaacctcccatgggtcaatggcaataaacttgacaagaagcaaattgttttattttttgccttggattccaaaagtgtgctgaggtttccctctaggcatgctcttttacttttcttaagattatcgatttattctgttagagagtctacagaggtgacactcttcttttctggccctcgctctccctttctttgttttctctttctcctcatttcctcctatcttaatggattgaatgttgtcatatgtctcagcaaccctccccaacccagtgaccaaataaagtattccccattacttactattggattttgtttaatccccaagaagactgggctaagaagttagtgcttgtttagaaaacacttttaggtactttgcagataacactgtaccactaatccctcatgccctatacatttagatgaacctgggtgtctctctctggtattcgtaagaaaagctctgctcctatgggccctgtctccatatgtcagcctagcaaagtaaccaaccatgttatgcactgtgagataccatcctctagttatcctttacttgcttgagtggactgagatgaacataatatacaaggtttagtagttcctaaaccctatgagaattcctaagctccttctcttgatgttgtcaatatataagttcaaaaaatagctttgggggaatttcaataaacaactctaaataagtcctctttcctttgcaaatataaatcctttgttaaattttatttttttccttttgttttctactcctgattctgttatagctctagcaatgctaaaaacaagctggtttggagattaatatgaccagacataccatgaattttttaaatctcaaaagtcccagtttatccttcttggtaaatcgaatatctgttatatatacatacatatacacatacataaacacatacatacatacatacatatttatgcagtatgttattatgtcttctctaaattcttttttttttttgtctccctgtctcctagaattcttcctaaatgcttttttttgttataataaagaggtaggagaaagaaaacctgaagaaatggaggagaaaagagtatgaagtgctagaagatggaaggagaaggcacactatggaataagggaaaccagtgaggagattgaaaaagtagtgattttcttttcccgagttcccttagactgcttttaggtttggttttgatatttctctcacctagtgccccaaaatgacctctccctagcaatttgttccataaaaaatattcctcttactgccagaaaatatctcttacctgtcaagcaggttgaaatatcctgccccagcatctaaacatcctctccagcctgccaagcccctaaccacctgacccaggggacttggacccattgccattagttctacacaccccctaccccatgccagcatggagagtgttaatggctgatgtaagtgtgaaagaacataagcgataatttggttttactttattaaaattcaaaatataaataggtaaactacatgttgaattcataaaattcttcctccactgtttagaaatacaaaaactgcatttttagaaaagggattgattggtgtcatgtacgtatttgttcacgtctgttgatgcaagataataagagtattaacatagaggtggaataatggtatttataatttcatcaccactgtttatataagataaaaatgtctgaaagcaacagagagaacatttgctgctctatacatacattaaattctcccatttttgtttataaagcatatgaggaggaaaaacaagtttaacaaattgaggaagagttagtgttctttttaccatgtccactgtcatttacctaaggtagccaggttcagaaaataccaaaatatagtggagagggtaactccttataagagaatatagggaccagaaatatgcacttggttaactgttctctgagattgagattacttgagctagattatggtcctctgttcaatgcagaaattgttctaccccagagagtagtgagtactacgtctgggagaccagtaacttgtgtgtaatttgcctgtaacttgagatatgtatcttaggggctgaggctccattccctctttcaaaaaagaaaggaaaaaaatggtgcttcagatcagattgtaaggactcatttcaaaaacttaaataattctgggtagacttttatattttcatggctgtttgagaaagaaaagttagttgggagtggagaaggggtttctcatttatataaaaattagctgtgttgatagtatagctcacaaaggatcaggtcattcatgaaaggttaatggatgttacagggcaaatgaataaaaacaaataaagaacaagaagaggaatcatcatggcaggtggttatatttataacttgtctaaagtgggctaataacctgtcagtgataatagagacagaaactctccaaaacatacattagagtggaaggtccttgagggcagaagtagaatccagttggcagagtaatcaataatagactcgggaaaactatttgttgaattaatgaatgaatgcatggtgttggaaatactttgtatattctcccctatcttaaccaactctcaagataagttcagaaactttattaggctgtcatgaaagagttgatatttaacaaggacataaagcaactaatttttattaattagttccttttagtccccattcatattcctatccctgtctattttattgtctgttggaccaattttgcatgaaaatgttaggagatgaagtcagagaaatagtaagggacatactgtattggtctaacagaccatagtaaaggctttagaatcctaagcatcagtgagcctgaaaaagtctactgggcaggagagtctttgaaatcacaacaaccctatttttttcagaattaccagatgagacacttcagccaaaggctggagccctagatataagagcttgatttaggctatttgttaactgtgatatttctgaccagtataaataaaaataaactgtgcttcactggacctttgttttttgcctattgagctagttttatccatcaatttaccccagttggcagccttacctaagagaagcttagggagcagtagcaaatgtgtttttcagcacactgaagaccttatagaacttatctataaggtctccagttctaaagtgtaggatttaagacactaaacaaaaatttaaaatattagatagattttcccttgtactaactgttcactgaactaagaattatagaattcctgtgtatttaatagtgtatgcataaatcactttgcaaaggaaagagaggttaaaagttcacataagacatatatgatctctaaccaagtccttccaaggtgaaccaatttgctacacttacttgtaagaatgagagaaatccgatagtttgcctaagatgggatattcagaagtcattttcttgtccatttaagtctaaatctttaaaactctgaagccatgttactagtagaaccgagggaaatagcctagaatttttcttgtcacttacagagatgacagacttacaatatgatgattcttttgaaagcttcttacaagacctagaacttgtctggctccatttatctggccaggatgtatttctatgatttatccaatgagattcttagcagagccttacatttactgcataagataattatatttcttttctttgccatgacaaaaaccactctatactatacacataactttaaaggttgccttttttttttttttttagcatgtggacagagtctataaaagcttttttcagtttcatcatgttgacaagctgattccattaaatcacccaccaccatcatgttcacttttttttttcttttttgaaaagttagaaaacagtgatcatcttagagttttcaaggcattccctttggaaaaaataaatctggaaaaacatgagtctgttccttcaaatggaaaaaaggcccttctcttgaagctattcgggatagggaaggagctctcggtcttttaccccctgtaagatcggatgttttttaaacattctgagtatagatcaaacttctctacctcagtgtttcttatgtattatttgctacttcaaatggacactgcaagaagttaaatgaatgacatgaaagagattcgttcagggatttcttagtattttgcaccctcggatgcaatgcaattagataatattttaggatcacactgctgttttgattagggcagatatatccctgctcctcccatcaccatgctttcctcactgagggggaagaaatcatatgatcatgctgctgctgggtcatttaaagcattgagtggatgtgtgaaatgagaaaaaaaaaaaagctcagtgtggggttaattagctctgtggcgttgtgggtgggtcacttcctccagaccaaatcatgcaggaggaaccatgcatgtgcagactgacaaaattaaaagaaagcccatgaaccttcagactctaggacaaaaattgattgcctttggaaacaagaaaggaaccctttcatgcagtgagtactttgggcttcattggtcagagatgaatggacttcccttgaagtgtcggctcaggccactgtcatatactgaaaatgaatctatggtttgagaaggacctggcaaatctggtacttttaaaaatttacctctgctgacactttttaaaatcatgtctttctcaattaggatactagccttatttttgaggtctcatcttggaaacaacataatttcttccccaaagtatgggtgaatactttatattttcgtaattgtgtttcacggtatttcacagactgctgcgggttccctgcctgctgagattcgttcagctgtggtttggcctgaagggttcccactaggttgtttacaatctaatccttgaagtgggaggttaaggagcagatagaaaacatcctcgatccctggatcattaataggtgaatacaagaattcagatatttacaaggaaatctcacaggccaggatttctagggcagaaagatattgtgagaggctcctggagcatatgctgacaaggagccaggaaccaatggagattatccatgaggaaaacactgacaaatatgttaataaaatttcagtgcaaaccatttggggtttcttatgtttctgcctaaattactctgactttagtagtaacagcacttcatggagtatacagagagtcaccaaatgtttatgacttttgagaagaagaatatgtgtgtgtgcacgtatgatgtgtgcatttataggtatatatctttatttgaagtaaaactataagcacaattggcttcttgaggtggggaagcaaatgaccccttttagcagtatacttggaaaactcgaagcatctaggacggaatttgccaccaccaccaccaccaccaccaccaccacacacacacacactccccaaatactttgcttattacctgtgaaaaaaactgaatgtagatcttgtatcaacagttaagaaaatgcaaattcccctaagtagaggcattaaaacaattaaatgaatatatttttagcaaactgagagcaagttgtggttggggagatggagagctcactaagagtatccccaaagaagcagtctcagccgcatttgtttctgtttctttaactgcctggtgataggaatgtggatgtggaaataagtaggactagaaggtgggggaagcagaaagtaagttttgctaattctaacaacctatgttatcagcttattgtgccacagcttttcaaaattcaagttgctggttaacttgacacctttactgttccattcattatgaagcagcataagcaatggctacatgcaccaaccattatcctagttaggttgtcaaagttagcttaatgctgactttattttctgtagtgatactaaacaaaacgtttcttttgaaaggtcttagacctctatcctcccaactcctgatcacagtaataaccaacctcaagaagtcattagtgaagactagaacaatatcctataactagtcagctatgaagaaattggcatagctgactctttgattcatgttcttatggaaataatgggttgcaaaataaaactacatttctttctctctctctcttgaattcatttttttactggatcttctctacaagttacattggaatgcagattttgtttttgtttttgttaacaagattcgaataacactcaaaggctttaaaagccaaagtccatctttagatatagctttcttctttaatctactgccagtttcttatgtatgtgtatttttaccttcctgatgccttcgcctgttgattggtacatgttagtgctttgcttataagagttgggcaatagttcagtgatccagtccaaatctgggccatagatagaatggactcatcttctatttaagaaaagtggcaaactgctttaaatgaatttggttcagacaaggtcattggagctgttcatctaaccctgtgctgtatgtaatggacacttctgctgagctccaaagctaaaaggtaaatagacaaagaaagccagtaacttgccacccctgttagaccttatctgtgagtctgttattagatttacattcttaatcatatggggcacattttggtcatttaaaggaattgtttagtggttctcctgttgtctttgaagatggtccaggaaataataatagtgagttcatatattactttctggaccttcaaaaaactttttctttaattggaaattgagtttatatacatattcaatatgaggtttatgaaatattcagcaaatttcttagacatgaaagaattaattgttagactgttttactctagataatcgctatgttaaagccttagtagattcaagtacatttttcccaattttatttgtgttatatgcacttggcaaattgaataaaaaacgtgagcaccatatattactattttgaatgtaataacttatcaactatctgtattgcttatttctttttaaactgtagaatgtattttactcaactgtattgtgattctgtataatttttagggtgaacattttatagaattttatagaatcatacagagttaaacaagactagaaaagttattgaattcattctcctgactggaggcagagctgcatttattttatccaaaatagatgaagatttttcctattttaagagagtcaggaagaaagaaatttcagaactgctcttagcaatctatttgattatttaccacttgcatatttagaatgttcatctttaagtcttaaattctgcactggacggtttaatgtcattttgccctaggacaaaaatgctgatcattatcctctttgtaacaacttttcttatagtcaaaaaaccataaagacacacctcagctctttcttccctaagctaaattatctcagtttttcaaacatttgcttttgtttctatagctctttctatacctgagtggcaaaggggactatttttaaaagctctgtcatatgtgatgcctcttagagaggcactgcatattttaatttcactgtgctgatgtggaaatagccacaactttttcattatatgctgatggacagggcatttgtgttcatttaaccttgaggtttaaacttgttcccgaaaaagtaactgactcatagcattggctagacccaagaataaagagcatcagttttcctaatcttcaagctcatcttgcccccactcctaaaatgcactaaaattaacttttccttgacctctctctggtgctatttatttactgatttaacaactttcttctgtcatctctgtctcctaaaatagacggacagcatttattcaacaaacattggagtgtcgtgctgtgtttcacacactatgctaggcttgggagattcaagtgtgaaccgttagctgactcagagacatagatgtcccaggccatgttcagggaagagcaaataggctgtcaccgtatataaagaagcagcagtgggaaaattttttattaaaagtagagaggtgggccggggccagattgtgaaaggtcttggaggctcttaagcaaatagttggtagtgacaagtctaaatgattagaccacatgatagcagtgccaaaccttttcagcatcccttaagatcagtttactataagtcaaaggtcctggtacatcaatccctttggaatttatagagctacaatttcagtagtttaagatatagaagagaaagttctttggaatcagattgtaaaggattcctgaatgtcatcatgctaaggaattgtgtctagtttagcagcaataaaaaaccatcctaaatgtattaaacaaattcggtccttgccacccctcccagcactactgctttcatttcattctagtctgtcagaccctatccccgtaagaatcaagaaggaacagggagattcatatggggtgggatggagtgttacattgtatcttggcaatgtctcaggcgcagaagcagtcccagacctaattgctgaactttaaaatcttctctctttattgattataaccttatttcatcatcaaaattttgaaggcaggccattttttaggattgttatcatagcatcttaagaaaaaaagatctcagtatcattctcttattgttcttcttgagacggatccaaaataatatgcgttttggaaagcagaccccaagatatgtatgaccatttgtggcatttatagtcttcttcttcctgaccaaaaggaatgaaaatacatcaagaatctgtcctgcaggaaaccccaaagtacctagagagtgatggcacaggttctgtatgcacatataaatacccttgcatctggctttctcctgtaaaccttttgccaaatagaaaatagagaattaaaaactcccaaattcaagatgcatgaaatgtcattaaatctagtacaaatttttttgaatctgtcagataaaggaaatcatgtatccagagtaaagatggaatatcagttgacaggcacttaattttgagagacatataaatctaaaaatctaatagtgcctcatcctttgaaaacactggaaaccagaaaggtattaggaaaatcaataaggtaaaaatcatcatcctactatttggaatgactcccacataagaattaattaacgcaatacttctagaacgttaaagggatgttaaaacattatctctaccgatagaaaacaaacatataaacccatctaacttttagacagagtagttaaggaaaaaagattggaaatattaattaagattggaaataagaggtcatttctgtcctgttgtcacaccatttaccctcttcagctagaaggataagtgtcaaacttcagttcatccaaattcctcagctctgtcatcagtgcagtgacacattctaattttctgactcatttgtgatgaataatctctcccttttctattcacaatgctgaaagtaaccaattttggtgtgagttatgattacttattttccctttttttcaattgcactattattgttttctcttagcagaatttgtctcactctttatcacccagtgtgaatctcatgttcagaaaagcccatggacagtaatagtgcctaggcttggagttagtcaagaggaatgagagtctgacgacccagattctgtttttaacccagccagatacctcagctggcaagtggttcagcttcctcaccataaaatgggtataataatagctttcgcttaccactgtgaaatatttagaatgcaaatcaagccaaacctgtctgcttccaaagagaagcttaaactagcctgcgtaatcctgaatgagcccagattcaaggggaaacataaagtgggaaactcctaaaggtagtgtaatttagtggttaaaaatatgtagattttggaatggcacacacttattcagacgccagcagcggtatgatctgagctgtttcctaatttctcaaatttctcttttttctctagtaaattggaagtaacagtattttctcttgtagtggggattaaatgatacactgctaaccatgcttctcaaactcttccacttgggtgatcctcaagttagagtgagtgatccaatactaagggtgcctgccaggacattgcttgaagtagtctgccacaaacaagacttttcagtgaagtctcaggtttcacccaaaaaatatatacacagattttcctttcagctcctcaatatattcttgtttgtttcactcaaccggaagttccatgaggacaagaacagtatctgttttctttttggtataacattgaagaagtagttattggataaatgaacacgtgtgcaaataagactttaaattacttgcccacaaggaatactgaccctccaggaagacagccatgtatttactatttattttgtggctttttctactcccgttacactgctcacattcctgggtatactcatatccaaatttgggaaggatttatttctcaaggtacctgaaggactcagtagatagtgattcttatatcattatcatctctctgctcggtactcctctactccattgttgctaaggctttgtagatttttttaaaaaagaaattataaaggactaggaaggtaggagtctggcaggccttcaaagaagcctgtgtggctctaaccacatacccttacccacttagaactcttttttatacattttctttgctgctggctttagtttatagcatttcatgaaaactctgtagaggtgagtagctatgggattgaaagagggtttttctcccctgtctgcctaggccaggggttcctaacctgggattcatgaatggccttcatggagtctaggagttccttgaaacttggtgtttttgaggagttttctggagaaagagattctcatagggatcggtatcacttcaaaatgttgaaaaccactgctgtagaactttacataaactacactagaattgactttaaagttataattaataatatttttgattcttggagattgacactatataataatttccactcagacattataatacgaagattaaacttcacccctcgtcatccccctctctctgctcatcccccaccttccaccctgatattttaacgtcctgaattacttgggctttacagttttatactctttgctagatatatttatgctttgaacaaagtgtgcttaatgcaaatgtttttaatcctctgtgaaacttttatagataattctttgcatttcagataaaaacaacttatagacatataaggtgaatatcacttaggtggaaagagcatgtatcaatgaaataacaatttgaattgagcaaatataaatctatgtagattaatacatattctcagaattacatagcagattataattcagtcaagaagtaggtgtcttttgatgcctatgaacatttatgaattgtgtaagaactctgagattaaatttttagccatactattaagtttgggatcatattatcattttatattaacatataagtacaacaattatatccaataaaacttccatctaacttggctttaatttgttttagactgtgacatacacactgtaatttttctctccattttggattcctatcattgacagccatcctgtgtgtcatttgacatccaggaaagatagtttttcattccagacattggatgtgttagtcaatttgggtacaacttacattgatctcttttgatcacatcaaaaatttaattttaactaattttatgaataaatgcaccttgaaatttagaaaagaaagttatgtgtttagatataagaacataaacactaggtataattttagaagagcataatattgttgagagttattgggtttataacatgcaacagaaaaatgatcattgaacatatttcatagaaaattgctaataatattttcttcttctccccaaggttagagaagacagcaagttcaaaaaaggagagggaaagaaagaaagagaaatagagagagaggaatgtaagaaaggagggagggagggagggaaggaagaaaggagagagggagggaggaaaatggtaagaaaatatgcccctgtgccatagtctaatatcctggcttgcagagaagactagaatatagcaaaacttagagctttaaaatctttgaagactagtcagtgttatatatatatttcaaatttgtatgtgctttcaatgaatcatacataatctaattctcttgcctaaaattttcattaaactcatgaattttgtgaaacaatttgaaagcattggagatctccagcctctcttgtattagcattataataatccaggctggagattttcatcttaactcgtcttgtcaccatcctgcatcaagtacacctgcatgtacttgagcaaggtttcacattgaccacaaagggaaatcatttctttgaagaaatctctacaatagtgcagttgtcccagaaactttccaggaagggtgatgtctttaattgctggttttctgctttagccttttcaatgcaaagatacttaatcaggtccttctacttgatctcctttagtgaagtttgttttgcatatttctggaggccttatgtgaagttgttaaaatcatggtgtcagagaggcaagattgaatcaccctgtattaaattcttgatatatttaagtgggctagaggtagggggacctgctttgttttctcagtatctttttttggtttattaatttgtcatggctctcctcctacttcagttttatccttctaagagaagctatcaaaacactgatgggtctgggcacggtggctcacacttgtaattccagcactttgggaggccaaggtgggtggatcacctgagttcaggagtttgagaccagcctggccaatatggcaaaccccatttctactaaaactacaaaaattagctgggtgtggtggtgcgtgcctgtagtcccagctactcaggaggctgaagcaggagaatcgcttaaactcaggaggcagaggttgcagtgagccaagatcgtgccactgcactccagcctgggtgacagagggagagttcatctcaaaaaaaaaaaaaaaagaaagaaaaaaaaacaaagcacaatgatgggcagaccagtcctataatagttttttttttttttggcctgtgatttttttttttttgacggagttttgctcttgtcacccaggctggagtgcagtggcgtgatgtgggctcactgcaacctccgcctcccaggttcaagcaattctcctgcctcggcctcccaagtagctgggattacaggcgcccgccaccatgcctggctaatttttgtagttttagtagaaacagggttccaccattttggccaggctggtctcgaactcctgacctcaagtgatccacccaccttggcctcccaaagtgctgggatttacaggcgtgagccaccgcgcctagcctggcttgtaatttaaagagtgaaatatcagattttaaacatagaacaagaacactgttagggtcagcttctccaaaatctaaaattttcatcatttcatctgaaattttcatcaccaaacagagttgtgtttggtgggagagaagctttgtttaaaatcactttatcagattattttccaccatagaggggacattctaggctggtgagaaggggtagaggcagttttagaaggcaagtccggggcaaacttaggactgagttcttagctacacacgaatgtattgaatttgttcagaggaacttctggacattaaacatactaaatataccttaaaagagacaaagtttatcagggtttgactcatctttgtcaaaattagctaaaattggtcatgtactgtatagtaaagcttttacctattctagtcagtgctgcccaatagaagtttctacaataatagaaacattttctatctgtgctatccagtaaggcagtcaccagccacatgtgggtattgagcacttgaaatgaagctggcaagactgaggaactaaatgtttagctttttattaaatgttaaataatttaaatttaaatagacaaatgtggctagtggctattttgttaaatggtaacatagctctaccaaatcctatatgatacagattagaatgaaatgaacaaagaaaggtctttgcactccttgtgctgggaagtactgtcttggtcatcatagcagggggtcatacctttagaaagtttttatgaagctgggtctcctttattttgaggctagaagtgacaaaataggctcctttaggaacaaccagtcccatctatgcctagatttgctttctttcttcccactgtatcattttgcttttatatattggttttgcatcatatatcggtttgcttttaattccttattttttctttgattttcagatctttgaccatcagtctgtgacctgccccttctctttacgtaagtaaaagtgatttctttacctttaaaaaaaaaagtgtcagatttaggaaattgtggttttcactggcatatttcctagttgactttgttgtggtttctagtgcttctgtagtgtgtattagtttcttttgcgtttggagtgtatgctgttggtggtaatactaagttgctatccatgagggtgcagaaaataccagtggcccagatactgtacttctataaaggctgccctttacttggctgcagctgctgtttgcaaaagtcactgctcttttaaagtatagcttacattattcagccaaataccagcaacagttgggcttttgctcccctgtcaatcattgggcaattatgtattcttcagttatgtacccatccctaggtccaatagtttttaattttaacttctagatcagagctttcatttattgacaaaatttctaatatccctttactaagaagtacaagactgtaaaataaatagactaaacttttgtgcaaaattatgaagtctacaggggaaaaaaagaaatcccagattcacgtgtgccagaaggtttataaaggtaccactcttttttagaaaagatggaaaggtattcggggggaaaaaaaaacacgattttatatgaaaaaaaagagaacgttcattatttaaaattcaaaccaggctgcactgaatgggtttaaataaattttattttgaactgcttgaaaaagattctaggccaatgaacccaaataatcaaagtcacttataagagacaccacccaaaagatcctacaggtagtgatagtcacctaatgtgataaataattatcggtatcctctggctgcttctcactctctggtgagctctgttccttattcacaacattatatcttgcttcactgactcttcactccaaggtatttcttgtattataatcatttgcacagaatggaggttcccatggctattttgtttatgcgtgccttccactaacattcctagaagatagtggcaaatatatttagggaggcagaatcctccaaaggatgctaaggctaaagtgtaacgtgacagtttatttgacagagaaaggagattgattaaactccccaaagactggagctgtgtgtaatgcatttatacaacaggggtgggtcctacctgtccctgacaagtcttgttattctctatttcagtgttgatagagtgggtctgtaaatgctttggaggatgtcaatatgcatgcttatggttaccactttatatctgcacagccctcccctcagttacctagcactgcatatttctagtcctctgactggcaaatcatttttgttacagttcttttgtgtaaaaacagttcacataatagctctgtgttagacaaggcattaatcctcacatcaccgggatgagtcagcacagtgcactcctgcccgcacggctcagctattgtgacgtcagtgctatagggcgagcctcagacacaagcagtacaggggacctgtgtcaccaattaggaatcaagggggagacttttgagataaaaagtgtagttgaaaggctgtctctggctcataggaaaatgcaaatctgattctatgctacatcagccatcagttgcatagcttctagagatatcctattttttaaccacacataaggctgggggagtgacctataatgagcagataatccgttcatatacccatgaccttgtgccatccctgggccaggcttcatgtttgcttggcttgttccaaatcttgaagctgccctcatatcagcagggtgaccgggcttatgacagtcctactgtcctcaagtatcccatagacacagttgatggttgatggctccagagtggtgccccagaggctcgacaaaaggaaaagaaatgtccaatgtcccttgagaacagatcagaacattatctccccagtgctttgactccaagtgcctcttcaatggcctcctctaaacaggtacagaattctgcttgttcgatcttctcttagcagtgcatttagtccagtatcacaatctgtatttgacctggatttcaataggaactgaagagctctcagatgttcccccaagaatttcccattccattactgtttagcagaaacaaagaggaaccctccataatctgccatgctaccttgaagcaggtagcacagacttaccttatttgggaaacttggttcttataagttaggtctctatacaattcagattcagatttattctcaggacaatatctttcagtattgaatattaagtcttgaaaagggtgttaatttacagccttagtggcagtctctgttaaaaagaccttcctccatcacagaatttatccctcactcttactgtcaccccagccagtcaccagcccctgccatacccatcagaaagtgccttactgctgggatcttctgccttcattagattgctaatgggctcctactatgcttataaaagctaacactactacttggcttcgttttgattaattatcatgtacagctctttatttagttttcattcaacaaacatttatggaaagctagtcactgtgcttggttctggaaactccgggataaataagaaatgctttcttttgttagaaatctcagtctgataggggagatacataagtgaataaagactatagcatatgataggcactgaaatgcaggtatatacaagacgtagtaagaggaatgaaggaggagtgcccacttggatgtggtaaggtgaccaggctgggtcttaaagtcagaagagtaaattgcagtttaccaggtagatatgaaagagcagaaagaaaaggggatcataatcaagaaaaatgtaagagcatttacaaaatcaggaggcgttaagtagcagcgagattcagaggagtgaatagttcagtgtgattgaaacatggtggttgaaagagtagtatgagattgggctggaaagcaggcaggggaccttgcctgccatacggaggaccttgtatgccgtgcagaggagtttggacttgatcctgcaggctcaaggaggctttgaagaattgtaagcagatgtatgttttagaaagagcacttggtgaaagtggagaggctgactcagaatagggagaccaggtcaaaggtaaaagccaaaggcctgaactgtgcagtaggggtaggatggagggagaggctatttggtagtgttgaaatagacattaacctttgtgtaattccagcatatcttggcctattgcataatctttgccttctaggagaaaggctgaaacattgtgtggagtcaaatttcagaccaaaatacatccttatgggatcttcagcaaagacctcaatttgaatatgacctcactttgagctactgccccctggtcaccaggctcgcgtgcctcctactgcccatagtgggtgtgagggaggagcaggcagataaggagaagacattcccagtgtcctgcttgtctcttctttcacctgaaaatgaaacagtttctaaataatgcccccctaaagtcaatcaatgccccaatttcctatcattttctcattgctccctttttctaagcaaaatttccaaaccattgaactgaattgcaacttatgcacagccgggtgttgaaacaattcagtgtattcattccttctctctgaattagagttcaccataagtgtgcttttctcttgttcactttgggctgccaggacaatttaaaggaaattttcaacagcttatgtttcatgtactatgttctcttttgcaaatgggaggatatgcgtgggtgtgtttaagccttctctatattgctttctggagaaaggtttgggaagatgaacaagacgaggagtagggacctattgaaagcccaggtcccccagtgacctgagtgcagaacgtaggctggtgatcagatggtcaattatgtgtttgtcaaaacacagtgggctgcattccaggctgccagctttggaagcccagcttctgccaaccaaatgtcatctgggaacatgcaacactgggcactgtgaaggagtttgaaatagaccatgccacagccaacctactgccagtcttatagcaccaatatggcatgcacagccgggccccatgtttcagagctcaggaattcactgtactaaattcaagaggtcagatgggttcatgttttcaaagcctatgttctttgctttgaacactgtgacttgctcctcagcaatttccaagggatttttccagtcacatctctgtggaaaccactctttttgtgatggttataagatccttgtaaatgtcccagaggataggaaaaaaaaaaatcaacttgctctgacaatgactatgatttcgacagagggattccaactcttaggaaattacattaaaggtgcatagcttttaaaatatcaggaaccaccttggcaacttataaaaagcagaagggctttgcctattttataaagtgatttgcatatacctgcataaataatgtccccacctgtacttttatgcatttaggttgaataaattaaattttgtgatctttaaaatattcactgtctttcattgctcagacaccattttcaggacccttcctcctcatttcttttcctagtgataagagtggctatttttttttcaatcttttgactcattcagagaatcaaaacactctgaacaccaatcgactatagccaggaatattacctccctctggttgcatttctcttagcctttctacctatcagatggtgagttccatgtatttttaataagagaaataaagtattactaaggcgaaaacacagcacaagacagatttaagttctatttacatatatatgtaagagagagagagactgtgtgtgtgtgtgtgtgtgtgtgtatacacagacttgcactgatacacacctcagggacatgcccatagtaaccttttctttctttcaccactgcactgcgacaacctcttcaggaaccatccagctactaagccatttccgttgtaccttgggccttcaaatcaaagcctggtcagtaggccactctcccccacattcacgctttaagatattattaaaaacatgctatgtacaaagaataatttttattggatagttaaagcataaatataccataagtacatgaccctttcttgctcttaaggaatttaaaattgagttaggaaaaacagttatattgttgagcgttgtgtatgcacataagataataaatgactaagttccaaaaggaatgatacagtccaggaagtaccatagggtttcattcatgaaagagccttgcaggctagaaagtttcatgtaaaactgattcagctgagtcttgaaaactggctaaaatgtaaaaaagatgaagagaaacagaatcatattccaagcaaaatcatataccaaagtgttggaatcttcgagggggcccataaatagcatcacttttccccacttgaattctaaacctattgaaaaataagacaaaagaactgatagctagggaaccaaaatttttataaaggttggttgaagagcatagcttagtgtaaagaggaaatgggtttgctgactctcttcccttcagtcaaacctttcaaaagctctcttacaggaaaatgtggatctgcatatgagcaacactttccaggtcatcacctcccgatagtctcagtagaaaaggaaggacaaagaggttaaactcctgtgcttacaaatttggatagatcagttctacctacctgagaaatatagaccaagggctttcccaccaatgggatactttgcctccatggggaattataaggaatgagacaagaggaaagcagtgtttagaaaacatctggaaactaggagtagggaagaggcattcttacccacactgacatccatagactggaaaacaagaggaggaagtactgagtgagatgaaaatgggaaccagagccacatctggtctgagagcatatacctggggtaagaaccagtagtcctactggttatccaagatctaaactaagggccccttttcagagtctcaaaagttacaagaatcagaacctgggggaacaggcaagaaatgaagataatggacaaaagcctagttaggaaaaaaaatacaaaaactctagtttcttgttcaactaataataacaataagaaatacctattgagtgcttgccttgctttagatactggactaaatacttttcatggctatctgatttaaccttcaaaactaccctattaagtagatgctactataatcctaattgtgcagatcagaaaactgagatttaacatgtttgatttattttataagaacatctaataaatggtagagatagaacttgattccaggactatgtcttaaaagcctcagccaaattttactggacacaaagttgagtgtctactaaatactaaaggtatatataataaaggaatattaacatagtctctctccttctggagcttataatctggggaatgtaagacagatactaagcaaatggtctcacaatataacttgtaattacaaattgtgcttaccactatataataaaagtaccatgtgctctaagggcaaataaaagaagaagatttaactgagtctggaaattcaggagaagcttctctgaaatagtaacatttgagatgacacctgaaggttaaaaacaaaaagtaaggatggatggtggaagaggattccaggcagagggaacagcatgaagtccctgaagagagctgcacagagagaaaaaggtgactagcagcccaggttgaggttgaagagatacgtaaggcctgatgataacaggtccttggtaggccatgttaaggatttttgtgtttatcctaaggacagtagaggagcaaacttaagaaggactgtggcatgatcattgttgttttttaaaagggtaaactttggggcatttatcccagagagatggaaacataactgtacaacacctgtacattatgttacaccaatgtacatagcagctttatttgtaatagcccaaaactggaaacaacccacattttcttcagtgggtcagtggttaagcaaactgttatatctataccatggaatacctctcagcactaagcagaataaattattgatgcatacaataactggttttaatcacaagggtattacattgggtgaaaaagctaatctcaagatgatgtactgttacgattcttatctatatagcactcttgaaatgaaaaaaatatgtaaggattgagaacatacttgtggatgacaaagttagggagttgggatagaaatggaggtgagtgttgctataaaggataacgcaagggatcttttgtgatggaactgtcctgtagcttgactgtggtagtattcatgagtgtatggatgtaataaaattgctcagaactaaatatacactcacatactcatgtgcatataaaactgatgaaacctgagtaaggcagatggattgcaccaatgttaatttcctgattgtgatattgtactacagttatataaaatgttaccatttgggcaaaactgggtaaaaagaataacaaatctctctgtattatctcttacaactgcacgttaatctaaaattatcttgaaattaaaaatttaaaaatatatatcaaggtagcttaactttggtaaataatttggaaggatcaaaaatggatatgaggaaaccagtgagggagctattccagtagaccacataagaggcagactagagtattgacagtggaaatgggaggaaattgatggaactgagagataattcagaagtaaaatattcctggactttttcatggttggttatgtgaaataaaagagagaagtggcaacaatgactcctggtttggggcttatcaaactatatgaaggataataccattcacagttacatgaaacaccaaaggaggactggagtggagagaagtttgtaagttctgtttttgagatgttgagtgtgaggtactttggatagatacatagtgagcatattgcacaggtatttatatacataaaactggaattcagaagtaacatgaaggctggagacatgaattcagggtaatcgacatatagtggtaaatgaatctgttggcatgaataacattgcctagggacagggttagattgagaagaagacctaaactgagacttgaagagctcttaatatttaatccgctggtagaaaaaaatgaggccataaaataccctcagaaggagccaccaagaaggtggcaggaaaatcagaaaacataggcacagaagccaagagagtgcctcaaaggtagtggtcagtgatgtgacatgttactgagcaatcaagtaggttaaagactaacaaatatatattgcttatattaattttgagcttattgttgacctcagcaaaagctgttttgttgaagtggtcaaaacaataacgtgtttgtaatgggatgaggagagaatgagaagtgaagaaacagcaaatgtgggccactcagaagttttgctatgaaggaaaggaaaatgagctactgcaatatcttgaggggggaagtgaggtcaaaagaaggttggaaaagcatggaaacactagtattttttgtattttcatgggaagaataccgtagagaggagagatccaatgtgcagaagagagaagagcataggatgactggcagtataagattactgataaggccagagagatggaatcctgagtacaagtggagagatggaaggagggacacatcttctatttttgtaagaaaggaggagtaaaggaaaggagcagatgcaagcccacgtgtagatttggtactgaaaggttaagaggtttcccaagtgatgggcactgaggggcaaggtcctgctaagaataagcggggaagagatttaaggaaagtagagatttgaaatcgttcttgagacaaatgggacagcaagttgaccagagaaatacagtaggactctccttggcagtgtggaaggtgcaggtgagtctggtgggttgatgttgatacctatctgctctgtcatgggattttctccagcagtttggggaccaaggtgcaaaatcagaagaaatgagtttgaattaggatagggtttcacctagcatttgtggcattaggagttttagcttcttgttttggttctagctgaggccagtaagaaagggcagtgaaagggcttagttaaattctccaggcatctgttgagtatattgtatcaggcactgtgtttggtacagaaaatacagaggtgagtaagacaccatctatgccttcaaatagctcacagtccagggtggtttgtaggctgatatctggtccaaaacaccaggaacagggacttgaataacctttgcaaggaccaggagaccgatgtcattccttttctttcttatgcctgctccttccctctgccctgtcctcacaatacccagtttgtttttgtgttttggctttttgttttgttttgttatttactttctcaaaaaatatctactctctgccttattgccaagcctctagtatgcatcatacatatgtgagagacaactttgatttctcccattatctttttgctaaaatatgatgatttagaaacaattagatcatctacttgaagtatggtattggtatagtgtgaattgtctctaaatgttaagagctggcatctaacactacagaaaagctatttatttaagagggctggagacaggagtgtagacaggtgagagagggaacaagggaagaaagaagggagggatggaaagaagaggaaggaagcgggccgggcacgggatctcacgcctgtaatcccaacactttgggaggccgaggcaggcagatcacgaggtcaagagttcgagaccagcctggccaacacagtgaaactccatctctactaaaaatacaaaaaattagccgggcatagtggcgggtgcttgtaatcctagctactcgggaggatgaggcaggagaatctcttgaacccaggaggcagggattgcagcaagccgagatcgcaccactgcacaccagctcaggcgacagtgtgagactccatctcaaaaaatcaatcaatcaataaatatatatataagaagggtaagaaagcatattaactacacaagatcttatatagcagctcatccctgtttgttattcaagggaactcccatttaaaatgaataaataatcctccatccctaatggtgatctacaccatcagcctccaaaaacagcttccagacctagaaacgtaccagggtactataggttaattataaattccaggtgctggtaatgcaagagaagatatggagagggtctgaaggaggtggaagtttataacttccaacagaagaaagatcccttactcagatttattttaagcattataaaatgatagcttagaaagaggtggtggccgtgatggcttatctttatttgggcacattccattctgtgatattccctttaggaaatgatgttagggtcatttgactaaaagctaaattgctgatacatctggggtaaaatttggcagctgtcgagcaaaacagcttttttttaatatttactttttttatgattctataattcacacttattgtgaaatatttagaaagtatagagtaaaggggaaacatccataattccactacacagaaccaactattattaataattttttagatcaccttctagtgtcttctctagattttaacatgcctgagcatacattgcatgtatacagttgtatcccattttaattcaatattatataataaatacttcctggtataattaaaaactctttataaatagcactataacatctgaataatatcacataaagcccccagaatttacctaaccatgccctagataaaaatatttgggttatattcactacttgaaattttatattttaaaattctttaagggaagaactatgatgtacatctcaaagtgtcaaacttgggggaaacttgaggcagacattgatgtcaccctactaagagagctagttagtaattgctaatgactgaagatcatattggaatttttaagtatttattgcaggttttaggtaagttctttttcccccaaaataaaagttctaatttttaattctaaaaaagtatacatttagttttgcttgaatttgtttcattgatagtatttataaagagcaaggttaaattcctttgaaatctcacagcccagagataatcactattaataacttaggaaatattatatttccatacagtcctgtttatctttctctttttctttctctttgtctttctctttccagactgaaaggagaagttacttgctgttttgtattctattcttttcacttaacattgtaatagtcatttaccatgttaataaatatagatctacattatcttttgacaacaacgttgcacttcagtatatgcataatttattgactcaatcacttattgatggacagttgggaatttggaactttcttcttactaaacaatgccacaataactgtctttatatgcacatgcatatgtacacatgtttgtacacttacatgattatttccttaggatcaattaattatagtggaactgcaaaagtaaaatgcattactaaactgtcctctagcattggttaatatcttcaccaacaaaaaaagagactgcccatttctctgcatcctcactaattctgtaattttcagtgataatttttgccatatacatgaatattttcatactggaggtatgagatgcattttccaggcataaaaccaaagcctgaaaactttttaaaaaatacatgtattttaaattttattacatgaaaataaaaattactatggtagaaaatcattttttaaactaggaaaaatatttgtgatatatccctaatattttaagaatagctataaatcaatgatgaaaggatgaataacacaataaaaaaattggaaaagacaaatgagccgtctaacaggtttgtttgcttagtctcattctttactgcaaaggcagtgctccctgaagtcctccaaggccacctcaagctctgcttcttatgctctgatggcaacacctaccctcaccgcccttcaggggagtgttgtgggaagcaaagcaccaccagagacctatgacatttctgggttgggaggtggtaagtattcacctggttacatacatttatgtttatttggcatcaccagccctcaaagggccaggctcactcacatgaatgtaaaaattatcatcagcgctctgccttagactccagaatcagtaaattattgggaagggaaaaatacacactggcaacattgcctgatccatgtctccagggcaggattgacattattcttctcccagatgtagatagagatttctggatgttctcataaataaagtgctagaggccatgtcatcaacgtcctccatctttccccgctctctgattcccatgtgtattactacatacttaatgaaatggaatattcttcagcaacttcagggaaagtgaaagacgctagagaattggaaataccacactaacagcatcacctccgcctctgccgtgcaaactgtgatgacagggcgtcttccctgtgttctgggacagggagcatctgggttctgggagtgagttcctcgagtcttcccgagggtcaggagttgtacaaagctgttctgggtggtaattggagcattccttgaccacagaagttcatttgcagatggtaagggatgacatgctctggggcatttttccccctctttggcagaaaattgtggacatgaaagtcatgtgtgttttaaatccttagacagtgtccagaaaggaagcaaaagagaggcaaacatgttagagtctaggaagtcccttcaggccaactacaagctaaggagaatggaaggaaccaggcctaggaaatggcttatcctctacctgaacagtcaaacacctcttgaggtgtgcacatatggttatgagccaggctttagtgctgccagcagtgcccttggagaccatgccactgactcagtgtacctagggctcagagtgtcaaatgtctcattttcttaatgatgctcctagaaagcttcacatattatccacatgcttctgtaacatagtttatactcagaagctggggttcgagggagattttaaatgttatatatacatatatatatcttccacatacacgcatcctacttgtttaaggagtcatgctactaggacacttgcagaggcatcttgtacaagaagtctttgcagtgataaaattaagagttttttttcttttatcagggttcttcttttacatggtctctttgtgtagtctctatattattcttcatttcttctaatgtgtgggtattgagaacagatcaggcatgctccagagaatcatttcaagatattcatctaaacaggtcaccttacctctcacacttcgataggctaaaatgggttctacctttaatccctggtaaatttctaggctttttgatacatgaagaataattctcacctctaatttaaaattaaccttgtactttgaatgagagaaccgtgtgtctcatgaaagaacatgagtgaaaggtacacctaaatcttttaatagtagccttcagcctagtccttataagctactcaaggacacataagaaaagtaatgaaaagtcttcagtcaaaataattttctgagttttttttctatgcttttatccatcaccaccatgcttgaataatcttcactgcattggttcttcaccagtagctttcacatactcctctaccagttttataacagtacctttcagtaaaggttaggaagaatcctaacactgttaacttcctcagtaagcatgcactatctgttgacagggtgtctgtagactatctatttacttaaaaagaaccaattttttcatcattacattatcatcagtcattaacattactcatctagaatgggtacagaggcaagccacctcctagtaacctatgtgtttaccactccatcccaaatctctgatacacttagaaaaaaagttttagacatgtaggataacattctagaaaacagtttcaaagatctgaatcttagcacaggaattcatacaccgccccccccccccacacacacacacacacactcttactgaccaccattatttggaatttttttttatttaatcgacaaagaactacagctaaaacactttgaagtattccttttgaaacattttgatgttggattctggcttattccttcttagaaaatgagggattacatttaaatgtcaaataaatgcttgtacctaatgtgttagtccatttttgctgctataacaaaatacctgagactgggtaatttataaacaacagaaacttatttttcatagttacagagactaggaaattcaagattgaggcacctgcaaatttggtatctggtgaagtcctctctgcttccaagatcgcacctcttgctgtatcttcatatggcaaagggtggaagaggaaaagggagagagacagctccttcacaccttttatataagggcacaaatccattcatgagggctctgccttcatgatttaatcacttcctaaagactccacctcttaatactatcacatgggcaattaagtttcaacatgtgaattggggggtggtgaacattcagagcatataatctaataagaaatgaatccataatttttgaccgttgtaataaaatgatatttcattaagcatcactcatctctactcaagtagtgaccaaaagatggagatgttcttcagagaggagacaacagctctctgtgggtaacccccaatatggatgcagatttggaaacaggaaagcatgcaagtaaaagcaccagaaaaacaaccaagagatgtctgcaccttaactgcactagccaccctaaaatgagttaggctttataagatggaataaaaaacatgcactctagacagtaatccacttctaggattgtgtagggttttagtttcctctcatttcttcgcaaaagtatttttgtaaaaataacttggtctaagaaaaaaagatttctccataccacagttggattatttcatgggaacagtataccactttggcagactgcattgactttcagaccagcatgcggatccagggaaaatagactgagtgacccaggaggggcagagtcaggactggctgtatgcaggagtccttaccatcttccaaaagctaccaaatcaatcctttatttcctgtctcaacaatcggcattggcaaatttaaaagatcaaagttccttttaagacctgagctattatattattatatggggattacttctagatcagctactgttacctttgtctgtggtccagggcctcaaagcacttccatacacgtgcgtgcgtgcactcacgcacacacacacatgcacgcgcacacacacacacacacacactctattgatatgagcttttctcctgcctattagatgcattacaaatctgcctataatggggcctctctgcattccaacaaaaatatttctggagctctcctggctcccacaacatttgctgggtgcacatttaatatgttttagctttactgcctgaagatggaatcagggacatctacctgcacatgacagtgctttggctcttgcagttgcagaacttaatgtatgtatcagtaatgaaaatcttaattaagaaagctgcatcattgtccatgaacactcatttttctccccctgcaaagccctttgtgtattgcagtatatacctggtccagacagacagagccctcgaagagcttgtctggcagatcttctcttgattattaacagctagcgaatgacaaagtctcgctctccttttgtcttgaagctgaggcttggaacagcagagcacacaatgtactgtagggtttgtttgtgtttttttaaacttgcttttattacgttggtgggtttaaaaatccgacagtgttgatcaaaactaatttaggtaacttagagttgccaaaacactagcagatgcatatttacacatatactctcagaaaaatgtaattttccatatagaaacaatgcacaaacataagaagggaaaattttaatctgtctgcccatgtttctggtaactttggcctccagtacttaaaggctgcaacgtcctcacatatgtgaccttagcagttacttcttttcctgtgccattgtgcatgtgccaatttgtcatttgtgcaaagagtaagcagctttggaaaatggaatgactttatgcagacaactaactgtacccataaaaattacaagagttactaagaaggtcctttgaaccttagttcaaaggaccttcttagtactactcttgcaatttttgaaaaggtggcctataattatgtttatgaaacaatgccgaattgtgatattttaataaagctcacatcataattcccccaaataaaaagttaatcaacttaaaattctcttaaaagcctcaaagcatttcactcttcgaaagtagcaactcctaccaattaagtctatgacctcgacccatgtcctacatgatgaggagagagactcatgttctcagtcacttacatatcgttcagtcttctgcattttctaaatttctggtctacagtgttaaccatttactggtagagccatgtaaataattgaattggattcaggccgtatgcttatatgatactttctactggaataggacatattcacttaaagaaggtctgatagtaaatacttatgatctgtcttctgcttgctgtacctatactgccctcaccaagaggggagcagccatgctgtctcagatggtaatggtgtgctgcttatttactctccttataagttcgcatgctttcactcatttattttcaaaatcactgtaaataatggtcagttttctgcatatttgaagcaacaaaatatttgtacaaatattctttttgtgtatcatgaaagatatgaggaagacatcattatgggaaaattattttcaaatagtctaatttattaaaatctcatgattgcactcatagcatgtttaattaaagttaaatatgaaaagtaaaaatagacttatgttattaaactagaaccacaatgagaaagtaaaagagatgctgtcaaggctcttcactgctacataggaattattgtgaacaggttgttgcactctgaaaacttttcctttttaagaactatctgaccagtactgctataaatcctaaagcagctgtgaagtaataggcctatatttgtgctgcaggtctatagtataaagcatacagtaagctctcaataaatgtttggagaatgaataaataattatgagtgaataaggcaaagaatgaatagcactggcatttcaaagactaaatcagaaaatcaggtactgttcttaatttttaaaagtccttgattagaggttagaggtctgctgaatttctagaccttggtctataactttccaaacaataaactacttaaagaattatgaataatcttaatatttaaaatttgagcagattggttactttctacctccagaacacacacatacatccatgtatgtgtgtaaacagttactgggtcacaatataaaatgtagtttctactataagtcatgaataaaaatattttaaaccctgccaaaaaaacaacaaaaaatttgtgtagattaagataatatcttctcctattcagaaaatctacagtttgcttaaaatttaagagtgactgacccattaaaaatcacaggccttctttccttatctatgaggtaactcagatttggcctccattctgctaggtggtctcctctccccttccttggagtgccatccaaatgcaatatgaaagtgagggtggagagcagttagatacagtctactcactatggtgtctggtcttctcagtgttgtcttctgagctcaaattccctgagatgtctgagagcccacctcatctttagtttcctgtccatgtagatccctgatgtgtcttccttgtcccagctccaaggcctcctcaagtcttcaggctcctttgtcatgtcttccttgctctgggcccttctgggtcatgctggggcatggtgaccctgtgaggttatcttaagtccatagtcctagacacccccctgcaaagacatcttcctgctcccacattgtggatgtgtttaccctcagacccaaccctcaccctacccttgctctacaacagtggctgacccatgtcagctagattccaagttggatttggtgcttgtgagacacttgtgagtggcaagagggtcagtagaaggcataggccagagatttcccccaccgttctttgcatcatcatcatcaccagccacatttcctttgtggtttactccctctgaacaaacctgctgtgactccagcttccctggtgacccaggcctctgggcatcaatagcaccatctcttcccattgtcctttcagcatagggacatagagacacagtccttcacctaaaagagtccactgactattagggaaggatggatgtgtaacacagatgtctgtaatgcagcaagaaacagagaggaaacagattatttaaaggatgcattgggactggagatgcgcatagagtcgttccaatacttgcctgcaaaatagagtttctcagagaaggcctaacagtcaggtggtatttgatctggatcttcaggaatgaatacggatttagcaagcaaatcggggagggattctcacctctgttatttctctgtgtctctcccaatgcaatgattttcaagagaagcttgtacactccttatgtagaaacataacggatctctcagggtttatcctcgtttggattagtaaatggggcagcactagagtagtaggatgcgtgtgacctgagtttcaactctgttgagtagcatcagcagcttacaggaaatgaggttttttttttttttaatgtatccttttgtagattcgatggggccatttctagagttcagtcttgacctaaagacttggatctcaaggcactcaaaccgtcttacagaatgtgcaatccacaaaaaatatatacttaagccatttaaaatatattatctctatattggccaaacttctataatgaaacagatttcagactatcctgtaacactccaatctgtcagaactttcctcagaatactgtattttgctatttttttaaaacagagaaataagactattgatttacaactaacttcatctattagtatgctagaaacaatattcctaaacttgtcctttatgatctaataattttaaaaatgaaactaattgttgttctttccattgtttgaaaaatggaaaatgataatattacagaaaacagtaaagacattgaactgtttaaaaaaaaaaaaatgaccagccttccgatgacttaccatcctctttgcctctttgctgacatccctatgtgttcctcatcatttttgtgcttgaaatatgtattgtgtcagctttagtccagccaacaagttgagtaatccagcaggtttaggacaaagaagtgtgttgcaactgaggtaaaaggtctttaaaaagcatattagctgactatatggatgttcttcagttcaaacctgaccaccctttgctctcacatggaaatacatccacaagcagtgttgtaagtgatcctatcagcaaacgtgtgcatcagtgctcctccagaacatcatatttacgttagggcttaataggacattcataaagcaacatgcagtttgttatttttaaatgcatgtgacctccttatttcaaaagcaagtatctttaaacatagtaatagcatttctctatatgcaaacctctgtacatgaaaaggtttacattttaaaacaaacatgtttttgagttttatccaaattcaaaaaaagcatctgaaaaatttaacagctgaaaaacactttctccttgctgggaaaacttaaaccttgctaggctttatgcaacttaaaaaaaaaaaatcacttctgtgctgagaactagcatgagaaatctcagcatgaaaggttggtggattttttttcttcataaaactaagcccaattgttggttttaagagtgatgccacaatatacatatgctttgttaggaacaaatataatctaatttcaagggcatcttcaacaaaaattagggggaaaagataaaggctacttaagcagtgatccagtgtctgaaagcaaaggttgagaacatcattgtaccatcaaggtctagaaatgctgctaaccctgagcgggttgttactgtttgaaaagcctatgggtatttgttttattgttgtctcactcaattcttacttagctgagagtatctcacaagggaagtactgctctgtgatggtgtcctggactttgttttctatttgtttcagcacttcaataaatggtctgttacctgccattatgacctgtatgcatttgctgagcagtttttcaaaacaaaacaaattatgtggctgtatttctagaacgctgagccattttcaagatagtatagaattagaaacacacatagacacgtccacacaattgtatgtttatactgaacacatatattcagacatattcaggaaaataagaaaaaagaaaataggttggacaatacaaatatggaaatacagcttgttcaatcatttagagcccatacttctaacggtgtacatatgtagacgtgactttgtaaagaagacccacatgtgtgtctacactcaagcatcttcctcttaatactctactgaggataaaggacacaaagtaatttttgaaatatcatgctggctacttttagagtatattagtgtgagtagtgacttaagaggtcaggtttaagagaagtagcaacatacttctattatttacatggtgatttttttttataagtccttccttgaaggcagacttagatatttcaagacctccttagaaaaatttttcagcaccttctgtgctccaaattgagtcagtttgcatcatgtttcagtgtaactgagtaacaggctagcaaattctctgctttcttattcaccaaaatccaaaatagaactcacaaaaactccttccttcttccccccatcctgaaaaaacaccctactgtggcccccccccaatagaggaacagaccagaaaaaaaaagagtaaacagagccagctgtaactatagcactttgctcagtactgtgagcttgctagagctggcacattttttataatacagatgcataaatgtactgtctgaggcagaggaattgcagcatcccctttagtatttcttgactgccttggtctaaagtatgttgcacaggagaagcctccctaaacccagaataaaatacttaatttggtatctattttttaaaattgtgaccttctatgacttaatttttcataaggtttgtagaaaaccacctttttcagactttcacagggtttttccaaattcagacttccggggtctatgtcttactctcacacatacacatatgcatacacatttcagattacatatttaaagtaaaatatgtaaatatggactgttttaaagttattaaatgtgtatatgtgtttgtgtgtttgataatgaattgtttaataatgaactgttgtttcacagtggacataagataatcaaaccaatggaaaattattgtttaaaaccatgatagctattagtttttccagaatgagatatgcatttttaagagcagcttgttatggagtactactttttcttctctaaaattgtttgctagaataaaatttgttaaataaataattctgattaaagtgaatgggaaggagaaaggtactttacccaaaggtccagttaaacatccaaaattggaccaaaactttgtccaaaattcatatctgcctctgaggaataaagattagaaacactgaagtctaggctgggtgtggtggctcacgcctgtaatcccagcactttgggaggccgaggcaggcggatcacctgaggtcaggagttcgagaccagcctgaccaacatggagaaactctgtctctactaagaatacaaaattagccagccgtggtggcgcatgcctgtaatcccagctactcaggagaactcatgaacccaggaggcaggggttgcggtgagccaagatcgcgccattgcactgcagcctgggcaacaagaatgaaactctgcctcaaaaaaaagaaagaaagagagagagagagagagagggagggtgggagggagagagagagagagagagacagagaaagaaagaaagaaggaaagaagaaagaaagaaagaaagaaaaaaggaaggaaggaagaagagagagagaaaagaaaaaagaaaagaaagaaagaaagactgaagtctatgcaaaagagtgcagggtacggaccgggcgcggtggctcatgcctgtaatgccagcactttggaaggctgaggcaggcggatcacctgaggtcaggagttcaagcccagcatgaccaacatggaaaaaccccgtctctactaaaaatacaaaattagccaggcgtggtgttgggcgcctgtaatcccagatactcgggaggctgaggcaggagaatcgcttgaaccgaggaggcagaggttgcggtgagctgagatcgtgccattgaactccagcctgggcaacaagagcgaaactccatctcaaaaaaaaaaaaaaaaaaaaaaagtgcagggaacaaaggtcattttcagtagcttagagatgaattccagaggttcaatcctgtgtttgaaaacagaccctgtgtccttttgggcacattaattcacctttaagcatcagtttctttatctataaagtaatcagaaaactcttatgatgattaaatgagatagtacacatcaaacatgtagcccagtaaggccaatatcaaccacatagaaaatgcttcgtaatggtaattatggatctaaattattttagcagtggtcgtatctttgaaataagcatttagcctggagatagaaatggtgcacacttaagcatgttatttcaggtatgtttttcagtttatatgtgatgtttctttataagcacaacgcataattatgcaaccagtattttgctttttcaaaggtgacatttattgcacactaacagtgttctaggtactgtggaagggattagaagcacatcttctcttatgatccttagaacagcccctataagttaccattatacccatttttcaaatgagaaaactgaagctgagaaagcatcagcagcttgcccaaggttagataactaggtaatgatggggtaagactttgatccaggcagtctagccctaaactgcaacctaagaaaataattacaagtaaacaaaagccattatgcacaagatatttatcatatggctgtggcttgactgtgtctccaaaagttcttgtgttggacacttaatctctgatgcaacagtgttggaaggtggggcctaataagaggtgattcagtcatgagggctctgccttcatgaatgaatgaatgccaccactgcaggagtgtgtgcattagttatcatgagagtgggttcattatagaagtgagtttggctccttcttgctctctggcttttgtgctctcttgccctctgccttccaccatgggatgatctagcaagaaggccctcaccagatgccagtaccttcatactagacatcccaacctccagaactgtgagaaatatattttttctttttaaattagccagtttataatattctgttacagcaacacaaatgaattaagacataaatatgcttttttacctttttgttctagatatttcaaacatatacaaaagtaggaagaatatcatagtgaactctcatgagttcctcactctgcttcaacagttgtcagcccatggtaaatcttgttagacatatttgtattataaaactggaaataagctagatgttcaactctagagtgctgtgttaagtatagtacgacatatctattagatagaattttgagccagtaaatgtttatgaagaacctataatagtatgaactatttatactatatattaagttaaaaggcagcatacatagtaatacatatggtataatcccaccttttttaggatttttaagattttttattactctcctatattttctaaattgtatatcatgaacatatcttaattgggaaaaattaatatttctctaatattcagaaaaatatgaatttcttcattaataaaggcagcttatttacctagcctcacagagtaagactccatctcaaaaaaaagaatatacttaccataattcaaacttttctaaatgattcagggttgttatcttgaactacaattcaaatttgtttctattgatgagggtgtggaagtataaaaataatgctacatatttgaatgttattttatggtttccaagcttctcaattaaccatttggtccttattctataagattatttgcttctgtgtttctttaccctctgactgctatatctttagttctcatgccttcttttcgtagtttttatttttcttctttagctattaagttactttctgttgtgcaagtctctaagatcctcattccttctctgatgcattatttctaatcttctttagacaataaaacaaaaaaacatgttttgattgtgtgtaaagtacatacatgaactcattcacttgacaaatattgtgagtcgtgcacttgtatacttggcactggagaggatacacagataagacatgtcttgccctagaagttttaatctagcaacggagctgagacatgtgtctactttgctagaattaatagtgaaaagtgaaatgctctataaaagtagtacagataaggtattcttggagctcagaggagggctaactgagggcttcatcagaaaagatgacactggatttgggctttgaaaaacaagcaggatttgagcatacagagatagaaggaaagaacattactctatcatgagaaaagcatggaagaatcaaagggtaaagattctgcaaagaagtaattgagtttaacttgagcatggaatgtgtgaagataagtagtgggaaataaagcggtaaaagtatattgggaccagaaagtgaaaggacttgattattagggcaaggaatttggactttattcaggagacagtggggagctattgaaagtttttagtaggagagtaacataatcagagctgtgcctcaggaagattaatctggcaacagtgagtaaaatggattggagtagggagagaccagaggacacaagatcaggcaggagactattacaatagtccaggtgaaaggcaatgaaggcactaactagggcaggggcagagggaatgaacagagatggcaaactgatttatgaaatgtggcgggagaattaatccattatatttggggagcaagggagaggaagacaccaaacacatctctatgattttgaaccttagtagagtcataaacagagcagcaaagcaggagaagggttgggaggggaaagcacacgtttaattttgaacacactgagtgaaggtgccgactgggtatctgtgagtggtccactaggcttttggagacacgacactatagtgcagcagaagggccgggcttggagataaagattttgagtcacctatgcctcactagatagagaagcaagagaagaggcttttaaaaagacttggaggattatgtgtggtttatttagtaccaattttggctgcttgcaggtctttttcactttgtttgttcttaaccatatttggaatgccacataagtggtgtgcagatatgtgaagcattgctgtatgcatgcaaacacacaaaatagattctaaaataatgaactagtttgggatatagctaatggggtcaattttacagtgtccatagactatcttcacttgtaacatattcctgtgggatatggtttggctgtacccccacccaaacctcctcttgaattgtatctcccacaattcccacatgtgggagagacccagagggaggtaattgaatcagggggcttgtctttcctgtgctattctcatgatagtgaataagtctcaagagatctgatggttttgaaaaggggagtttccctgcataagctctctcttctctgccaccatgtaagatgtgacttgctcctccttgccttctgccatgattgtgaggcctctccagccacatggaactgtgagtccattaaacctctttttcttcccaatcttgggtatgtatttatcagcagtgtgcaaatggactcatacactgtgtaaccttagagaaatcactgtacctcttacttctctgggtctcagattcctcatcagatagatgaagagattgatcaagatccctggtctccataactggttgcaagcagccaaaactgacatagaattagaatcacttggggaaggcaggggaaggaaaaggcccaggaatctgtgatttgtattttctacttactttttattttttagagacaggggtctcaccatgttgccccaggctggcctcaaactctgggggtccagtgatcctcctgcctcagccttcccagtcaccaggactacagccacattccactgtgcctggctgggaatctgaaacctctctatgtgattctgagacacatcctgggttggaaattgccgggctacaaaacctcttaggttcactccagctcttatattctaaagctttatcaatatttagacaaaatatgcatttttcatgactcactcataaggaaggaaatatatcaaaaatgcaaacttactttcaaattcagttcatcagctaaatactccacctctctcctttatattaggaggacaatatatttttaaagtatttgaaagacacaataatttggaaatctcctgtgattttataaaatgtgaaagatatgtagtgtgtgccgaaggggtaggacggaagggaagaaagccaggaagtctgggacatagcacacataaagcgtgctgttcaccagccatacctggggactgtctgcatagccacagttgaagtatgtctgtgctctgcaattgatttcagtgctctggctattcttgttgaggcacgcagtccttgtactgtttctgattgtacctgtcaggttgtatatataagcatttcagaagtccttctgtgcagactcagcacaggtttagcgtgaaataaaagagccagttgagattccagtccaacaggtgagctatttccttaatgggcttatctttaacataccctctttggtttggtttccatcatacatttcatactttacctttcacatagctcttgttattacagcattgcctcagctttcctagatcatacattctgaagcttccccagggtcaacagcatgctgtattgggccacacagaagggaaggagagcagtgaggtatcttttttttttttcttctgagatggagtttcgctcttgttgtccaggctggagtgcaatggcacaatctcggctcactgcaacctccacctcccaggttcaagcaattctcctgcctcagcctccgaagcagctaggattacaggcctgcaccaccacgcccggctaagttttatatttagtaaagacggggtttcaccaagttggtcaggctgatcttgaacacctgacctcaggtgatgtgcccgccttggcctcccaaagtgctgagattaaaggcatgagccactgcgcgcccagctgaggtatcaattctttattcacttcctatgtcctctttcttcctttttcccagggaggacccagttagatgaacttgataggttagactggattaacctagactgtaaaaacaggttggaatttggaaaatctgaaagtttccaacttccaggcaaaattttgacgtcccattttgctcaacaagtatgttttgaggagttactctaagtagggaattctgctcagcttgtaaatcagaaattagcaaccaattttagtgattttgtctgtacactggctactacaaaaattctagacataagtgcagagtagaactagtgataatgatgatgttagtactttacatttatttagccctgaactgtcttttcataaaattatctttggtgccctcctattcgcctaaggaaatcctttttatccttgcttgtgtcactatcatccccttctcccacccttcagttccacagttatccatttcctttccccattcaaactgcagcttcttgactttagttacattcagttaggtgatctggtaaccttattaaagtaatttactccaaggtgtaaatgaggtttaaccctcttggagaaataaatattttaaaaatatcttgttagacaactgagtttctttcccctgttcagttaatgacacatgaagcgagatgtttttttgagtagagtcctcagttatatctcctttgccctctgacctccaacacacaatgttttatttacatttgtaaaggaaaaacatgaaatcagccaagcagtcctatatctgtcaccctctacatattctctcagtcgctccacctccctgatgtagctgtactttcaatgtgacatgacacccccatatatcagacatttgctgacttcaaccatgcaaccctgctggacccaccaccttgtttcctcatctgttcccactccaattcctgattcctggctgcatcttgtatttatcatcttaatattgatctttgaatttacctctttagattttgttcccatattctgggagagagtttagcaaagtacaaaaagcaaagctctggagtaaaatgccactagtcatgtgaccttgaactagttatttaccatctctaagcctctgttttctcacacgcaaaatgggagtagtgtaaaaattaaatatgatatatagataggatgaagaatattaagagttcaatgcatggagttattattgttaatattatttattatctttactcccctcaacaacttcaattgggattctcccctgattctaccttggagaacctttcttgagtgttgtatgctggtcaggactagtttcctggatgtgaccttttcagcattttatacacaaaataatgtcagacactacatattttctgaacaaagacttaggacataattttataaatacatgcatatttatggggataataaaagacaagatttgaaaccaggtctgctccaggagatcagagacttaatctcctatatctaaccttaggatgtgaattctatacactggacaaagatgaattttagagtcgtaaggtaatactgataattaagaatatgatagctctgataaccaattgtattaagaaaggatggtcaattacacaaagaaaagatgttagtatttcaggaaggagtttttttcttctaaaggagaaagcagagccgttggagtcatatctgggtttgcatgcaaattctaccacttaaaatccatggacaaaaagacactaactaaatcaccttggtaaaagcattaaatttatttgagtttcaatttccttatcagtaacagattaatgacacccaacttgtagacttattatgaagattagaaataatgcataaaattctggtatattgttaggtctaaataaatatatttcctggaaattgagagccaggtttctcttcaagatgaaaaaggagctgaaattatgcctgtcttccacatataaccaagatctatatttaaaagcaaataaaaaactaactactataaaacatggaaataaacattttccacatttacatttttaaccctaatttttccactaagtatattcagataggcaggttaaatataaattaagtactttttcaacatcagtttctaaaacagaaactttcaaaggattcctaatgtactttagtagtataaaagtgtcttttgttattatataagggaaacatagggtaatctgagactgtgtcatttttaaaaagctgttaagaaatgatcacctaacattttatggagagataccagaggtatttagtgaaatctcactaaaaagagactccctttttctatatctttaatgcttaatttccaagtggaaatattgtttttaatctaaatcttgagcattttagataagttgagaaattgtgtggtgagtggtttttgttttttatttctaatgaatcagtaattttgaccttcgttccatatgcctctttaatttatggtgaataagtaatactgatttttcaaaaattaatgcacaatctcaagcccccaagttttaaaattatgatatttccaatggcaaatgaaataacatgctgtccatgcagttagtgatttgaggcaatttgaacatcatgataagagagggagggaattacaagcagtgttataattaaaggtctgttgattcttcagtttaaatgccattgttgaaagatttttcactcagatgtcaaagtctgtggccagccaaaacttggcatgctagaactcagcccagggaaacattgtgttctacagatttaaaaaccaaaatctgttaagaacagaaatgttgggcttgggctgatttctcatgaatcagaaccagaacatagccaaataccacctcctctttatgaaaggaagtagtgcaggtggatgttaatgggaaatgtttgttcagatgggaaatgaagggaaattatcattagatatcatcatacagtgcactgggttagagttttatatcattaaagcatgtttctttgtgaaattaaaagcattttagacccctcttctattaaattcttcatgggtgttaagtggggagcagtatttacccatctttcaagatttgcacattgaggttcagtctctccacattacattccttgtgactaggaaaacttgaagtaaaactttatttgcttaactctctacctagaaatatatttccaaacaccgtcttgccctttctttaattagaaagttacaaatcagtggcctatgagctgcatctagctagcagatagaattttttaaaatgtatgtttggtccacagaatatttaaaataatttgagccaacctttaaggttaaagagatttcacaccaaaaaaaaactagatttttttttttttttttttttttttgcttctcttgaaaaattggagatctgacaacattagatctgcatccacatgtggcaccaatatctggaactgagtagcagctgctcacttcagacaaaccatgttctctccagtttgacaaagtccctatcaccccatattttatgccacacctacttcactcatttgctcttccaccctggctccttgaggcatttgacttttctttcattgcttgtggtcgttgtattaagtttcctcgcttgtggtattacctgttaaagtttccaaaattttcttttcattaaataatagcattgcaaagactatgcccaatgatactggacaaagaattattgaaaagaataaaagtcagaatgcaaccaaaatgtccaaaaataggtgattgtttaaattgtattttatgctggtatatccttagaatagaataccatgtaggattaaaaatgtttatcttgaaagaatgaatgcagattactaaactatgtatacatcaagattcctatgttgtaggagaagaatattcatacatatagaaaaagagctaaagtgatgtgtcaaagcagtatcagaaaaatatgtacatatacaaaaaatataaacaaataagtgaataagtaagtcccaagggcagcttttgtgggtccccttctacagggctttgttagtcccttttgacctaatggtttgaacatatgctaaagctattttttaattctctatcaaaacctgattttccttcttacctttattctttagagaatacaatgaagaataagatttctgtagttgttttaaatacttgagaaaagtattcttacttgcccacatgctacactgccactttggcaaagcaagagaaccagtttctgtgttggctttgagttagtttgttcttctaaagcaccttttggtgacataaaaaaatattcaaaactttaaaaaaaatcttggaacagaaaaaatacacataaacattgcacttaataacatgaccacaaaaactcttagaggctaggactgaaactcatcatcacaaaggcgtcagctttttgccaaccataggaaggagtgctcccaggtaaaagccatccaagcatttatggaaatttttctgatcccagcgtttagcacaataccttggagttaggaaatgctcaaaaatacttcctgaataaaatacaaataaattcacattcccaccaaggaataattaacctgcatataaaaattcagttatcttttgaattaaaatcaaaccataaagtttggatcttgctaactactctaaaaacttccagatatagttttgcttcagagttaataatgccaacatttttcctaggaaaaaataatgtttgtttatgtgtgtgattgtatgcatgcttgagtttagggaaagggtagaaagcaataagaggtggtcctttcaaagatgagtacagtgatgaagactctagctcttaaatatacctcttcctcacagcaatcctaggtatcctgtttatgatttgattgttttgactatctatctctaattcttgaagcatttgaagcattcttcacctttacactctatagcgtctgtttttatggttctcctgttcatctgaatgatctttcatccatcctccctttatctgcccacaaaatgtaagtttgtctgtctttctctcctcactgcattcttgaaatctgtggacagtttcatgaaatccacatagcttcaactagatgtttggagcacttccctagagatctaagtatctagtcctggcctgtagactctggtactgcacatgtgggtttcctgctgctcaatggacatttccacatgtttcacccacaacatctcaaactcctactgctatcctttgagtagtctagaagctagtcaaattgaccccagacacagtttgtgctttcctatcccttgctttgactctttctgtttcccttgcctaaaacctatctctccaatttctaattgttggaattttcccacattccaaagtccatctcaaacactgcctgcttcaggtaactttgtcagtgtccaccgctgaatagcaaatgatattcctcaagtcactgaaacctacagattttttttagcaacgctttacggtattaacttatttgcatcgtgttttagttatgtggtatttcttttctcccatgttctaaatattaggattattgcttctaatctttgtagctactttctagagcttaggtcctagcagagtcccttgctcacagcaggtgcttattaaatatatactgaattaaattggatttatgtattgatggttgcgcattgcacatgtgttgtgatttgggagacccaaaacatccacctgcccaaactatctcttccattttccaggccatagtatcttgctttgggacgttctcttgtacaaatgtgaggaatttccacaaatttagtcttttgttcccaagctaagtacactattggctgggtaacatgtgagttctgctacttgttatctcctaagagggagcaaagtcttaaaaaagaataggccaaagttcagatatgttctcatggaggcaacagataggaaaaggtccatgaaaaagacaggatcacagataggaacttggactgtgccacttattagttgtgtgccttgcttgtctcatctgtaaaactagatgataataataatgatgcctaccttagatgttatgagaacaaagtaacggggtgtgaagtgcttacaataatattaggcacattgtgttagtgagggttgactattattagttacatatgtcatacatatatgggatatatatagtgtatatgtactcatatattaagtatactctttctcccctcactgcattcttgaaatctacatagctgcaactagatatttggatcacttccctagagatctaagtatctagtcctggcctgtagactctggtactccagatgtgagtttcctgcatatatatatatatgcttaaaacataatgcacacacacaaatgtacatacatgtatttgttaattattgtcgcaaaggaaatcctggatactcagagaccttaaatgtctgaagattgaggatgtataagagaagagatgagactctgtcacacagacctgaggtaaagctcagctctgccacagggaatacctgtcttttatatttgttttaaagattaaatggccgtgtcatgagcataatcatcctaacattggactttggacctccttcttttggtgattcctatccctttcttttctttctttcttttttttttttaagacagaatctcactctgtcactcaggctggagtgcaatggtgcgatctcggctcactgcaacctccggctcctgggttcaagcgattctcctgcctcagactcctgagtagctgggattacaggcgtgtgccaccatgcctggctaatttttgtatttttagtagaaacggggtttcatcatattggccaggctggtcttgaattcctgacctcaggtgatccacccgcctcggcctcccaaagtgctgggattacaggcatgagccaccgcacctggcccctatcctttttctgaactacacatttgttttcttgacaaattagatttcagacttttgttctggaccaaacttagaagaaacaggtggtactgtttcagaaaaatggtgtcagtacaagctaatgatttcaaattattaataatttaatacagtagtgaaatgttaaaatatgtacgaattaatatgcaccaagcctaacagagaacaaacactcaccaaactgtagctaaatccttaatctagaacaaacttaccagtcagaccaggttttataaaaaataaaatatctcttacctatggaaataattaattatattacagattttacaactggcttttttttttttaagtacaagaatttaggtttttacctaaaaacaaaacagtcctttccacttagttctatttgaagggagtgtgtgggggttgggggagaaggaaaaacgaaggggaaaaaaagtcttgagaacatctacaaactcctggatattcagagctgaaagaaaaagaaccttgtaatgtaccttcttgcatttagtcctgttattgtagtgctgtgatgtggcactcaatgctctaggggacctagagcaagtgttacaaatgcaaccaaaagtctcatgaaaatgagcctcttaacagtgtgtgagctggtctacaatggcctcaggaaatccccccagctattcatgtcctttttatccactacattctctgactcaaagggaaacctcccttcacctccttgaccagaattgagcagacattgatttggttacctagagctttatttattcatttattagtctttatcatttgtattccactagaacaaaagaatatatcttttctttgcattaatctaagtttaaagatgtgcaaatgtgtttgtgggagagtgcatatttatgtttacgtaattttatgggtagctggctttaagttaaaatattttctgtcaaaaccatagtacatagagcctccccatcaccatcactgtgcagaatgactgtacttgacacataagctgaattcctaaaattgtttcacgtaaagtgcgccttttaaaagagatcatgtttttctattcacttctataattagattgagtgtcacacaggaaaaataagtggcccaatgtatatgtttttttaaaaaaattaagaatcacaactttcacctcagtgataatgatgcatttatctatggacactttatgtgcataaattgccccccaagaaaagccaataaaaagtgaatataattaaacagcagatagtttgaaagcaaatgctacttgtaaaccactgtactgaaggcagcgggaaatttggagatgtgtaaatcaggaattgtcctcagggagcatatagtctagttaaggatgcatagcagaaaaggtagaattgtatgcacaattaaagattcaaatagcagttcaatatattcagagatattcttcgcacaattatattaatgacttatgttgaaattataccatgtagttaatttcccttccattttagaggacttactgagtaccacatactatgacaactatctaaatagcaacaatgcattatgagctcttcacatgaattcaacttaggcgaaattcaattttggttaacaaagtttgggcaattcaagcaataataatttgttttgaggtagactacatgttcctgttcttttaaatgttaatgcacagtagctttgttacagatttccttcaggaatgcttgttgaactagtggacatttctaagcagattttttatattaagcaatcaagaaaaagcctttgaagatattttcactccctcaataccagcttcggatgctatgttttcttcagtgttatagtactgaatttgttcttacttagggaatatgttcaaagttgagttggccagaatggaaacattgtaaattctgcagcagtgtctatttcatgtataaactaatcatgatcaaaatagagatcctatagggacctaaaggaaattaacatccttagttaccaccttagctgtaacctgaaaaagggattaatgtaagttcagggggaaaccttggaggcatatacaacgtagatgtctaaaaatattcaagctaccgtacccaatatgtctgtatatatctttactctcctgctaaagagtaaataataacaacatcagtaacaccaaccgaatgagattcttagtttacaaagcattttggatacatcatccattttgatcttcagaacaatttgtaagattggtaaggcacatattattcatattttacaaatgaaaaatctatgaaatgtaaaaggacagatgacttgcttaaggacacagagctcttaaaaggtgcagctgcatctcctgatgcaccagtgtgactggctcagaggaaacagcaacccaaacagaatctttgctacacaactgtcctgcaaggcacagaggggttgccaaaaggtgacgtgcagacattagtcttcagaggaaggacgagtcctcaggccaagaggcatacgtcactattatttcatgaaagaaggaaaagacatggttagctttcttatgaggtggttttctccacatatatagagctgttgagaaatactgcaaattttcattactcagagattggataaaattctgatgattttccatgaaaatcatagttgtgtctaatctggttgcatctgagttcccttcaacctactaagagtttggacttgaacctctaaaaagatctcagtcctgatcaggaccatccttcccacctaccaggatatacatattttctattgaaaaaatatgtgaccataatcaattgttgagcgagctccctggagcttcttacttatttgagaatatggtatggaaatgcaagagatcatgggccactttactaaaactgagtgtcattggaaattgataaaaaattgtggttctgaatcccacaagccatagactttcactggcatacagaattcaaagctgtcactaaattctgctacctgataaatagaaaggtagactttcaaatcaagaaatttagcacttggttctagagactaataatgccagcagatcctccattcagcatcacaccctttaaacatctacagacttccagcctttattttggcctggagaattggacatctggagcttcttgaactttttttcagtattactacctgggagccctagttaatatgaaatatcaaggcaatatcaccaacaatgtggtcctaggatacttgcaatccaaattgatgtttcttctacaataataaccctgaggttgtaaagtgttttcatatgcatgatcttgttaacttctacattaacttttcacataaagcaatttattattattattaattattattatttccatcttacagatgagacaaatagactaagaacataatctaaagtcacatagctggcaaatgacagagtcaccatgacacctagattagcaggtgatctcactctgagtccaacgtgttttttcattagccttgatgagcctcacagatttgtcctatgacaattgttctcagctaggctttagaattacctaaagggcttgttaaaatatacacactcagacatccacctctgagcatctgattcagtaggtctagaataagacacaataagttacgtgtctaacaagtttctaggcaatgctgatgctgctggcccaaggactactcttttaggagcactatcctatagaatgtaagcggtaactgaatggcaatgatacactatggcaaaagagtcttattaaagtttggataggggctgggcgcagtggctcacacctgtaatccagcactttaggaggcccaagtgggaggaccatttgaggccaggagtttgagaccagcctgagcaacatagcaaaacctcatcactacaaaaatttaaaaattagcctggcatggtggcacacacctgtggtcacacccagctactctggatgctgaggctggaggattccttgagctcaggtggttgaggttgcagtgagctgtgatcacaccaccagtgcactccagcctcggtgacagagcaagaccctgtctcaaaaaaaaagaggggggggggaggagattgttttgtttgttttttgcctaagctgcctcatgcttcttttttctgacctctgttaagaaagctcagaaaaaaatgtggggtgggggtctagcaagagagcactcacttctgaatgagttcaggtctctggcactcaagaaatggacactgaaacccttctctttgcttctaactagaactactgttgtagattaacttggagatacaattgccaaaccaccagtgaagagttactataagacaggaggtgggcaaatgtgattagatggatctgcagccaactgatcaattaaccaataatcattagattgattgctttatgtcaacttagaaggaagctcttagtgtcaggagaaaagaccctccttgacttatcctagtcaatatttttctgaagactggtaagggttcttgtatcacaagctcagtttgaaccagtaaggtaatatatctgctaaaataattttttaaagagctaagaaatatttcaactgtgttgaaagattatgtccagatcaaggtagctgatggtccctgtgttaatttcctatggctgttataacaaattaccacaagcttggtggtttaaaacaatgcaaatgtattctcttacagttctgaaaccagaagtctcaaatcagtttcactgtactaaagtaaaggtgttgggagggctggttccttttagcggctataaaggaggatccatttatttgccttttctatcttttggaggaccctgcactccttggtgcatgaccccttcttcaaataaccccaacctcttgtttctgtcatcacatctgctaactctgatcctcctgcctctctcttataagaacctttgtgattacagttagagtccacctagaaaatccaggataatctcctcattttaatagccttaatttaatcatatttgcaagacccctttgccacgtaaggtaacattcaaaggttctggggattaggacatggatatcttttggggggggccattcctcagcctactatagttcctttgtagtgtgtttatcagactacattaggaatattgtacccctttatcagcaccagaatttaagagttccgtcagtaaaatatgtccaaaaaagaggggatctggagtcaagagtataaaagccatctttcaaagtatgagtgagaagagtgtggaaccagggacagacagactgggttccagcactagttcacttctaccaagtttttttaccttaagcttgtcagataaaatatctctgccactcagctcttctctgtaaactgagagaaccagagaatttcctaaataccttctgcttgtataaaatctgtcaggctgttcctaaatggcatttaaaaaccaagtgcttactatctctaatattcaggataaatcttgtccacttttcttttgaattcaaaattcacctaaattttgaatttaaaacatgttttctaagtacttcttgctataaaaatagtggcgatactatgaaaataaccaaaacaagtgcttttcactagctaattcttaaatactataccctccaatattattttctgaacatcaaatcactaatcttaggataaagtatgccccttttacatgttgaaaacttgacacacagagagaaaaatttgtatttactcatgaagaacaaagggaattaaaatttgttgcttccagcttttctgggagatcatctaccaccatggcaggtgtgatgctggacaatacattaaatatacaaggtagaatggaaagaccttgtcctggaagagctcagtcttaaggaatgagtaactaaccagagggcagtcactgagagactgctatcattattacaggggtcaaacaggtgggaaagggctgttttatatatttattgtggcttgttctcagataagagcatgggacttgaccactggttctcaaaaggaaatatggactagtttgatacaaatctctctatagcatgagggttatcttatgaacaccaactttaaatgatattttacagagcgctacaaaaaataacttggaggaagtttataagaaggaaggcttcaagagctgaaccagaaaaaaaggtgcttgaaagtaaatcaaattatgagatacgttgaattatggcatttattattatgtgcagaatatgcatggaattttgaactaaaagctgaaggagcaaagatctagaaaccttcctgcataataaataaattaaccctttattctcttattttccacactccctatatttgatgacttattcatacaaatgtacactaaaaaggcctaataaactatggtctaccatgggtgcatttacctatttgtgtacatgttttaagcatatttttctgggagtgtttctttagtataatgcaggcacagtatttcaaaggccaagaattctttggaaaaaggaaaaggagttgtgtctgtttatgactgtcaaactttcctaagcttattaaattaggatatgttgtccttttctttcataatttgaagattattctagtgatatgtttggagataaaaaaaaaaaacctgtcaagtaagtcagagctaataaatgggttaataattcactgaaaacccgtacgttcagtatgctctaccactcaggacttagtctcattttctactctaaaatatcgaagttttcattggtatttttttatactggaaactacatagtgtaagaaaatcagcttatcatgagcaggtcatcagctctggaaatatctgcccatgagaaaaaaatgtgattggaattctgtcaccaaggaaatgttttaaaaatctgtttcattgccaaacaaaaagcttcaactagttatctttattttacaatgactttaattcttttgcccattcatttattacatagctactatacactgatcatttagaaaaaaaagcaccctaaatgattatgcaaaccttaaatataactatatgtttgtgtgtattcgtatgcttttttaaagagcacatttgtgacaggaagtgaagaatggcatagtcgggggaaaattaaagagacacgatgtaattatccgaactggaattaagccaattaataacccttgtgctaacactgtcctcaaagtgctgaaaatgccgtcagatatttaaatgccctgggtggtcatggtcagcactcttcccttcatccattttcagcaccatgcagggacatggctcaccctggtttctgacaaaggactacacctgaagtgagctacagaagaaggacagattctataattcgaaaacaagattctctcaagtggttttgcacagattattactgatctccaatgaaataaaaattctagtgttttttttatttgcttattcattcaacacacattgactgaatacctactgtgtgccagtttagtaccatggctgagaatgcgggctttaaaatcagattggctggatttaattcccagctcctcacttgctaggcgtgtgatcttgagcaagttacacaatctttctatacctcagttttcttttctatgaaatgcggatattggtagtacctcattcataggattcttgtgatgctaaagtatgattttaaaatgtaaagtccttagcagactgcttagggcaagccaattagtaatatgttggccatcattattattatgagccaggaaatatagtaaaatctgggaacaaagaaataatacaaccccagatgacctaacatccttgaagtttagattttaggaatttagttctaaactttataatctctactgccaatcctttctagtagagatctgtatattagatccttgctttgctatatgctttcatgtcttgaacctacatgctttgaatataacacactcagcacatccataatatacacttttgtttacacaccttcctccataataactaccgtgtaatgactagctgtgtactttatatgtttcctcatgtcatccttaagacaactctatgggaccaatatcatcaccttttacagaaaggaaaactgaggctttcagagtagctgtgacttttgcagtgttatatataaatatgtgtttgctccaaagctcttgttcttttttctcagttcaccaacagacatttactaagcactccactgctttcttctgggctctggcctatcaggtattttggggcttgccaaaggatctgccattatcaaaatcactgattccttccccctttccaaatcagtcaactgtaggccgtgtgttttaggcatggcatagcagccattgttaaagaggttggtgtgcaaataaactaaattactctggctatgacttctctcagattacttgtctttgagtgggctcccacgtgcctgacatttctttcggttttcttctttctccctaagtagcaatgttgttgctgaagcatgactgagagatagttttcggtttcatacacatcctgagtcttgttttagggcaagaaacttaatctctccagtaacatctgatggcactgttctcttcataagcacctctttcaccatttaaaaactggaccttcaattacccattgtcaaaagggaatccttagtgaacatgatcatatgtgtcccgaaaaagataccatcactttcatgggcggaaaatatagtttcccctttttagtagctcattttcaattgaaatatattggaaaggttgtacatacctaattctccaggtggaaaatctcatcagtgctttaaaactacatagtatgctgaaagactcaatctctttcacccacaatgtgcctatattttagaaacgaggtgtatgagaaaaaccacatcttctcacttggtgatatatagcagatgatgttcatagagcgaattgtaaattcagggtgaggtctttgtagatcaaaccactagccttcattagcttgaaaatgtgacacaagttatatcttgctgagacgaggcctctacaatattatatttttctgcttttctcctagaatgaattaaagacttaaatcccttgttcctagcattcaaaatggtctctctctctctctctccatatatatatatatacataaacacacatatatataaagtggaaatgtatttatatatgtaattatatttccatttggctatttaaacattttgagaaattggaggtttgtgcactaactatataggtggagtaatcttcttatttgggaggtaagggtgattttcatacctgttgggccagatcttcaaagaatactctaggttagctggtgtggtggaaagagcactggcctggtgggctcctggagtcctagtgtctagtgtcgactctgggcctcagtttcctctctactaaattgggagggggagagattgatctctggggctttttctagctctgtattctctgggtctgcaaatcgccttcagtgtctgccttgccagctctgtttgtcacaaagattaatccattttaactgtaccttggagtgcacccgggagaggaggatggatggattgttttgtacctaatattgcatcagaacttttgcctttttagatgagatcgtgccgtgcctaaaatctgtctgcctatctgcccactgactttgtctgtgctgatctcttgccacggtgcctcttcttccagcatccttctccctccaagatctagattcggcatctgactgtacctgtcttgttctctgcagcatctgtctgctacactcctagaccatcgttaataaactttcacacattacacgaaaacccctaatatgttggcacctgcacataaatatctatggttcataaaactagaggagaaaactccattttttaaagacctctatctagtgccatttgtatttgcactttttgtttagttgtaagttttaatagttccccctttgaggatttgtcagtacgagcagtattgcttatcagaacacaccaacagtctttttgtaatattcgcttttcccctttggttcagccgagcctgctgacagatcattcaaattcaattgttttatgtctaagccgaacagctaattaaagtagggatgattaacctgactggcagtgccgctctccctctcgcgctctctctccttctccttttctctctctctccctcctgttccaatcagtctttttctcacacactctctctctccgtctctcctctctctccctctctctctctctctcccccccctctctctcttccccctctctcttcctctctctcagtctctctctccctccctcggttggtgtctctctctctctctctctctctctgtctcttgctctactgtttttttttcctctctctctctcctaaacgtggtctgcttgctgatggcagaatggcactcggagatttgtgcattgtgtctggtttcctacgggcaggctgacccagtgcctccagggacttatcaatagaccactcagaagagacacagacaggagagaggaggaggggtggggggagagagagagaatcaatatcaagaatagaaggagctccgaagccattttttttttaaagaagtatcgggacttgggagagggtgacaaagaaggtttttcaaagaggcagtggaggaggttctaataaatttggaaggaaacagttccctgtcttgggaaaaggagaactcctgactgattagcattcacaccaggtatgagatgttcgctaccccttatcactgtgtcgcaaccgagatggaaaagcctttttttttttttaggagaccgagggagcatgtattttgctgtgtttgttgttggggggtaagaggggcggcgtgagaagctgtgggcatttgtgtatgagagcagaaagaatggaagcagtacaacggggggtgggaaagagtatggagtatgttactgtcttccctgtctttgtgcacccctggggggttacccaagttcatttctagcaggtggatttagacgggagttacttaacgcttgaccgccagttttgaaaaaaaagaaagaaaaaaacgctgcttcctatgtctattaaaggaagctccaatttctctctctctctctctctctctctctctctctctcccttctcttttcctctctcttcctctctctcttcctctctctctgccccccatccctcttcccctctctccctctccctctctcttctttttttcctcttctaaccagacagcgggagggtttctggctcccagccagcccaaaagcctctaagtgttttgcacttgtttcagggagtagctgcccggggatttttcagcattttcactagagaacaaagagttctttacaaagggaagggtggggggggggggagtgagcttaatgtctgatatatgtttttctatttttattagtttttcgcctaaaaagaaagagacaggaacagaacattcactctataaagacacaaagacattcaaaagaaatccagttatcttttctccccatcatcccaatatatacatatatgtacatgaaaaaattaaaaagaaaaagactagttaagttgcatatgttgctcttttctcctcttttaatctttccaaatccaactgttcttatgctcactttatgctattttttttctactcacaataaaagttgttcaggatgcatcttctcttatcatgtctttaccctttctgggtcgccaaaatcttgtggaagaaagaacaaaagtccatcaaataatcaatttggtgactagaacatcttctacttttgccacttgggtaaaaagttaattatggaatttgggttcccaaaataccaatggggtacatcagttcattcgatctcacaagtttttgcatccatctgtttaaaaggtaccacttgtgtcacttgtcagttattaagaaaaggtagtaagggagcagatatttgtattttatttttgtttctaattatgtaaatgacaaaacccccagagagatttcttgccccttctatgatacactagttcatgcaaaatatagtctagatggagattttgtcaacgattctgattgccacgtagctttgtgttctccatttcaatttttgcctatgcatgtatatttttaccatgaatttgtgttgtagcaaacatttcagaatgcttatcattttcaaattaatgctccaacaaaagcaaaaagaaatcagatgtgagctgtatgtgtaaaatgtagtaaacaattttatcttttatatatgctgtacatttatatctttatgctaatatcctggatttgtaaacccaagataatgttttctttcttaaagttctcctcttaatgcatttatatgttgattgtcacttagaaatctttttaaggtacattatagacacgaaactaaacaaggggaacaattctcaagctctacaaaaatccttaaatatatattatgtaccattcctaactacagataactgttttgctaagtagaaaacagctacaacagttgtttcaagaatcagaaactcttttctttttttttctattaactgaaaataaaatctattcatatccctggggagggaaaatgtaggggaaaatatagatatatacattttccataattatagaatgcatttatgtaactgcttcttaagggtgtaatacatatcagggcagagtgtgatgctcatcaaaaaaccctcctggctgggaggtgtgagtgccttatgtttgaagtaacttgataacaaggagtcttttcgggaaaccttactatgtatgtgttgcctcagtaatgatcctcagataaaaaacaagtactaggtggccagtgttagcacttgaactcactgaaagatattagaagtaggggaacttttggcaaatccagaattttccagggtaactcacttcttacacttacatgttttctttaggaatattcttgaattgctttcagacttttctgtatttttgtagaattttttaatgcttttaatagtgcttaaggagaaaaatacttttaaaaagaatgtcatccaaataagagaaactcagtctttaaaaagttttatattgaagacaagagttgttttggttttgcttttttcctttttgcttgtgttctattttttctccctgaattcttttgttgctgtgggctgttgtccctgcatttttaatttttcatttggtacccccccttttttttcttttttctttttctttttggtctgtttttgatgtgaccaaggggatctttgaaaggggcagagggactgggataacaggctgttactgaaagctgcactagctcttcttgatcccaactcaggcagctcctatcagctagttgtgccgccaagagtacagtgacaggtgatagctgtcattctgggattcttcgtggatctgacctgagagtgacacattcacagtcgaggagaaaagggaaaaaaaatagaggaggaggaaagaaaagctctttgagctggaatacactggccctttcttcctgtaggcaatccgctccagttcttggcgacgtgtcctgcactatcagatatcatatgactttttatttagattccttttcggagaatggcctgttaggactctgtttgttttcttttatttaatttccttctcccctcacccactagttttgcgtatctgtgtgtgtcatagcgtgtgtgcgcacatgcatatgtgtgtgcaatttttatctttgtttttgttctgttgatctgatgctttatttaaagacaaagctttaattatttcagtatactggtttaattatttgccaaaaagaaacctcattctaggctttttggggggtccatttttaaacacatccattaacacatgaggctggagatcctatatgcttgttggtctgcccttggcccactccctcaccttaatttaaccctccccttcatcagcatgcacagcagtataagttaggaaacacctgtgctgagttgagagagaaataaaagtagaagcaacttcttcaaatttgcactcctagtttcactttaataaactttttttaatcgttgattttttttttttttttggcatcctctgttaagcttgaaagcatcagagatagtgaacgatgtgtctgtggagcttttgtgaggccagctgagcacccttggaaagtagagcaggagctgaaattcattcagagacttaagaattaagtaagagatttaaataagatctgtgagatctgtgagctgttcagggtttggtgatagatggtaaaatggaatgcttagggatattcaaggaagagaaagaaattttcaaccaggaacgaaacaggcatttctactgcaattcatactttaaaaaccttcttttatcaaatttttattttatatatctcaaaatttaatcaattggtatgattgccttcttttccacgcttgctatgaaaaacagatgaattgtgccgatgttattactgggtttctcctaaatttttgttgtatttctttttcggctttagagagttctgattttagttagcaaaagaaaaataaaacttctctaggtatgcatatggttgtatacacattattcttatctacatataatatatcctgtttgtatcaggatataatttttgtatagttacatgcaagactgccttgaaagttcagatgaccattacattctttaaacccatagtttttagtttcttgttagtttctctaaaattattttttacagaccttaaatttgtaatgccttatcatagccagaggtgaattttgttgaaacttggagaaaaatttattccacccctttaagcgtacccaaaagggaagagagaactatttttcgttcaacaaaaaattttaaaagccttttttccttcagcggaaaactccaaaacagctttgtctcagaacgttaaacttggcatggataaaaaaatttgagttttgctttgtttgaggaaatttgtttttgaaacaacaatgttataaatatttttaaattgcctgctgagcatgcgctgtatctgactttattcatagttttaaacacacaccaaagtgcagtcttctgaatggccacaggtaaggctgttgatttgtatgatctttcgcagaggcaccttctgtgagtctactcagttttccagaagggaaaaaggcgagagctgagtttagacctggacacctttctaaatatcatagagcaaaagtaaattgccccattaaggcttgcacattacacttagggtaagtactgttcaactttccttttttataggagttgcctgccttaacttttcagcttaatacgagcagcgtaaattaagaaaaaaaattaactcaatcagttatttcactgaaatagaaaatttgcagattttaaagggtatctattgtgcataaatttggggatacgagaatttgccagtgaaatgatagcagctctgtgcttacagagcaaagatgtgctagtctgaacatgcctgatctcatctggaatcgaaagctaaatctaggtgggcctgtaataataccagaaaaggaacacatgtatcttttgtgcaacctttttttttttttttttttaaagctaggcttccaaagggaatgacaaagaagcaggttctcctcttgcttaataagtagtcatagtttgcctctggagatatgtatttccagttgttttagttgttttgttttgttttgttttgttgttgtcatcgctatcgaagaatattctttcctgtcagtgattattaacactttccgtttttcagaatgctttaactctgtttgatgtttcctcacttggttacctttctcaagtctgcgatgaccctctcaggctttgccattcttatcgattcttaccagaatgtacttactcattagctgttttgttatagttatggtggagataatcttgtttttcaggcttttataactaaccaaacaaattaccttttgaggtgaaatttctcatagttatccttgacacagaactgaacttgtcttgaaaaggcttgaagaaaatccaattagccgttttttgagaactgaatattctaataaatgcaaatggattattttacaaaatacttattgatgtgcaatgcttttctaatctgtttttcttttcgtgctttaaaacagaccctgaaaattaaatgtattaaaaagaaagaaagaaaaagaaagaaacctgccaggttaatactgatattttaaatacccaatttaaaataatgctcaaagtttgaatttctttgcaacatatcacctttcagtgtcagtcagtaatacctgggcaggtatatatatacattcacacccacagggaaacatgaatccactttacagttacattaattctattttaacctacaagagaaaaggttagcattactgtaaaacttttgttaattcattatattttatttttctgtaataaaaaattcactgaactattgctttcatccaattatatatatacttaacacccatttatattcaaatattttatcttaatttatgaagtatttttataagtcttatatgctgctgaattttatgcagctatatgaacgtttaagttttttctgatacaatttgctttgttccgaatctgttactgtgttagaagtttttttctttcccaatctagaaagagtatggccatcttttcctatatgtgatatctatacatcttcagtattctgaagaagagattttttaacctgcaatctcttggaaagctttcaaacaagtgggagaagtaatctttactttgcttctccttgatccatctgtttgccctcactgtaccacccgtcaccaccagcaaccctgaaaaaaacaacagtaataaatatgatacgataatttttctgatcacagaaccaggaaataccagagaaaattgtggcatatgtaggaaaatgccaagagcttctccagtaagatcagctgtttttatactttttttttttcctcttgaattttgtttgtgacttttttggcttgctgaagcacatccccataatcttacgaagccacagcaaattcccaatgccacaacaatactgtgcagccggggagaggccagaagagctgatcctgggtggctgcaggcttccccagcaatggtgcaaggcaggaggagtaagtaggctactcttcttttcccttcttacctaggctgcccaacctgccagctagagattttctttctgtagctttctcttcaactgtctgagacatttccttcaacaaccaatgactttctacttccaagggatggttcatatagcaaaacatccatttttattttatattgcaacatggaaagctttgaaattggaggggcaaaggaaaggggctcagggtatccgagaaatatcccaaatggcattaggctcaaagctgtttttcatggttgctcaggtctataactttcctgttccctccagagcctctaagtggttgaaagtagtgaatgggataactatagggtacacactatgatctaactgattcagtagatggagctcttctccttaagtctgtatttaaattaacgtcccactctagtttgtggggctctctcttttaaggtgtgtcatactacacacataaaattgaggcctgcatagctagagaagagatttcctggcgcttttcaagagacatgaagcatttgttctgaaatgcaaacagtgcaggggagcactagggtggggtgggaagggaaatggagtttacctatctaaatttctctctgtgtttgttgatattcttaagtgtgaaattaaatcctagcagttattgtggaatacacttattcattagctaatttgtaaatgtagaaaaatatattgcacatgcaggattttggtgatattcattgcaaatcttccaagctatctgaactgtgcagatctcctttcatttaattctacaaaagcatcttaatactgtaatgcagttgtttcatctaattagtctagagtacctgaataaaatgttacaagttctgaattgtgacagcacagtggagggcaaagtagtgtgttagtaaggtgcctttgtggaagccaaaatattttcagcaataactgaaaatagatttccagtatctgttttaatgggggaagagctacttgtttatttctttttaaattaattgaaatgaataattgccacagaatttttgtcagtgttacattgttttcagtaccaatagaataagtttgatcatgtctcttcctggtaccaagtggagaaatatatgtacactgtatgtaataaattatcttccttagtggaatgtcttctcacagattggagatattactgaatatctcttgttaaatcttgataagatcatttggccaaagtagaactggtcttggctttagtaccaaaagaaatagcatttttaaaagacttggatttcctttgcataccacgtgtctgagtttgatacagtccaggaaaatagagaggatgagatgaaattattcctaagcagccgccgtaggccaaacactgaaacagtgccaacctggaccaatcaggccggcttctcagaagatacatgcttttgtcaaacacttacatgaagaaagagagagaggaagttcgtgaaactgtatttgtatgaatattcttcactgatttcaataaagtccagggtaataaattcgatgatttttattcttttgtaaagcagaaaatctgagtttttctgggcagctaaggttctctaaatgttgtactgtgacatcttttaaacaaaactatcctttcgaatttaagcagtgcaaaacttctcacaaagagcaaagagtaaaattgatggaaactcagaatcaattccaaacccatttctggcatgatgagaataacatttgtgctgtgtttaaagtagtttaaaacaagaaaatgataaaatgatcaatatacttaaagccaaaaataaccaggagagaacaatctgtaatccattctcagtctgaaaccccacactacttatttattgaacatgaaaataaacaactatatattttataaggtggccctgcaaaccttataacatataaacagtaatgatgagatgccaggctttcaaccctttatttaagctatgtgtttagaatttagtcaggcaaaaactcctggacttaaactattatacatttatttgtttctacataccatgaccataaaaagaacaaacgttaaggaatatatagattgtcgcagtgaactacattgccaccttacagtttatgtactctgtttgttttaaaaagaaaaaaaggttttaactacagcaaaagaatattttaagttagaaagtcagttaattgatcaatatagaacagatttaatatttctttaaaaataccttgactcctgactaatttattaaattcaacacatacataaatgtaaaccatatatattttatacttattgctttaatggattgctttaaaagactaacttgacactaataaattttgaacctgtggattcaaggtcagtgaatgctgctgtccaagtttacaaaaatctctctagacttaagattttgctctaataaataattttcttaccaatttttcagaggcacttaactggatatatatttatcgatcagataaaataaaattgtccatctagatttttaaaattccagctgaagaacttaaaataacaacaaattgcataggcacacaatttcattgcactgaggtgctgtaggaatgatgataattctaatgagcactgtgacgaatgcaactacaatgaaacatgtttgattacatcagtaagagtgaactcagtgggcaaggtcagaagggtgagacatagaagtcatgactgagtgggggctaatgattaaagttatgggagctatttaaagccctatagctgggtgcaaaattaacagatgtggaaaataagagtcaatcaattctaaatatggacagtactttttcctataggttataattaactgtagaatttactattgcaaggatttataacaacatcataagctttggttgtccagtgtgatagtagatgtaaagagctgttatgcacatctgcttaaagatttatgtaagtgtaattgttatagcaacttgttatgctattgtttgaagtttaaaagctctgctttaagcgttgacaaagcaaatgtcagcatcagagcatcataatcactgtatcttggagcttgaaggggctttagatatctcaatatgggtgagtgggttaaccaactcttcagaatggaatattggaatatctggtcgaggaccatgtagaatttgaaaatacatatatattacaatgttttatatttggaaaacaaaatttacgagaaaaacttaacaaaatagagaaagtaaagctctacaaaattatctggactaatggtactatatattgcattctgtgaaccaggaattttaaatagagaagaatagaaggatctacattaaaacaaggttttatttttatcaaaaaaaatttgatgagggggttgtccaacagattaagaaatgatattcaggcttaaactactcattttgccaataagaaaacttaaacacagagaagagataaaatgctttcaagatgagcaaggcaaaactgggaccagaactcaagttttctaactcacgttttcttgatgtactcctatgccaaaaggctgaccactaaaactaatttataaaaataaaaagtaagtgatatcccactttgaagaagtggaagaaaccagaccctcagggtttctatttctatgccagtaacctcacctcggatgtggcagggacaaatatgtgtgatgaggataaggcattctgaggaatgaaggaaaatgcacccaaatgcattgtactccctagagactctggagttaacactgctgcccagacctccatagccttgtatctcacattttttctccctctatcgccaccaaaaaataaataacaagaaaagttttgagaaattgtagtcagaagatcttttggaaagaagtatttctttgtagaaatattcctgtacagattggtatattttactatcttatcaaagtatgagttctaatgagacattgatgattcaacaggtttataacattacaaactggaacaatccttgtttcctaagcacacaccacattttcccatccatgttccttttctcctagtattcccaaatagaaacacattctgcctcctttatttctacaacactttgtatcttttaatgagccttgccatatttcattttatatgcaagctatttatgtatttatttgtaatgtaaagaacaggtctacataattttaggcaatgtacttaattttactgggcctcacgttccacgtctgtaaagagaaaaacgatatctgccttcctaggatactataagaattccatgaaatgtagtatataaagtgcttagcagaatgactagctcaaggttatcactcatcattgttgttattgttattgctactattacttattaatattcccctgcctctgattctttcccatttatatacttctcgaggtcatagattgacctaattcattgtcttctcatgcaatgaacacaatgatttttgtgtaacaggaacctaataaaaatatattgaatctttttataaaagtccatattggacctattatttccctacaaagatccttaaatcctgtcctggaagtttaaaatagtggtggttatggccagtgcctgacccacatacattgtaaaatgcagtggtgttgcttgctgtggactgtcagagccacatgatttttcaggttccccacagacccccaacagcttaagactgctctttgcagcatccccagaagtgtcagcttatatttctggttcatgtgattaatgagcttgttacacctctgtctgtagcctaaactagaaactttcactttggagagcaggtcaagatatcgaatttaattttggttgcatctgttataagccaattgtgtattcattacatttatagattccctcttcagccatatattttcatggctgttgagagcacctgaatctgtgttgaatgtccttagattttactttggagacctgaaaatgagacagtgagatctttttgatagctagctgtcatctttggcattttcttccctttagtgtgtaatctggtctaaatttgaagaagagggcaagtatagcatttttatctagcttgaatatggcatggtaattctgtattaatgaggtcaatggtaaatgcagttcagctacacatttctgtttttccagacatacaaacacattctgtggaaatagaaaatgtctaaaaaatggaaatgatgaaataacttgagacatgtaagggtagagatataacattaaatgtatgggtttagcaagcagagcaacatacaaagtggactctgagtatgtatggatcttgccagtccttcaaggtttcagtggatagcaagaaaacgaaaaagaggtagatcacatgaacatggcagaagagagactgacagcagggtgtgctcaagtcagaaggaatgttacattttaatcagccagaagttccatttatttgagaataagctggtatttgtgaggggaacaaggtcacatttagtagaactgataattcaataaaggattttgactttgccagagtaatggtgttggcatcaagagaagaaagttttgcagatttctgtgtgtgcacttgctgttactggtgttcctggtgggtggctgaatcatcctgatggcattcaacaggaaccagctgctgagaatattaaaatgcaagcatttattcctctagagagacagtagcatctgcaaagttttcctatcttgatagtacagataatcccagggagcattctctagtagttttcactctctattcatttatacattttctttttatcattagcattaatatctcaagttctaaatgaagagaagagtgcctgagtcctgagtccacaacaggctgtagagatggatagttaacacttggccaagaacttggtattgcctcttgggctttaccttgaattgttatctaaaagggggaaactgacatttccctcccttggcctgtcttcaaagcaaagagtcatccatactcctagtcttcagcgagctccatcagtgtaaatcctgcccccaacaacccccaccaaacacgagctttggagcttttcactttacttataaaatttgtaaatttgttgctttccttgtgtgtttgtattttatttgtttgtttggtttattttgttttgttggtggttttttttgttttggttttggtttggattttttgagctaccatcaacagttaggggaaagggagttacaaaaaggaggtttggactctgtaatcttccaggtctttccatctctaatatttatgaataatgtattgaactgatggaaaaaatgttgaatatgttcattatgaattatattcaccggtgtgttgcctagaatataaaagagcaaagcagttgccgtgtaagtggttgcttacaataaatgtagtggtacaacagagctctgtatcccttctcattccaccgcgcgtcgtccccaaacacacgctttacatgtctgagtggcaactgcagatgaggtgcttgatgggatgacagccagccaaggttctgacgggtacagggacattcgtagtgcagtgggtcttaaacagaagcagccttgatgaaggttttgatagtgcagtttccttcaggagaaatcaccgaagccagtttcacatagcaaacattactcaagtgctttcatgctgcaggggttataactcctattaggagaattgaaacttataattttgcccctgatttttaaaaaacagcatgaataactaatttgtcagcaatgttacattctaaatgagccggagtggcagaaaattcagaactatttattatatttagcttcaaaattcattatatacttgtctctgttggtttttcttcataattatgttttgtttagaatttatcaaaataaaattgtattttctaagcatttaccagatgacattgagaaacagtaaccagaagcatgataagagacaagaaatctttttagtcacacaaataatcgacaaaagagataataaagagttaaaataatagcaaaatagtttttcactggccaaaaaacagtgaggcccattatttatcaaatatgtcaccgtaactgatatgcaaatatgtgccaaaatagagaaagaccatctaaggtcagggactcagagaggacagccctaatgtagagaatagttccaagttaaagcagttcaacaggaaggtgcacagaaagctctggcttttgtctgatatcccaggagaatagcagagtgttgatgagcaggttctgcctccaaaaagctcttccttcccatggtatcacttcagagcctttggactagctcttgcgagagaagggtccaagacagtactcgtaccagtatccactttatagtgacattaattcaaataaactgtcccagcgttatctatccttttaaaaccttttagaaataagcttttttctcccctatgctctctttagaagctgaaacccatcaaagcccatgaagagcaagtgtaaatttagagcaaccacatttatcaatagtttataataatctcagaggagaagcagagagaagaagaaagtaagagggaatgagagaaatagtgaaatttttttcaggaaaattacattacccattatttagatcaagtcactcaaaaacaataaaggatacccaattccatagtggtatcatgtaagagcagatgtgggaggatttttttttcccccagctccacccttccttacaggacaaatcgcttaacctatctgtgtaatagtgtatttgtcaaataaatagaaaaccatctatcctcatctacttcacagcagtattgctaaggctgattgtgcacacatatattaatgtatatatcgtagctatctatttacagcaggggagaatggttttaaaataaatgaatcagagttttatgtgtgcatccattgtgaaggtcagtcactttttaaaaaaaaaaaagtaagaccttctctgctgattaccatttgttaaaacacttgaaaatgatggctgagcctacatcacctctgtgaaatggaagacttttgaaatctaagcatgattatagagattcaaacacatttccatctacttatggaccctaatggccttatgcagagcagcagtacaaacctattaagccaaataaaagattagctttgccaatagatatcttttaaaaaatcctaaatcaaggatgtagcaattggtctagtgtcaaagtataattctggctgtaggagtgaactggttctctatattagatatttttctttaatgggacaaagatgtatagaaaggacggaattaagtttcaacctgtacagacatcctaggcatctgccaagctactggtctatccactcaagaagtaggctaagtatatataaagtccctaaggtcattggaaaagaggccacattcatttcactttggactgctgttattcttttgatgttggtctgagctctttaaatctctactttcttcatacatacatacattttttagacatgatgttaccctccaatagcttttcaccaggcccattccaagcatccaggaaagagaaacttagcttccatggagagtgaagtcatcgcttcaacttagcataataagaaagggagaaagcatactgttggtgaaatgagggagtttctgctaggctatgaccagattcttctgtttctgctattttttctctaactgaaaagagttattgtggtaattcacctgcacttctgaacctgtgtgcatacacccaagacctactcaaggtaaagccagaaagagattaagagcagactttcatccaggggactcagcttctttttagtgacttctgcttgttttgttgttgtttttaaataaatttgtgtttttagaaaatatgtttgaattcccagacattgatatcctgggcatccttaggttgtgacagaaacacggattagtgactgtgacaaatgtcgcagaagccagtgcagttgcaatctatcaaatatgttggcagaccccaggattttctgatccttgttgcagaattcagttgtgtccttaccgtaggaagacagggttaactgagagttttgagagttgtggtatgtgcttttccatttgggtctgggtagctctgggactggaataccttggtaaaaacaataactaaaactagggccagcttcatgggtatacaacctgtgcagttgcacaaggtcccatgtttggacgggccctatgcctggcttgatgtgcttctgttgctgtcctgaaattcttaataattttttaataaggagccctactttttttatttttccttgagccccacaaattatagagctggtcttgcctagaatttatctttccctagcataccaattgaaagtatcagtcattttttctcttactgaaaatgatacctttttcaattcctcaaaagttaattcctccattaaactctttgaagatttctgtccacataatgtggttcagaagaactcatctctccttctttcctccaagcaccttgagatgattatgatcaaggtgatcttgttttgtaatcagaaactctatagctgtctcagccaagttttgttttgtttttttttggttttttttgtttttttttggcaaggagtgaatactagggagaaatagttgtatcatagtagtgagggctttggcctttattggatcattaaaataggcttcagtcattaaattgatgttttaaaatgagcacctaacattaagattatcttagcctaggtacctcccaaccatcatgtgatcaaacacatccgtgtatgctaaaaacaagctgatctctcagctctggccctgggcttctgcctctctcagacccccaccaatgccactgctagctatgtgttctgtggccttcccctcatcttcccttctgctttcagctcagatcaatccttttattcttcttactcaaaacacaactggcattagcaggaggcagttcctcgcttcagtctacatgtagcatctaaggagactacttcttgctgagttttgtacaaacacactaatgcctgccaccacattgatgagtgtgaattacagaattgtaaggcctggagcagaccccagagatggatgggcctgtccacactgacagtttgttaggaccaagccttaatccagaaaatgtaggcctcctgactcctagtcaggtatgctttggataactcaaggggtgttcgacattcctgaaagataaattccacatgactggctcctaaacctgttttcaagcacccatgagtgaaaggaggaggagaagaaaaagaaatatatacatataaataaatattttgtaggagctgagaaaagagtgctgtgtaacaaggagcctgactggccaccttgagctctagttagctgcttcaaccctataaaatacttcctattactaataatatcttcagggctgttggaaggatctagagagatgcttacctaacacaaagcctaactcacttggaagctgaggaaaggttaatttcttctacctcttcctcctccttctttgcccttactttcacacattttttcctccctgctctaggaaaggaaggaaaacagaagggatctgatggagagatagtctttgtgagtttaaattatatgagattaagctactctcacctcaaccaagtaggctgtagtttgctgaccgcctgttgagcaacagcacaaccatggagcaacagaagagccaaaggcatttttgataaaccatgacatctctcaagggatttttttagtggttcaccagctccagacaaggccctgggcaaaaactgcaatagagactgggttcttttcagtccttgtcacccacttcatcttctcctctgccagcagagcctagggtccttgtgttagttaatctgattgcttccttcaccttcccctgttccagaattatccctatccctccctccagctccagttcaaaactgctttacactgagataactctcttggagttgaagtggttatagcatgaaggcatgaatggcttgacccctccgtggtatgtttgcatctcagaagaagtgctggaaaaccttttttagcaaggggacttttcttcttgcaggctcacaatcagctatgttcccaatgtgactatacccaccccacccctttcttttttgttttttaagggttgaagtctggctcaatcacccaggctggagtatagtgccacaatcatggctcactgcagcctcaaacttctgtctttgctgtaatcacacatgtgatgtgaactcagaaaagcaaactttgttcctggaggaaagagagggagggaatataggtttacatagtgaataaaacccagtatgatagcaaagggtctctcttacgaaaatataacacaatattactttttttgtatgaaaataagtttctatcttggatagccaaggccttaacaggtaacattataagagtactataaacaaatttaaaacccaaatgttttgtgataagtcagggcttctacctcctgtgaactctgggcattttgcaaatttgaataatcagtcatctcgagtctcctctttttacagatgagagtattgaggctcagatgggacacaggttttcttctgggtcaccaaactcaacagcagagctgagtttggggcccttgggcctctagggagatctagcttttctgtctgatacgggaactcctaagagcacctccatccaccccagccagctttcctttcttctggtcatttctctttaacagttgttgctcctgcactcatcaaaaaaaaatgtcagcacaagaatcaaagggaggctatggagcattagagaaatattagcaactattgaaaagacattttgacctatttctgtagttatcaatttaatagtatttgttgccaggaaatgcaccgttggcgggtgggaaggtggattgcaccagcagcctgttctcagaggccctccagttacaggaggtggtaattccagttaataaaagggtgaacttcaaacacattttaaccaaatcaaattgtagcgggaaatatcatattactgatgttcaagctgactcacagctggtaacattagtcagtatataggccccaaattctgacttttcagcattttcagatgagtttctggcagtgagagagttccccaggcacattgttatgtaggaataggagatttttagctaacataggagctagcataaatgaagaatttttttattctcgttagactttttataagattgtcagatattcaaataatatgtaaccaagccaaacttcaggttgataggaaatctagagccaggagttttaatttttttgttgttttgtttttttctgtgacatgttggcaaatgataaaagcaattcactctgctaaccagagatgctgggcagaattcccccaacactgatttcatgccatgaaaagcacatgaagtctggcctggcaaggcatggtgaggagcacaggctttgtgtcctactgctccaatttgaattccagcttagtccctactagctgtgtgaccaaaggatatttacgtaacttctctgaaccttaggattcttatacaaaaaaaatgggcaaaatatcaatcattcgtagttggtatgaagatcaaatgagataacatatgtaaagaaatccatgcataaagaaaaacagtgccaaacgtgtaccaggtgttcagaagtgatcactgttatcttcctcccttttgctgctatggtgtgcaagtttttttttttaaagagttaattattttccaataaaatgcacagcttttcatatgataataaaaggaaatgctgctggatactccacagattaatctggtgagtcttgtttgagtgaatggctgtttgccacctcattttagtcccagttaagcttagacttccctttattaacctctctccggatcatacatacaataggatacatggactacatgataaatcaaatggccccctgataacacagtcccaagttgtgtgagcattggtgagacaatggatcatatgaatagctagaaccgctcatctctcttccacatgtgtcctactacacctcactttgaatcaggaaagatgccagacacctttctatgggattgcctcccacctggattttttcctaaactttttccatgcgcctgaatctcggttttcacagagattaattctgatttggttcgcctacacttttgatgctctaaacctttttattgttggcagatagtctcaaatactgtgtttgagaatggaaaaagaaaacgctgctcaaatgtaagcaccattgaatcaaagaaaccgtattttttcaattgcattatttgaggatccagacaaccttgaatcctttacaaaagcacatcagtaaggctatcctctctcttagaaagatacacacacacacacacacaaacacacacacacacaccccaattgcagaaggctactcttcatgaggtaaaggactagagtgtccaagaggaatacaaaatgaaaaagatgtttctgtaggaagaacccagacctagaagccaggacattcaaattctatttcccactaccatgggaaatacgatcttatatggatcctagcatacctgcctctcccgaactccatcgtcacatctagagaacatggattccaactcatactccttaggggctatcaggaaatgtattttttgctgttttgaaagacattttgatacccctaccgagagcattttgcacaggccaagtatttccctcatttggaagactgaagccctgaattttacttcccatcactctggaatgggtaaaaaactgaactttttacactagtgtgggaagaaaatgatgttcttataatgccaacttctagcagggtgttaataatcatctaaaatatctagaactaacacagacccattgacctggtctatcattcaattgacttccacttttatccatgcatgtttttgataaacattaattatggggtgacccagtgtgagaggagctgtggacacagtgagcacatccctcccctcacagcctagctaaccctccaatcccctaatgcacatcaattgtaagttgacttaaagttgtacagatccttcctttctgtgcattgagtcatttcagtatgtctatggaggggtggttctatagccaggaggacttgcttcttccgaactgctaaagcacttatttgtatgtctcctgtggcactgattacatactgtcttatactagagcatgtttatatgtctcattcctcctgccactgcacagtaagcttaataaatacagagactgtacttacacacagttgtatccccctcaacacctagaatgtgccatcagaaataaaaggtatagtagtaaatgttgtgatttgaatgagtgaaattaacaatggcatgtgagtgtttggaaagaaattaccttttctgaatccataaatttctactcagaagcagagaacatcactcagttacatcagaaaagcttaaggatgttttttctttccagtttattacttataggtttcattcttccccactcttgacatttgcacatagtaggtttttaataaattattattgatgtatttattaaaagtatagaataaagtagaggtgtcccactcctgtcttctaaaatagtaattttgattttcatctacttctttatcttcagaccttgtctattcctacagcacagatatcctgggatttcattccaagtggttcctgacttgagcttagacgtggtcatgacttttaacttggcctctttatcaggcttcttacagggcagaaggaaaatcttttttttctgtttcctcgtctccctcataggactgttgtatagttgaaaaggacctatatctacgtaaaactattttaattcctagagtaacataataacagattcataatgtcagattgaagaagctttggcatcccagcacaccaaatggttttgtacaccctgtttcaagcttatccatggacctgaggggtgaggagtttattactctaagcttttaggttaggttcgtatgatctgtaccagctacattaaccttgacctcagtccaaatgaggtagctgatttaatgtgtcctctccagtcacacaaaagcttcaccattactctccgacctgattagatgctaaatttcatccacacaaaatgatctggaaccagtcgtcttggtgttaggtcacaggaagtgataccaaagaattccaaaataaatacattattccagttttcctttggttcttcctcaaaaagtctgtctcacagcaggctcagagagccagtccctcctcagctagacattctgttgagtcatgtttactgtccccctcagaaaggttccaaaagcaaatgcaagaggttgccgaatgcagggacatgtggcgtgcatgctactgaagtgagaggcatagcacacacctgctttttggctgtggcaggccatcttgactgtgccatgccacaagttagcattttggatgagcaattgccattctgttgttttcttctcaacacatggtgttcaaaaacagttaaaagaaaactgtacccatttgctcatcccagaaatctaaaatttcaaagaagcatgccaaattaattttcacataatattttccaagctttttctttgcactgagaaatggtatttcactttttgaactcttggtgtcctggcctgaggtaaatgggtacagtttctctttaaatggcattaaacatatcaaagcaggattatatctgtcactgtctttttttttttttctaatggaatcaaaatccttcagggagtgtcccaaatccacattaatgtctttgagtgctaatgtttccactgggacttttacattagcaaaatataagtgtgtggttttcccccctctctctgctgtctgtataagaaagagacaactgcacatccgttattctccatggccttcagctaacccatgttaaggtggtaaaagatgactagagatttttggtgctaatgtttccttttctaccttttcactcctttgtgccacttgaccgaaaagctactgtgaatgctgtttccaacatggacaaatctttggaatcccagccatgaatctttgaaatcccagcatttggtctgttaaacagaccaaactgcagtagctgtcaatgctgtttttacctttggttctgattgtggaaaaattagacaaatacccagaactttaggatctcactgtagatatttttgtcattaatattggggtatgagtcatgtgtcctttttattgttggtggacgcacttcctgtctaccttaatccctctttttttgttctttagcaaagcagttcaaatggtattttgtcaactcttgattatcaagtgtcaatgaaagactacaatgtcataaatagaaaataattgtaaataataaataactttaacataatgaatcattagctgtcgtagtacatttaatcttagaatgcacctttttcttgcatttgaacatgctctggaaaattacattatttcttgaataatcgtttttatacgtaatgtagaaggggctagaaagctctgcaatatccgtctctgacccccttccagagtttttcttcttttagcaccatcctgcctactgagggttttagttctggagctgatagagactcttcatccatggagagctgggaggtgccttgctcttgaggctcacccttttcatcgtttcactttctggagcactctggaagactacactacttccttagaccctcttcctatccttcctccttcttcttctgtactttttcctgctttttctgtttttcgttttcttttcctatcccgcgtgaaactagaacgtgaactggggtgtatgtttgtgtggatggaggggcacagggaggaggggactctccaaatgccccagcttagcacgaggagaaactccatgttttcatttaaacaacctttccccacatctaggccttcatatatgagagaaaaattcacttgttttcctttccacactttacagaaaacaaggtaagtagaggcagtgagaatgccaaccctggagtaaaaatgaagcagactatgtgctcacctttaaatatttttaaggataaaaccctatctactggcagttaacagggaattcactgtgccaggtttttgtaggagcagtgcatgatgttccctggcactgaaagagtttatagggtattttttatgtttttagcattaatttttgcatgataactttgcaacatcaggtaaattgtcttctaaaattaaaaaaatacatgagtgatttgaattttctacatcaatattctatggtggatccaaatgttagtttgctcatgctcatatatttaaacatcaaggtggcagaaaatgtgtgtttatattcgaattaattgggcacataacttagcatcatatagtagatatccaataaaaagactgccagtggcattcattgttgtttcatttttgggtttctcccttagcaggcttataggctttgtagatggacaaacttggatccaaatatgagtgccataaattactttctagctttgtatgtctgctcaaaacacaatcttgctgtgcctcagtttctttaccagaagaaatggaaacaatctctgctctgggagatgtttatgagaattaaatgagctaatttgtgtaaagaacctagcatagtactgaaatgtagtaggcactcacatgttatctttctcctttcttctttttaagagaaatgcttgggtaatatgatcacttctttactactagtgatttttctccataaccagattacttaaactaattgtattcattaggttttagctactcaatttttgttcatctcaaaggaaatcattgtgctttgccatatactaaaatataactgtaagggaaatgacttggagattaagtacagtcatcccttgatatccaatcagcagggcactggttccaggacaccccatcccaccccagcccaccacacagataccgaaatcaacaaatgctcaagtccctaatataaaatgggatagtatttgcatataacccatgcacatccttccgtgtactttaaatcatctctaaattacttataatacctaatgcaatgtaaggtctatgtaaatagctgttatactgcactgtttctttgtttgtgttatttttcattgtggtatcattattttttattggaggttttttttttccaaatattttccatttgcggatatagaacccatggatacggagggccagaggtctgactacaaatgtgttagatctgaaagaagcatgacttagcaacgttctctgccttattcttagtttcatccccatcctcaacctcaataccctctcagagactgggcagaaggagagcagcaatgcctagagagctctgtttctgagctaccgagttagggcattgaatttaggatggattctaaagggaaaaaaacatccaaatgcaccgaatagctgaaatccaatctttagatgtggggtaccagaaacattccagattatttccagtgtctaactaaaatataatgcagagtttatgccttctctcaagattcaaaattaatgattatgatttgtattaatccaataggaattagtttgactacttgattatttaagaggttgtattgtagatataaaacaactatactgttaactctttttgaaacagcacaaactatgtctaatcgtacttttttacttttataatacttgcacacagagttcagtaactgtttgttcactgaacaaatgaatctagtccgtggcttcttgaccatggtagtgaaaatgctacaacaccggtcctctttttactacccagcaatatattttatacagacttatctatatctatagatctctccccctgtatctttttttgtatatatatgtataattgtttaaataaaaggccttgaaggacccaattccactggattcctcatagccccaaatctatctgtaaattcattactgctagaattgccaactacagaattaacttctgtgaccattggcaagtcctcagtttcctcatttacaaaatgactaaaagatcactaaggtaaaaaacacttcccactccagaatttgattctttctctctagtgagaagtcatatctttttgagaggtatcctattgtttgaacttagcacaagttttttccttgatgcaagaatcacaaatgaaattatttgtattctactaggggctggggacttgtacttgcttttaaaactgtttcaggacaaccattgagataggtgtcttttcatttctttacttacttagacactgggactcaacatggtgggggcagccagacctccacaggagcctgccaggtttctgtcattccccccacctaccaaaaaaagaaaaagactaaaatctacccagttccccacttctgggccccttcagggcacttcctctttggtgcaaatgaggcctgtccctcccagtctagctccatagatgcctttctggtgtgcttggtattaatgacatagtctgctttcgtcagccttaccatttccggagtgaggtatttcttggtagtttgcatttttttcttttaatacctgcgtatttaatgttgtgtctgatagagtctgattgtccccattgtgaacgtggtttttaagtcattaatatgttgatttggttcgtaaaagtgagagtaaactgccactatggtacagtactttgttggggggtatgggggattctctctattttctcttctttttacaagaagaaaaaggccccaaattgtgccctttggattatcttgttctctttttacatttgaatttcaaaatcccctttaaatgaacaaatctcaaggtttctattacgacagatgcctttgggcatgccccccagtccccgtgactttatggctgtgggcacttcttcctttcagctctttgtgaatattctgtgtccctggccctctctcagagtcacattgacattcaaacaataacctctcccttagttggtgctccttgattgccaaaacgagtgctctgcctctactgctttacctctgttaacaatcattctccacgtttctgaagaaaaagaaagtcttaacatttaatttcttattacacgatacattttgattaacacccaagtattagatgttggtgagtgctgaggggaagacccagacagcagacaccaaatcttatttttggagactatttacagtataaatgtgtagtacttgggggtgggcaagtcttgcacatttgaataaaagaggaacagagttgttgtctcatctgtgtcaggaccttctcctcttcggtctgcattgcagtcctgctttggcttaattaatccattaagctctatcttaaccctagtcagtaatgatcgaggggctcactggagccatctagaatgggagaaattagatggataatgatttttgtgctgatgatgtgttctgtctttttatatagttgatcccgtgagggacatatttctttggtgtattcctgctgatgttctcaagacagatatattacagagaaataaatcagactatgagactttgctagtgtctacttcttggtgtgtaaatttaacgttttaaaatcaaagctgtttttaaaaatatagttttatgaatataatattaaacaatcaagagggtgagagaaatttgggaaactctcattttggtattatttcttgttacactcagatgctgctatggaatatttatgttcatagtcttctgattccttcctcctctgtgagtaaactgtttaagatggttcctcctcaattcaattcaacaagtgtgtgtttagtgatacctatcatgtgcatagcggttgacagatctcaaaaagcatgagacttaaatggctttatatatattaaagtaacaaaatgggacttttttcatttttgttttttataccaatttgaaatcaagacttaaaagttgcaaggcaataaataaactgtattaaataccatattttgctgccatcaaaataatttataaacaactacaatacacaattaaaaatataatttttttctgaaatgtgtggaaaggtgggtggagtggttcttaccttgttttagagggttaacagttggctggtaatcatcttggaaatctctctggcataagtgaggtttaagttatcatctgaatgaaggaaagatgttcttcagtgcatgagggattattccgtagatgcaggcttatgtggaaaaagttcagagatggagagggtgtattctcagcggaaggaagccagaagacaaaagcgacttgctgtgtggattaaggtgggccttagtggcaccggatgctgacaggttagacaagcagacctacagggagggggctttcagtgctgggagtctataattcacaattgatctgaagtagggtagaaagccactggaggactaaagagggaactgtgacagtcaaaccattgagaatatgtttggagtgaggaggcaattttttttttttttttttttttttttttttttttgagatggagtcttgctctgtcacccaggcaggagtgcagtggcgcgatctcggctcactacaagctccgcctccaggttcacgccattctcctgcctcagcctcccaagtagctgggactacaggcgcccgccaccacgcccagctaattttgtttttgtatttttaatagagatggggtttcaccgtgttagccaggatggtctcaatctcctgacctcatgatccgcccacctcggcctcccaaagtgctgggattacaggcgtgagccaccgcacccggctgaggaggcaattttcatatcctaggtacaatgtgattaggagctggccaagaatattagtttaaaaaggtatatttgagttaacatcatcataagaaaatttctaaatttgataagtggctctatatgagaagcaatatattaaaatgtgaacgtttagcagaagattgaggcattggatatattagactgtggttacacagaatttgtatagcagaatgatttaaaaggaaagagagaatgctttttattatttgggttttgaggggctagcagccatctaagtagagatattctgaagagaaagtgttatctaagttaactaacttagttaaccctaactaaaagaggtagattatgagaaaagatggatgagtgcatcagcccttcagatgcatgagtataagaagaaaaaactatggccttaagatagttctttgagggacagcatatttaagagttacaaaaggtaatattgaggaaataaatgaagggagaagattgagccaagattataaattatagaagccaaagacatagaaagaaatcattttgagcgttttagggtaaaaaagcaaaaaagggctagaaggaaccctgcaggatcgtctcagtcagtattcaaattttgtgtattgggaaaaggagacctagaagacagatgtggtcgaagtaagcagagacaacgtgtagaagaaataggacttcaagtgccccttcacctctgctatgctgcctcagtgggggacttgtccagtcatctcttgcaaatgtcatgatttaagcaaagaacagctaaatttgtagagggccaggctgacacaaactggcttttgtaaatccattgccaagagtaagggagaaggcgatattaaaatctctatcactgcttcagctgtaaacagggtggtcagctgaagaattaatggtttttcaaatttcagagcgacaccttgttgcctactaagtatcagaatcacgtgcataagagggcattcagatacacagctacacaattatgtaatggttttcaacttggtccttaatatggagggaaaattctagggatgtctgccaaattaaaataattaaaattgaacctagacttaattgatttaaaaaaagaaagaaagaaagaaactgaagaatccttcactctgtcctaaactgagaggccggtttgctttacaccttgaccagctttcttcagaatgacagtaaaaggacttggtcaatgccatggtacaaaagatgtgccatgccttgcttactagatatttttaaattgcttcttttctttaggaagacctcctaagtttcacctaagtaaagaccgtaaacttgagcccatgcaaactacaactgtaagatcgtgcaggggatggaggttctgtgcaattgtgacacgttaaacggggctcccctgcataatgtgatccctgtctttaggaatagcgctttgctcccatgttaatacattctggaaattgctcaagaggcagctttggcattagaatagcaactttcaaagcagtgaacgtcagcacttctatttctccttctttttggcgtgcattacatgaagctggaaggactaattggctaaatgaagggactcagtgtcgcagagttgaaatcctggcatgtaaatggagaggtggggagagactttgcatgcatatctatatggcctccctttgtgaattatcataatagaaatggttctgccccttctctagtttccctgcgagatgagttggggtgtgaagtgcatggcacagaaattcaccatgctttgtatctatgattacttgtgtctgtgtgcatcttttccactcctaaattgcatgtttacccaaagttgctgaataatacattgtttcaaaagatgtgtccctgaattaaggttgttatgtgacaattataatatgaccgtgtacagctgctaacaactgtaaagaaaaataaaatcagtaagtggcattttcaaaagcaaacaaggaaatcgcttatttgttttataggtgttagatttacttccttgacctctgccaagcattgataaagactggtcaataatgggatcaaacagttcacatgaggttggttccctatgaccgtagtcaacttagcatgtgggatggctcagtcattgaatcatacacatacattttatgaaagagtatttcaagataagctctacagatcatttttaacttttatgagatgccaaagcctagaactcttctggttcacctgtcctgccctctagtagcatgttaactaaattgtcacagataaatagggatcaaatgtatttcataaaacttacactggaacatcagagtatttcatatgaggatttaacatctcctgaagtatgtaataattttataactcaactcaatccctcatacttcataaaccccctttttaaatgtttaatctgagttataggtaaggaacatctattaacacatcatcttactaatgaccattatcaaattatctctttaatattttgggcaaacaaggaaggaaggttctttggcctttgctctgaacccttgctaagctttccccatttccattaagtatggaactttgaattccaaggtataaaacacagggtgaatgtaagtcatccacttctttgttaacttttgttaacttctttgttaacttttataagcattttatttgtaaagcacattttatgcttagttaagtctatgagagctgagcctgacacaccagagtgatgttctgtagtataaactccttacagactaataattgttgatcagtgagaaagtcatttgagctcactaggtaccattgtacaaaattttgtggttaaagagtgttccatggaagcttgacagtgaaagagggagttagtggctcaactgaaagctcagtgaagtttagacattggttaaatcaaatttgagaatgccatatttgatttaaagattaaatattaaaatgttgccctttgattatgggagaaaagggcttgcctggggaagaacatgggtagagctaggcccttactgccaaatgatggaaaataccctttccatgttgccttctacccaggaggggtgaagtagactttgactactttgccaatcattggtcatgctgctgtaaaggtaaaggtgactgacccaaaatatatataacaccatttttttcagtagcttatgatataatttcatctcatccatcaataaataagaacacacaggtgtcattctccccaaatgagaaatggaaaaattgaggctctgtaaggttcagtaccttgcttagtgttacctaaataatcagcggttacatcaaaaccagaactaagtttgatgtctagaagctacagaatgtaattttcaggaccaagtggaacaagttatgttcagtttgattttaatgcatttcagaatctggacaacatcttacaaaatgtctgattatatcctattttttctgtagatttctagaaagggaattacaattgggggtgcagggtaaatctattttctgacagtggtatgcctttgctcttacaatcttatcagctgaattgagggaaaattcatattccatgtcaaattcatgtaaggcgggtaacgtccggttgcagtatattcacaaaatatactttcttgctgtgtgttcataaagtcctacttcacagccacaaggtttgtagatctttgacacaagagaagtggcagcaacaactccaaaggggactgtgtcctttgttgtctaagagtggcttctaggtgagctttgaatcccattgtgagaattccaggagtgtggaacaaaataggaaagctatagactgagcagacgatgtagtggtctaagtaaaatgtagttagtctttcatttctcttcattttaccctctatcatgccgtagtgagacagaagagctgatttaaatagtgaaagaattcttctaaacttcatctacttgtgtgttcaacggggctggagggaggctataaaagaaagtcatggaacagagctatacttgtgcttgtttcatgccttgtagcagattagtctttggggccattccatgggagattgcactaagatacagcccgaaacaaagtgatgttgagtgagagggagagacagggtggtgtcaaccagatgagggacactggaggagagggaatattttccctgaaaggctcaccacccacgcagagttaaaaaaaaaaaaaatctgtagtcttaaaatgactttaatgtcttattttttccttcaccaggaaattaacattcagaaagttatgtttttgaatgtgtcctgatgtatgtctaaatcaggagtacatttttatggctaggttataaacccatcataatagtgaggggttaaaatggaatgccttcaaaagataacctatacctactgcaggcttgaaactcgattagcccagctattaaaaccaggaggacaaactgtttcttccctggattcaaaagctgttaggctacggcatgacccagtacaaaagttttctgaatctctctccactttacaaaacgtcggctcattgctgccgtctgcagtgaagctgtttacagctctgtgctaagtggaaagttcaaatcaattattgtccattagagtttaggtataactgatgaaatatccccagaggagtattgtaaatgtatcaagacgtccttccccattatagaaatggggacgcatagtgaattacttaccttctctcttacccttaatgcctctgaaaggctgctgggcagacagagctcatcttgtcttgctgggctttaaagtgagaactttaccatttggtgaacatgcatagtgagctggcaaaaagtaaatttcaactctctagactatcctgtggacataaaggtctaagaaacaaaagataggaaaagccctaagaattgattaaagccaaaacccacaagttccctggtaatcaagatattttagaaatataagcttcttattaacaatcaaatgagaaaagctttgactccaagtctttagcaaatgatggtatggtttaatgccaaataatttgtgctaggctactttctttcataaaactggttctctagatttgtctgtatctggcttcagcaggacagaaaaggagacccactgacttctcaagtgcaagagagatagttctaattttccagaatctgttattcagttatagagtctaatagtgacttccacctcataaaggccagaactgagaggaagaagagggtcttatttgtaatcttctataacatgagatggaatagaaggcattttacttccttttagagttgtctttacttattccctttccctagttgtgccccagagcaatccctgtgccctagagaccctaaggctgaaatgcacagggacttgtcttgacatgggaaagactggatagtattcttcagagtgctatgatttttcaaaaaccagagaagagtcagacaaaagtcaaggagacatcattctcctgtatcaacctttccttcctgtatgtgcacaggcgggcaagacacctttttattcgttcagctccaatgggtgccctacagggaagcactggaacataattccaacccagactgccagtcgcaatggggataagaagcatctttaaaatgcaacactgatttctttgtgtttctttaacaccaaggataactccaaggatgtttctttctgctgacagctctgtccgtggtgctaagtaggaaattggctgtatttcctccttttggcccatactgcttacccccagctctcctgggcttccccatatctatctatagagatgctaattgctatacagtaaatctagttgagatgaaaacaatgcttccaggatatttatcaagttagattttcttctagatcactcaggtaatgagagttttcatgttgctttgtagctctatctagataagtctgttgctctttttaagtttacaaggagaagtccattgggacctacctttcattactaaaccaatacttttttaccaaattatgtactgtaaaaactgtcactaactcagagagcgatctgggccatgcccacccagttcccctcccctcaagtgtacatctactcacatatcaccagcttcgaacaatttatgatatttaaagatttagccaatttatttcccacattcataataagggccattgccctggtgcactcagcatgcacacggtatgtttctcttctttcggatttcatttattctctttggtatgtcagttgttttggcaacgtagattgtataattgtttcctcttggtgttttaggagaattattttatatgctaagtgtgagactaaaacttagtgattaaagtctaaatcctgtaaaataattaaaattatacaaagaggatggccttcagatttgtcctgtgtcttaatgacaaaatgccaaagaactgtacaggtccctatctttcttcattgggagtacagcatctgggtgctacacttgaaaagcagcctcaatgtgacagcattaaatatatacccacagtaccaaatgtgtgtttagagttattttcctgccctattactatgtgtttagtcagtcctttctcaaatcagcttccctgttctgaaacccattttgcttgccctcttctgactaccagccagcacacccatagactgctaatacgcttgctcagagttaaggagcagtcctggttttcaagtttcttgtagccattatttgtgttccaaattatgttactgtgtctgtattaattttatgtttctgaaagtgaactccgtgtatttcaaggcagcacggtttcttttttgtattttccagggaactggtgtttttaatgtcatgtgaggacaacattacacaatggatctttggcagggatacacagaaatgaataccgtgtgcgaacaaacattaaatggcagtcttaattacagagtttgattctgttgtttttaatgcccttcaattttataatttgatggaaaatgcatcaacacagctattttctttctaccctaaatgattaaagattgatatacccccaaaccagtagcttgttagatctggttaatcaggtaggtcttacatttcatccactagagggcagtagggatacacatccacagcaaccaatatgtgcaacatatggtcgatgtggaaacatagtagccatagctttcctgtgtatgaaaaattcccattacagtgttgcttcacttataattatattgaaagtaaacactaattcacagacggactacgcatattttatttcaacataccccactagtgttttgtctattctactttaaaatgccctgagtaatgaaacttctactacttcccttgggaaactgtatcaaaacccaactgttctcactgcttgatttttttttttttaatatactcaagatctattagtctttcttctagttcatttataactctattgaaatctattccattttttcttatgataaggctagtttcattctggaaagcaaatgtttattgagagcctattgtgtgtaagatatcactaagtgaatgtatggccacaactgacaagggttgcaatacagaatttgaataaatttgcatgactcagaaagctaaagaagaaactctcccaggtcaaatgtcagaagaaaagttggtctcagttctaaaatgagtaatagccataaggctgtcacagcttggggaaatgtttagttgtacttagatttctgtattgaaattcaaagggcatcaggaatgcttggtaacatcagataacacctaaagaattgtgaggtatgcagctaacacatcagtgggttcatgccaagcaaatgacctggaagtttactaatcaaggttgatccttcttcctttcacagctgatggccagattagcctagaagtttcagaatctatactgagaatcattatatgcatttatgaaggataggaaatgggttagtgaatttacccaaggtgggcgtaccttgattatgttgcattgtctattttctatcatcgactttttgggtccaatcttggtcactacacacactacacaatgggaaagcgatccaagttcatgtgcaatactctggtttgcatcattagtttcttggcatatactttgattattaagtatctgaaggggagggtagaagaaatccaagccaagaaagttcctttaaggctagaactcacaattacacacttgtttaaaagtccttttttcctttacattaaagacagagcaagattttttgctctattgagtatattcatctggaaggatttccataaggctgtcctgatcactaagagcaattcccagatagacgtgtatgcaaacaagaactgttcagactccaagagcaaaaattgaacactgcagaaattccagaaatgatactaccttttatattaacgtcctttgagcctctgtaggaagtaaactattctccagagtttttgaaataaagcactttcttttgccaattaagagcgcaagaatgtggtttcatagactgtggtttcattttcttaaggaaaatagtagggacggttacagaatcttcgtggaagtctacacaataccataacccaggtttctatcacaaacaaagcttagatttgaaatttatgtcacctgtaataaagtccacatgagtgttttctgtggaagtaattaagtgcaaatgtgcaacagccatttttgtgtttttgtttgtttcaaaataccagaggtgattaggccatattatgaactaattacttacttaatttatttaagttgaaacgagtttttgagttatacgagggccagaaacaagaactcgttaatccattctgcacatcactgaaaagaacaaaacaaagaagttaacgcctttattttattatgttacaacacactaatattttgaacactgatgaggacccaagtggtcaaaacatctgtatttggtaagaaaataaaacaaactctttttttccaccaccatttggttctttcagtggtgtgctgaaattcagaatgaatcaccaaaggtattaaaatggtgtgtcctttttagtacattttcctatggcatttaaaagattcttcaaacatatttgaaaatagtaaataaatgacctacaaaactcaatattttcttaaatttggaagtaaaccacattcattcctgggcttgggactctatacaccaagtttcaaaccggagcatattttggtattttgatagttgagttataaccccctgaaaagagggactgattatgtgcagtaaggacagctgcccatggagctgcagctgagctgctaaaataaagctagtgtttacctgtcgctgctgaccaagagatgtgagactcagtagatctgttctgtagaccctaagagaagctctgtcagcactctgcgattgagtttcaccgtctgcgtctatacttagccagcttctagaaggggagaaagtgggggatacaatacactcatggaagcaaaaccaaaacaaaacaaaaccctgtatgttgcaagcaaattgaaaatgtcagagaatatttatgatccaaggttacttgttctaatgtttgattctttatcttccaggttctaatccctctatttagttagttgtttttttttttttttttaagtattgctaaggaattgaaattatcatatgtctgaccacaatgatcaggtggttgatattattaagtgtctcaatttttattttcacaagttcttttatgacttgattctcattatctaaagcaaaattctggcatgtgattgccacctaaatccctgggtgtaccatacgtgggcaaattctatgctcaactatagtatttacaaagaggtagtggctcaatctgtaatactggctaagtcatttcccacccctgtaggagatggggtgactgcaatggaagcagacttctgtttttccatgtgaaaagtgaagaggaaaaaaatatctgtaattttcatatcccaactgaatgttgtagggatttgatgagctatttatgcaatcttaaaatcagggaattctctcaggattggttatctcttttgggaagaggctactggcaagaacactttcaggtgattcaaagagtctgaatagtaagattgttcttgtagcacaactactatatggtgataccactgactcaatgtcagtgagacccacgttttaagttatttcgcccaggagttcagatgcattagtatcaagccccgtgctctctcttggccccactccatttaaccctaaattagaatccttgactatgaaatagagtttttctctattccaagacatttattcattgagcaaatatttattaagtactatgtgcaaagtattatatcaggccatctgatttatatgaaaactgaatctctaatgttaaccttattaaacctatgttctaaccgagtaagccagccaaacaagacacaaaatcagaactttagatttgaaaggagtcccacactttacaggtgaaggcatttaggcctagacagtgtagtgattttgtaccacccaacacatcaaatttgtatcaagagccagaagcagagttcaaagctgctggtcatcagtcgaagatgtcttccatccctatatgccccttcatcaagtttttctctgaatctagacagtcatttctgacatttttctcttactctctttcttctttggcactgatagttcctttagttcagttaacaatgacatagctttaccaggttcagcagtgccacatccctatgccttgtttgcagcgagattgtcacattggtgttgagggaatgtaaggaaattctgcttagaggattattttgaccttgtcctaatgatatcaaaccacattgatttttcattagccagtgagagtcactatttggtcactatttgggtggtccctagccaagggaacatttgtgaaagctatgagttgccagtgttacagaaacccattacatctgtggttaaaatcctgggtgggtgcgggggggcggcagagaaaggggagcaaaaatatacaaaaggaaagggaagagaaccccagagaaaggagtatagatgactttacttttacctagacttttaataaaactcacaaatagctcctattcacatgtaaacatatataataattttatataaaatatatagtattttatatactatcatatagcattttatattttatatattttataattatattttatatattttatataaatatatagtattttatgtattcgttgtttcatataaaaataacttttcccattttacaaggatagaaattaagatacaggtattttgtattatatttcaaggccacaaataattttgaaaggtttgttacttttgttatgagggacacagagctcctaagatatgttatcacagcctttaggctagcaacactcttgcattacacaatctcctattactaaacttaaattttcttcaaaatgtggagaaacaaagctcattcagattaaattagagtctgggaaagtaaactccggattcttctctaatgtttcttctcctcatcgtgcttctcccccaacccagctatttcttgtgtttctcatcttccattttgatatcccattcaacattagagtcaccaaagcaaggaggttgttggaattcatcatattcattcacttcttggatattacttctattgtagtacctgagtttagattaggaaaactaagaatgagtctttagattagttgatagagaagagtttctgttaatatacattatagtctgaggtactctataataatccatagcagcatgccttttacctcctcgtgatctgtttgcttcttttgttccctcttaatgagagctggagacatctttaatgtaaagccatagatgagcacatgatttgatgacaagaagctactgcacacacagtttagatatcaaggcaaatgaagagcaagacttcatatcgctttaacaggttaaattagtcatcttaagctgttaatacatcaggctactgggcagaaaacagcagcagtgtggtagcagagcttcagaagtagataatcctaaattcaaatcccaaatctgccatttaccagctgtgtgacctttgttaatttacttttcgtctctgaacttccctgatccttacttctctcatctgtaatatggagatgataatagttgctgcagagaaggagtggcataatacagcttaggtaatgtgacatatgtgactgcaggttcaagaatttgtgcaccttctggccccagcaggcttaatatcagcactatagttagtccctactttcttacaagcatgtgattataagaaaagcccctctggttcaggcttatggtcctttcagttcagcattcattttctgatcacagggacaggaaactgttatataagacacaattgtccttgttgctaacttaaagaattagagttattttcctccagatagcctagtttctctgaataacccactatggacttatccatgaatttagctaaacctttgtgatactatttatgtcatcgacctttaatgaattttataagttgattgcctactgtgtaaagtagttctttagtttgtcataaattgtttcttttgaaaagtagtaagatgacttccagttcacgtatactagaatttgaaaaagaaatccatagtcagtttcccagaccttttgtttctttatagacatttaccatatccttgcctggattttatcattataaatagaaatcttcatcttatgtcatgattattttaattaatactgaacgttctcctattctttttatttatttattttttgaagtacttcatccagaaagtatcccacccatgagttgccgttaccttttactagagctgatcgtaatttaactctccccttcctctatcaaaattacactctatgctctgggctcaaaacagaatgatcttagtgtgactgcaattgtatttaagccaaagttcagcttagaaacagctggcaaaatgttcaacaaactggaccatagaggaagaatcataacaaaaagatgtgattccgtttgtagcaaagggagaaacttgtcttaaggaaaagctagagactgaagtttttgctcattttggatatcctaaagaagaagtagaaggcgatgttttctgagccaatttgttccactaaaagtgaccagaatcaagtctaggttgggctggctgccctaggttgcagttagaggttggggctactgttttgacaatggcagcagaaatctgtgaccaaaaaaagcctaaaactgcttgcctctgtgctagcatcgctagcatgaagtaagatttgaactttaaatgactcattatgagtgggtggcaacctactgtggagttagtctatgaacccaaggtcagcatcccggtgagaaatcccttcaggtttgagtgagcgatacacccagtcacactgagatgggagatccttgtcctcttcagctttgtcagagcattccctgctttgtttccaatcctatttctgaggatatttggcacactgcttggctcacacttggcaccactgtcttcagaaaataaatgtcttacatttgtacagtgctttatagaacactttcacatagattgtctcagttgatcctcacaactctatggtaactgttcatgttcccattttatggatgaggaaaactgattgaattacttgtgcaaatggtgttagtaagttgtagagcagggactggccttatgatactaagtctatgtcctttccatgtcaccgccacaaagatagccaggtcatttctggacatcttcctgaaaatataccttgtttcattttcccctgaatgtactgcattatacttgcttgtactgaagttgccctgacctcttgtggatgacagcaagcctcatgagatcatcctgcagacttcgccttttaataccccgaatactaataacacaatgttctacaacttccatatcatgtggagatgttccgtaagcctagcaccaaccttgcatctggacattcagtctcagaagaggtcatttatcccaaacttttcttctttttgtaaactttccatattaaaatcgtccttccactccttaatttaaatgtgcttcaatattattttaacaaactcagtagcatctgtaccttacatctttctgtacccttccctcccttgtgagggaagaatccctgaatgatcctagtaagttctgaaaagccttagcagggtagataatgggtaaagatcattgtatttcagctccctgatccattacacccctgcctttcaccagcatgcagagcgttgtgtttttttctaacagaataaattaaatatgaaagagaaggactaatgtaattcaaataaacatgttaatgaccctatttttccatttggtaactagaccggatgtggtggaatgccagttttttactgagcctgtaatttaaaactttcaacaaggacactttttttcccttttatttccatcctccattcccacccgcttttattcttacagacactccttactgtccaattagttttggaacatgaaaactgtcctcactgatgcctggagccatgggggacctgggatggtttctctctgtggaatggcttgtaagaatccagttttactggtgatgaccctgccagagctctgtgctgttgaagggtgtggggaaggaggtgactggtgcatcctgcacctcctctgcacccccactttgtgtatttttgatattttgcatgtacatgtttgctgttctaggcagcacttcagcattcagatttgggaatagaagagctctcagtttgcttttaaccctgtaagtagccatccatcccagctacattttttatgagtcaaagccatgttttaagagcttgttatcatccaaactaaaaccctcactaactcgatgtgtccctggatgactccctagtttatttcttcccttccctccactaagtcagttgtctccctatgcaccccaggagtagccattttccacagcggccaccacctctcctccagaaaatgggcggctcaaaatggagcccttcctctcctccggacctcaaatctgccacctgtctgctccattcatcattagttagctatagagcctgatttttctccaaactgtatgtatttaatccctgatttcttcctcacccccacgatgtgacatcctttcagcattttacctgctggaaccagcgctctcttgtttcttttactgtggtcacttgctagagtttgaaggaaaactttttgatgtgaacacatttcagtttttttccaatttacactggagagaggaatgaaggggagagggggctctggccctgttacttcctgtttgtttttgttctggagaatgcagaccatctgtgtctctcagaagctattcttctacagccaccgtgctgaggctgatatttaatttcttagtttttccctcgtttctctctaatgtccttttcctcttccaaaaactcctaagcccctcattaaatctttcttcctgaattttcttatcttaatagtacctctggatacggttctgtccccattaaggccagaatttcaaattaagtaaatgataattggagagagaaaacaggagagaagggaacaaggaatcagtaagcaaacagaaaaaaaaaaagtgggttgactttttaaacatggagttcgctgattctcagagccacttcccatgtcctggcatccattgttcagctgatgtctcacctgttagatggaccttgtctttctcagaagaaacatctgctggatgttgggtctctctctgagttgcctgagaaggtccctccctaatttatttttcctgccacccagacttcgataaaggctatactttctcatgataatcaagatggttattttctagaactagtagagatattctccctcttctgagagctgcctgatgaatcccaacatatagtcaccctatataaaagtcctattttctttctgtttcttttacatgcaatttcactaaacaaagtctctaaacaactaggtcctctttcagtagataattctataacttatgaaatttcaagtgtttcataagaagcatctttctgaggcacatcttcatttcagatgtcattgcagtttaggacacaatatttccctcatttgtgttttttaaaaaacatagctttgatttttttttattcttaaggtcagaattaaaaagctaaatgaattccaggcttcaaactcccagaattatagctggttcaagcctaaaatgtgctatatcaactgtctacgggggaagtgccgagtagttgtggccttcgtggagtgttttttggagctctcgcctgtcccccacccccttccttcagctgcttctgtttgttcctgctgtagtgccttcagccatgaacataccgtttaatcagtggtgtattaaaatggacctgtacagtcagcaatagctaggccaaaatcgattggctatttttaaaaggaaaaaaggaagatagaaaattgctcttttaatctaggtaaatcaaatcgtgcctgcttgctttccacctgtagctaagtgtaggcaagagcattctgattgatgacagtgtttctttgtgcttctttattcatgcttatccacttggggtaaaagcaccagggtatcttcagaacggagttttcacattcacgtcagaaagcttgtgctctttttctctcagaaaaaaaaaaaaaaaaaaaaaaaaaaaagtcttccctttttccccctcttagaagatttgaataaaagcagagtacgttcaaccttttctgcctttttggttttttcctgccatgaaatcatatctgactgtgacatcacagtgtgttgctttgggcagctttgtgatgtatgaaggcgaggaccttaattgggttaacagagcacaccaggagcggacggcggacgagcgctgctctcccactaggcagttctttgctccaggcagtgtgagagaatcagagaccagctagagaggagctccttctcccggggatttttaactctgaggctttgtcttcttttagtgtattactaaccaatgaaagtaatttttaaaagaaaaagtatataaatgtgctttgtttttaaactgcaaaaaattgggggtgggggtggaatgtgctggcaggtttgttctgtagcattgatttgtgaccaacaaaggaaatgtctacttgtgagacacaaatcaatgcaaccagactgcgaaagtgcaaacagagatgtgagaaaattattcaatcgttagtcttctatggaatttaaaaacattgaatctttcgattgttccaatacaaaaaaaaaaatcactagaagaaaggaagggagggtatgaggacttgttctaatttcgtcaaaggttttctctcgtgattatggaaaggtccggcaaagctataagattcctaaacattagcaatgttgtgaatgattttcagaactcatcaaccatgtcctcagatgctgtcaacagcaaagttgtggaaaactggtagaagacaagtttatgcctgaacttctgctttagtctgcagtaaccttggctgctgtaaactgaagtttcttgcaaattctctgtatccagaaataatccataacaagcaaactcagtacttacatagtattttttatcatataagcatgctacaaaaattaacaaatagattacatgggtaaaaacgtaactctagaaagctaaagaagtttattttgtaaaatttcatcagttcaaataaactgggagacagacgactagaatgagctgaaaacgtgatcatggaatatttccatgtactttgaactgagatttctaagttttaacagatagagtttcttcagcactaacttcaaaataaataagaattttcagtaacttatcagatgtgtgtatgttaaagtagttaaagatgtttcccccccctcatataggttacatttggtttcccccatccttcctcccaacagttttaaggttattagtttgcttagaaatcctattttcagaggtaataaaaaggcaaatttcgatacaatccctatcctatcacagattgcgaattattctgacttctccttttggagaagaggaaaaaagatgatcagatgttacttctctgaacactgaaaattaatgtaaataacttcacagtttttaatgttttcccagtgtctagtcaggccagagttcccattagcagtccagggaagttttctaacttgactgtatatttttgcctccatcactatgatgaagtcagttaccaagactctctcaccttatcctaaaaatgtgctatttctttacttcccaattgtcattatgttagttacattgctggaggaaatcaagggagtgaaatataatggatcagagacctatcaagtaaagtaatcaagaatggatttctggacaaccctgtttaaaataagaagccttgcaataaaagtgcataaatgtttcactctgtgttacacaataatacctcaaaatccactttctggtagttcagatctctgagttacaaccctgagcaaagaagtaactgaagaccttcaagtgtccaaatgagtttcccccaaatcttctaccaaaccctgcattcaagcagtattgtctctacagttcttatttatttgattttctaatccaaagcacattagaaaatacatttagcagagaggatttagaggcgatgggtctgaaaaactgggacagtgacgccagttggctatggcagtggctagtgggctatagctcagtctgtggccgttaggctgagccaagggatgaggccagttctcaccacaagtaagaaaagtgtattcctgtaaaacaggaacaatgaatagtcacaaggatgaccctgtatcatagaaaaaaattaaattacatcaacatactgtgtttaagaaaacaaagatatgtaaaagttttctatgaaaaacatgtgtagaatatattttactgcttaaaaaggcaagtttatgtcattaaaaaacattttaaaatatatggaacattttattcctcaatatagcttgcttttttatatcctttttcagtttgaaaaaatatagggattgttttgtagtagtgactctacaaacctgtctagccaaaactactcagtacaaacaccttagaaggagtacaaacaccttagaaggaaggatgtttattcttgaatattttaagtccaggtctcttaaaataaagatgttctttttcattgatcttagttatataatgtatgttgtcatctcgagtaaggcgcagttgctcatatttagctggtttactttgtaatgcgtcattataagtgaccaaaaacatggtacaggaagttgtttgtgtgttttttcattgcttatgcaacttccaagcagaaaatgttcttgagaccagatggtaaagaacagtcaattgcaagttctattctccagatgtattgatgtttcatgtcttcctgaagccagttcaaacacacttgtaaattcaagtcttaattttagtaactctttcacttctgctagatcctatttcaaatgataaagaattaggctagaatatttaataacaggatctctgaagcctgctgtactatagagtggcaatgccatggtcatataattcagtcggataaaagttcattacatgtgcttttggacgtatttggtcactgtgctacaatgacagctaagtgtttacagtaccaaacgtcttttcaactttatcctttccaaaagtgcactttgttaagacaattttaaaaaataacatttacccagtgtttctacttggcatgtagggtttttttttttaatctgctcagcaatttggaagtttgcttggaacacagatgagttaagataaaaagctgttttttaaaaaaaaatgcctctagtaagtaaaaatgaagatactatatctgaatgaatgtgaaaagttgtccctttgtatatttttaaagcttcctaaactatccccagttctcagccaaatgcagcctacccagattgtctttaggaaagtagcaattcacagagatttgcagttagccatgtatcaaactacactctctttagtccctgcttacagctccaccattttagaatatggtgagatatgccagagccctaccatctgtttaatgggctaattatgtttaccacatgcctacttcacaggaataccatgagtgaggttgccaaacatcatacaaatatatatgtttgtatatattgatatataaatatacacataaataaaattgtatacatatataaaagcattcagcatttctgagtttcattccatcttttactctcaagatatatcatggcccatcccttaaacccagccaggtgttgtcagagtttgtgaagctgttgatgataagaccgtcagactgagagggatcctctaactgagagatttggaggaagtgaaactcaaattgtatacacattcctatgtcttcgccatttagctatgccccatgttctctctactaaaatgtagacattttagcttcataattaatgcaattaaactttatgacactgtatgttgctatatccaatgactaaacttcttttaagaaacagaggatctcttctcctttattggaaaaaaaaagtcagactgttttaacacaattcctcccgtacatggctacaacttttctcttacataccacagcttctatattgggcttgttcttaaagctaggattttttttttcctcctatgaggacactgcaacccttgaaagtttttctctggtattctctgagtgcttcctagatacctggtttcagtgactccagttatcacaaggactaattttcacttgctatccatgaaaattttcgctgggtcaaactaagttgggtcaaactaagctgcttcttggaaatggggcttatgctagtcgtgagttgtgtccagagggaattctgagcagtaaaaggaggcaaactgagggcattctaggtgaagggaattaaaccagcagagaatcagggcacagatggaaaagagcgagtcatgggtaaccagagtgcctagtcaggatatgatataagctccgggtattgggttttctgtgtagctcctttgtttatgtaaagctagctcggcaggctctgggccttcttggctttgaggatgcactgacctgagagctatggggaaaaatagccacgtctgtacaccagactataaagccaatatgtaccattctctttgaaaatgaaagacaataacatatgaaactattattgatataagcttttatttagtcttttctaagataccagggtatttttatgacctgttttcttcccctcggcgttaggatgttttcttatactgcttcaactgaagtaaattattcaaacagagctgttttgttttatttgtttgtttttgtttttgcagctttatgcttaccagggacttcataaacaagttgaaagagaaaaaatagccaagacataaatatagaaataacccaatcacataagctttcatgagcatgggtgagggccttgtgggaaggatgaggaaaaatctttattagtaccagaatgatcgtgattaccttaggcataagtctgatttgagaagagacactgatatacaaagaaaggaaggattattcccctatgatttgtccatgtgtacaaggaaaaatagcttcagtatttactatttgacttcttgagtccagaaacctaatactcactgcaaactgcataggcacggagcaggagaaagcaagtatttaccaaaacaagaggaaagaggaattactctttcatctcttcttactttagaatcatcaaatgttattactggaaagaatcttaaaaaccatctaatctaacactcccacattatatatgagaaaaatgagactcgagagaagtttcatgacttgcccaaggtcacacaacagattacaaacgtggctggggacccacatatgataaataggtgcccttcatttcttcagtttctccataatcattttagagaattatttgacttatcccaccaatgttgttttgtatatctggattatcatctggcttctcagttaatttttttgaagtgaagtttgctttataataactgccagattctatagctgattctaaaaattaaaatgtgttctcagacatatcctgagtgttgtacaaatatggagacgctcactagatcaacatgtatgcctccttattttatatgaatcctataatacctataaacgtggcctgatcatattagactcttgaagtttctagagttccagatatttgttggagcatataaataggtgagagcagatttacgcatttacccactctgagtccctgagacgttcctgaactgctgtgcctttgtaagtcagttattcccactgctatcgatatcaccagttccaattattaccaatatggcccattactacagactgatttcttactaggttcaaaaccagctgtacttggtgttttactgatattttgttcagtgttagaggagaaagaacatggtgagagtctggcatagcccagctcccttctgtgaagaaagagtccatcactgacaatagacattcaataagtggttatttaaagaggtcgaaaaaagcatccaccatttctctatttcaaaataatcaatcatttaaaaatattaactacaagcttctgatgcaatgttgtgtggtttgttgtgccacatatggttatgatgatctacacgtcagctacaatccagaaatactctcattgttacaatgcaaaataatataatcatccacttttacattttaaatgtgtctggcccaccaagtccttgcttaggtgccagacacaccactgtgaaggaactgtctgacatagtatcctgaaatttcgggtaagtataatcatctcccagatgcatagaataagcctggtttttgaggcaaagagaagaggcaaacctcctgcccttccagaagtcagaaccattcagcaatatattcacagtagctaggggggaaagcctttgtgaagaaaactgttgtgtctcatggctgtttttattaaaacatttagtccaccagctttccaactctacgaacaatttaattcacaaagcacatgaaataagcagaagaatctagtcccaacagccatgttccacctctgtgatcctcgtcgtgagttaggatgatttagtcgtcaagatccctgctgttctgtgcttggatatttgtgaggaaaacctagaattcatcccctttagaagccatgtccatatggcatgcagcaaagaccattagagaacagtagtaggagttttgttatcaaatccagccagatttgcagataggaatactgagaaattagtatttttccttcctcttcttctctcttttcctttttagcctttttctttctcctgtttgcttcttcaattcaatactcctttgtttatggatttggagagtactccaaaagcaaataagccaatcaaatcctgtttggagggagaacagccattttgacatataaccatctcatcactcctttttatatgcctaaacaattgaagagcatgtagcatagccaggtgctggtcctcaaagtgggtgtgccctaaaacattctttggtttgaactagtctagtccactgtttcatgttactgaacaatcaaaagagaaaagaaagtttttcttctctggttctagaccaaatgactggcaggatgtgattgccatctgtaattttctgcgaagtccttccccagtccaatttacatgatatgtacagctacttcactctgagaatgcacactcaaaaaatacagcctttaagtgatttttcctagcatgggcaaggtgaagcagtgaggaaatggacgtatatatgttatacatttatattattattccccataaacttttaaacttcctatccagcatttgtatttgttctcaaacaaattggtagtttaaagaaaatcctacctttgtgatttttcaaaaatcatttttcagcctctcctattatttttttttatttcagtagccaccttaatgggtagctgagtggggatcaagtataaaaagacctcatcatgtattacaagccagagagtgtactcatgggaaaaatgtaagtcctcagatggaaagtcatctccgtcaaagaaagtggctcgggcaaaagtgcctgacattacatagtctgcatggtggaacactgcagccatgttttcagttgcctttcactctctggaattttatgaaatgatctcggccaagaacctttggaatatcactctctggtcaaacaaaaaagaggacaaaaaaaatcctttgaaagttgaagctagttggtacaagctagcagacaatccagtgaaattttcaccccactctgttttgggggtttggggtttttatgcagtataagagtgttagagaaggtgtctgtctggtatggattgggatactttcaaatactttaaagaagaattcttgttttctacagtttattaaactagctcagctaagtatattggttatcagatcccatgatgcatgattattcaatatattttaaaacacaaaaaaattcaattgtgctgtcccctttctccttctgtctcctccctgtctgtctcactgtgctgtgaagcattgggagtagtgtgtgtgtgtgtgtgtgtgtgtgtgtgtgtgtgtctgggaggtagacagattccctacctggaaatggcttgctattattagacgttcagttaccaggggttatgtaagacaattgaagctctgttttttaacagagacatgattcatgctgcttgtagtaacagtaaccacctccaaacgagacagaaaccagacacagacaaaggctggagaaatcaatgccgactcggtacagccattctcctgataccctctgcctttcaatcagagcacttaggttatcaggagaggaggctcctgctaattctggatcctttttgtctcttggggctgccaggtgaaatcatgtgggctggagctgtgtacaggagaaaacgggtcctcaggagcagtgacgtctgacctccttccctagggtcccccagtgtttcagacacacctggaggaacagtgattgtcacctgtgttgtggctcaggattcactgtggcttctactcagaaaggttggaacttgagcatttggctcacccactcaagtaactttcctcaagtgattctctgcagcgtgctgggagaggagaggatggagtgggatttgagctgctgccagtgctttattatagcttctcctaaaacctgaatggaagtggactggctgtcagttcccacacacattcgggaccctttcctaaatcttccagacaacattgattcagtactccacactatacaaagcacttccacatggatcagcttattttagcctcacaactttataagataggcaaagcatacattattgtcaataccattttacaagagagagattttacagcttacaagtattatgccattcattgattccttgctcatgactttataagtgagaacaataagactcacaaaagttagtgacttggccatggtcacacggctggttcttaccagatccaggaagacaaggcagatcttctgattctccatctagtgctctgccccagatttgctacaaagcttgttgacaaccatggcattttttggggaaaaaaagcattttctgctgaaaatcttggttttagattaagttctactactcattagctagcccgcttaaactgccctttccttcctcttcaccccatccacctcaatctcctcatctatgcaactcatgatagggagaactcatttttagagtgttcatgaaagtaccacataatctttaacatgtctaggtcaatatatataaagcattgccaatagtatctccctgcccccaccaagagtgaaatccagcaaagagatccagagatctcaggcttcacccagaacataaaagtaaactatttatttttactacaaaaagaagaaactcagatactttattgcagaaactgcccatggctctcagaaaatagcagtcttgccccggtggcctgttacacacccaataggcaggccacccttcattttcactctcacatgtgtaaattgcccagaaagacaattcttaagtattgacatgacaggaaaacatctaggccatttagcttcacccacccaataatctcctgcaataaaaattccaatttaaaaaatacttattattgattactactaataaccaacactctgatacactgttacgaattttaactgaagacggacacagaattttatatttatgaaattttaccattatccttctatttcacatgttaaataatacaagctatacctattttaaggtaaacacaagtaaacattcttatttataaaatagctttttattaaattttttgtttgtataccgctttatatccaggaaggtagcaaaatactccacaggttatactctaataaaatgcactttctcttctgctaaaatatgaaattgctgcagttttaagaaagaaagctatacttttctctctcacataataaaactccctgactaagcatcaagagaccaaacttctagtcgtaggcccactaaaaattcactgttagggaacctgctgagtcccaacttcagataacatctaatctgaaaaactcagggccccttaacatctagttattacacactagcccgagacaacctgccctgcgctgttgtatgttgtgtcaataaaagagctttatgggaaagatggaattcattatttggggttttatgttgtgccagtcgttgccaagctgccttgaattcaccaatgtattgtgtctccagactgattcaaagagatagaatttggaatgtgactagaaggcagtagcagattctgtaaatagttgctacacattctgtataccaggcacaatagcacacagtggaacctcagacaatacttaccctgacttccttaagtaggaaaatatcctttttcttttcatcaagttaccatgatttaatgattatgaatggtaattttaccattggtatattccagtgattcctttcatggatcacttgatgttcctagattattttaatcttatcgccatttggtgttaactaatgcaaattcttactttcacctaagaacggagctgcctttgctcttctgtatctagcctttatccacatccttagacacacatggtatcattttcagggcaatggcagtgatggcgggtagtgtttcttcccaatattgtgatggaacatttcacctgggctgttagcatcttaaactattccaatagctacagaaattgggttttaaaccatcatgtcttaatgccatccatttctgtttatattaaccgatgacatggttataacatcctactgtgctcaaaaagctggggtctctgtagtgtataaaacaaggttcctacccaagaggatgtacaccctcgctaataatatagcaaacaggcagtaaaccataaccatttattgaagtacttaaaaagtggcagaaaacattatgggctaaagcagtcttcacaagggaaaatttcataaaggatacatttttatatatggaccctgaaggagaaaaaagtcctatataattttttgaaaggtgataaaggtattccaagcagccaaactggtatatacagtagctcagagatagaaatgtgcttagtctttctgacaccctataagttaaccagtttagaccatgtggagtattaatggaaaggaaatctgagaggactcatttgatagggagtcagtgaatttccgagcccaggcttaagagtttggaaccaggggaatcccttaaagcatcttttcccgaagcatattctgaggttaaataagtgttccattaaaaagggggatgggggagtctgtaatccggtaagcctggacaaagattaggcttccagcaccttaatatcctgtgtacacttgcgagtttgaaaatagaatatatagttttcagtgtttcctaaacttacttgactgaggaactttttttgagatgcatcttgaagttccagtatgaaacacactttaagatacaccatctgaaaagatttttgaagggcaggagttgaatgcgggacaaaaaaaaaaaaggtatgtggtgatgattaatctagtactattagaaattgatatgctatcagctacagagaaagtatccctgatgaaaccaaaggaagataaagagaagtagagagaataaccttcaagatacgaagggaacatgggaaaagatatatcctgaggaaataaaataatgaaaattcagagatattagaggagatgagagctaataagcttaccacactgcatggtgtagatccttttattaaactaggatgctagctcatcaactgaaaaagagaatgggacttcataaaggagaacaaactaagaaaaactgccataggttgtacctggaaacagtgggcaggagcataggtccaggtagcatgcatgtgtagccttttgttctgagagtgggagcaaatggagaatggtgatacagattcacagttgatgaatgtaaaaggaggcactgcacatagaaagttagaaaaggaaggaaatctgcatggttactgaggacagtgttgaaatggttgatcatggggcaagatcaaactggacaaatacatctggtaaggccaactggggcctactaatgaaccagctgaaaacaataggttccttgggcttctgggaaagtgagttcaatagctgggtgtggaacatctgatgtcaaatgtgaggcctcaaaagagtaatttagaaggagtatgagagctaagaaaaggggtgataaagtctgttgaaaagaagtgttaatgagtttttggattaaattattaatacagggagggaaaacataaatcaagtgtagaaggttttgagaaatttcaagaaatattcaagaagacatgagagagccatgaagaagaatctagcctaagccaatggtggggatcacaaatgaagaggagtggaatgaaggcagatcagtggtttggtgattgtgagcctggtataggttaagctctagaacatgtggttagaacctggcccttaactctgctttgctaccctctgccttcatgactgatgaccaataactgtacctttcctgagtatcagtttcacctccttcgtctataaaatgggaatataattcccaacttcaaagagtaattgtaagaaaataaagttatctgtgaaaaggctcaatgcctgccacacggtaagcatttagtcagtaatagccaaagttactattgaagtgatgggagcaggaagagggaaatgatgttcactttgggaacagtgacagagtgtgttatctggagtaatgccactgtgatgtttctctgtacctttttttccatttaccacaaactataatggttaattcagaacacatactcactgtaagaggtaaggtataggaaactctgataataccaaataaaatgctgtgtcataaatcatgctcatgttagaattctcattacaaagtttaaaacgatcttattaacatgacctgtggcaggctttctggataagaaggttccagtatccggtgacataatagaggggttcccatcaccaggccagattcattaataccagaaattcatgattgtgtgtgtgggtgtgtgggtgtgtgtgtttacatgtactctgatccaaaagatctcttattttaaacaagaatcaactgtatctgataatgctaacgctcatggcatgggatgtgcaacttatattaacagagtttatgaactgtcaaagaggaatcaagaggtctctatggagaaaattaacatagatttaatgtgacaaacagtgggattgtgattccaccttgtgttggcagggccatcccaggggtcttcaagccatcagaggtgtttcttatggacatgggtattaactagtggttaattaaggaactaaaacctaaaaagtaaaatagttatcacagcatcagtaagctgacgatggtgttcctgattagtttatctggccgtgatgtctttggtgccttattcattaaatggttttctcaccactttccagagaggtggggctggtgacgtagacttgggaatttgtttcgggtaattagctaaaaagttaaaagtcaaatagacttccttaacatgtttaatggtttaacaggttgatgagctacttaattcccacatcttccttctcaggggactattagagttttaagggaccttaaaaatcataaaaccaacctcctctttttgcagatagaaaagctgagccacctagaggttaaatgtctcatcggaggtcatcagctagtcctgattttgctttctcttttcttatcttacactttctaactcttttttttctaacattgtattccccacaatgacctctctgctaaatatttcttagatgtatcctttttatgaaatttgctgtgcctcaaattatgatagtgggcctttgccaattagtaacccgtccccactaactcaccactacatttggggcaaagaaacgagggaagtggaacaattttaaatttactatgatctttgagacagctttatcttcacctgggaattgctgttagacaattaaggttagtaaagctcattgaatttctcagagggaaggtgttatttgaattattaccagataattattgttaaaaataacaataatgtaaaaaaataggaactttacatgttagagacattatcattttgaatttccagagagaggggaaaacccttggggatctaaaaacaattttttgacagtgtgctctatgctaagaactccttgaattctgtgtaatgcctgatgacctgacaaactggcctagaatcagaagccagtcggctggctgtgtgaactgttagccaagttatttggcttgaactgctccttcaaaaacaaccctagtagaaaggagagtgtcagaaataagacctgtggtcccagaccagtagcatcagcatcacctgggagcttctcagaaatgcaggatcacaagctccaccccagacatgctgaatcagaagccctgggtgattcgtttgttcattagagtttgagaagactgttagaggacattctcatctgcaattagaaaggaggagggaagggactatacttattggcagtttctgaaatagttccttctcctggagtctgtgctcccagatctttccagtggctctgaaccatcgtggaaataagcatcttccttgtactgtgatcacagcgggaactagaaatgtgtcccgtgtccatgctgcattggaacagttgttatatagtgaaaagagtacagatttagactcagagagatctgggtttggattctggcctcactatccagtagctttctaaacttcgacctgttacgtaagcccattaagtctcacttttccttatctgtaaaatgggtatactaaaacatacaccatagcattgctatgagggttaaacaagaacatactcatttataaaaatgcctggtgcagtccctgataaaatttagacatccaataaatgctagctgttattgttactattacctttcttgtaaactttaatcatgaaccccccatctataattttagaacgatgtggtgtgatttcctaggactgggacaggccatactcaaagtagacatctgcagaaagttccttacattgatatgtggcagtgtatttcataacagctctgctctctaagggcttccaagacagatctgcagaaacgccaacaatgaaacgggctgtagagaagtgacctactgtctgttcgcctctgacaccatcaagaaacttgccagctgggttccaagagcagattctttattacagtgatgatgtaagaagcagagacaacagctggattttcaggttctagggagaatttgtggcatcagcagcccctcaaaattatcttttgacttaaaaaccgagtacactggatatgaaagtcattaaaagagaataaatgtgaaaccccatgaagtcattctcaccgaatcttttttagagtgtaaccaccctttaagcaataaaacatgacacaccatgcagtggttctgattaatagacgctcaggtgtgtactaaggcaaaaggggaaagaagatggagctaggtgacactttgccaaaaatgaaagtaagattatagcagcaggatgtgggactgagaaagaaggatttaattaaaggacagacatactatggttgtattaattataaaatgcacaatgtaaatcagattttagatatatttaaaatgtacatttatataattacacaaaggatttgtaaatttgccagataatttttcactgcaatgtactattgatgagtgatttcctttatgattttaatgtagttgccagggggcaaaaggagaagtaagttctatctggtgaagtgtcaataatctgtccagccttatgatgggttagaaagaacaatgaagagctcttgagcccattttgctgtttgtgtggctgctggggtgatgctatttaatggatgtctcaatgcgtagcatggctccaccatactggccaaaaagagtttgattaatgctacctaccaaggttttcctctggtgagtaacagtgagtcaagcgctcacctgggagatgcagatgaggtcttgtagtattggagctaacatttaagagctgagcttttctggccaagtaataattactgagattccctggaaaagtctgttttcctcacctaggtaaacactattatccccacagcatgttttgttgggcttttcatctttgggtgagagaaaatgattctgtttgaggataaggatagagaagagaaacaactaatgtttcctctactacaagagaagaacaaggcaagaaaatttgaacagactcagaggcaattgtctatgcatttctacaagtaaattagtaatataaggaaagaaaaacaagtaaacatttaaacaaacctagagaatgagtactaggctaagctaggtggaaaaagaagtgttaatgtggcataatagcagattgccaatagtttgtttctacaaagtaatgaatttaaccacggaattactgcatgttttcaccaagaactccagctgaacacacagcttttccaaagcatgagaaatttctttattcttattttcagcctgagtttatcaccccagtggtatttttaacattttatttgtttttaatttttgtgggtacatagtaggtgtatatatttctggggtacatgagatgttttgatataggcatgccgtgtgaaataatcccatcatggagaacggggcatatatcctcttaagcatttatcttttgtgttacaaacaatccaattaccctcttttagttattttaaaatgtacgattaagttattattgactatagtcactctgttgtgctatcaaatagtaggtcgtattcattctttctattttttgtacccattaaccatccgcacctcctccccagtggtgttgacagtattgtcataattatttctgctggtaatgttagaaaactttgcttccttgttttttaaatccaccctcattttttagacaacatttaactataaaacatatttattagttcggtttgttgaagcaaataaatgaagcaaatttgttatattttggaacacaatatatttttgcaggttacacaccccaacctccctctctctggtcttgtcattactgatgatctgttgggcctattggtgccaagtaagcactgataaatattagtctgtggccttttatgtctgttatccttgcccagccactaacaaggatgcgaccttgagcaagtcagttcccttcatctcttcgtctgaaaaatgagggggttgaagcagatgagcttttaggtcttttcaatttagtccccgtttctatgactcaaggcaagagggtttattctttttaaattcagttcagcagattatcagcctagtgcaaacttaacgtgcaagaagtcatggcccactatagggtactcagagtaaaaattgtctcagctttcaaagggcttatgaagaaggaagacaaattacacaaataaccattctaattggtagaatatgcaaagggagtagtacagaatgtgctaataatatttaagaagggcactctcctttgtgaaatgcttcataaatgaggtggcatttggatggcccttgaagaagctacatgtagacattgaaagaaaggaagaaataccatgaacatggtaggaaagagtaggactttgctggagcgtagaatggagtgtagagataagagtgagaaactagattgggctacattgtagcagctttgaataccaaactgagaagtttgaatttaatccaataagcaaggaggactgtaagcaaagaagtgatatgtttagaagggcactttagaaaaattaatgtaatgtttgtgtgaaggatggacaagaggtaaagaaaaactggaaaagtgaaaccagtcaggagcttttcatagatgtcctcacagtaggtagcaaagggagaaataggggctggtatagaaaacaggtattgattcaggaatcacaatcagagtagaatctacaggattgggtagctaattggatataggaagaaaaaaaaaacggaagaattgaagatgactccccagctgtaggcccacgtaactggatgaagagaataccaatggcaggaaatgggacgtctagagaaggaacagattttaaaggaaagacaatgaattaagttctaaactttctgaattagaaaagcctgtgtagtatttgatggcgatgtgaacttctcaaagttagagaccctgttgtattcatccaggtgcctcatagatgctatataaacactgaatgaatggacaaaggaacgaatgaaccaataaccagctgttatttagaatgtgggtgtgcagctctgtagaaaagctagaactaaagatagcaatgtggatgctctccatggagaagtgattgttgaggtcagggaggactggggtagacaaagcctgaggagaggatctagaggaatgtctacatttagagaacagaagaaagaaaataagccagtgaagaaggcagaatagcagactgaggtataggggaaaaaatagggtaattcggtgtcctcagggttagagcctatggaagaaaatggagcctttgcagtgaaggacagagggaatgctcagaacatgcccagatcaatgggtgtcactagaatacattaagaactaagcaataaagagagagactgaaatgaaatcaagaatatcagaaatgtggtaaaagtacacaatggaacactattcagccttcaaaaagaaggaaatcttgtcatttgcaagaacatggatgaatctagaggtcatccatgatatatggggaaaaaataggcttttttttgtactagaaaagccaggcacagaaaaacaaataccacgtgacctcacttatatggggaatctataaaagcttaatttatagaagcaaaaattagaatggtggctgccagacgctgaggagacatcagtcaaaggacacaaaatttcggttagacaggaggaataactccagagatgtactgtacatcctcatgactatcgttaataagaatgtagtatatattgaaaattactgagagtaggttttacgtgttctcaccatgaaaaagtgataaatacatgaggtaattcttttttttttttttttttttttgagatggactcttgctctgttgccaggctggagtgcagtggtgcaatctcggctcactgcaacctccgcctcccgggttcaagcgattcccctgcctcagcctcctgagtagctgggactacaggcgtgcgccatcacgcctggctaatttttttgcattttagtagagacggggtttcactgtgttggctgggatggtctcgatctcctgacctcgtgatcctcacacctcggcctcccaaagtgctgggattacaggtgtgagccagcacacccagccggtaatgcatattttaattagtttgatttagccattccacaatgtatacatgtatcaaaacatgttttataccataaatatatacaatttttatgtgtgaataaaaaataaataaatataataaatgaaaaaaaaaagaaaaggatactagaagaatcaactgtgggaaggttgaaggacactgtttctacttccttcccccactgtcacccacaactcagcttctaagtcagaaccacaaaatcagctccgcccgcactgacagggtactgttgatgtcccaggctgcacaggcagttaggtgaaagcactgaaaatggagcctggacaacatcctctccattctcccttccgtacctcgccattctctggtgcaaagatgtagaaccaaacaaccaacctctcactcaagtcccaaagttctttcctatcaaaataaataattgccatcaccatcacctgttcatttaacaaccttatttttgttttttgtctgatctagatgcagccgctctctgctccctgccccaatgaacatctgcactaggcccaagccttggagtaatttacctgaagagtgacaccattgattttgaaactactgtgagtacattatgtctccaataaaaggcttcttagttcactttgtttaatacacacacacacacacagaaaattgtgaaagcaggcaaaattttagatggcttcatttcttggatcagcagggtaaccagactcagtcctgaggtgcccacagcggttctcaacttcccggctgcagtgcacaccatgtgcattatcattccctcctggccagatggctgtgctgagctgtatctgagcacaccttgcagggactggtgctgttctgcttggtcatctgtgcctctatgtacggtggtggcagcttctcctaatctgtttgcttctcatcatccttccgtgccactgttgaatctcatggtagcttgtcatttcttgccaccctggtcaaatctgtgaccagcagctttgcttggttttatttacctgttgtctgagctgcaacccatgctgttgtctccttgctgcccttcccttggagctctggcctccttccaccacatctctaagccacttgtatccagctcacctctgctctctggatgtatgggtctgtgtagttgatttagttcccgccatgcaaggcatttatgtaggagaagtagagaccttgcaaggaaaagtacagaaataatttggggtaggggatatgatacctatgggaaaatactgatgaaagtttgatatcaagtattcattaatcattgctgaaataacagatgaatatatgctattttccaatagaaaagccagtcatttgaattatttagaagttctgcatgcaaagtaacttaattacacattttaaaacaataactagttgttatattcacaagttttcctatatgttatgaggcaggtaatgggatggtgttttacagacttctatgttactggaaaacgctaaacctgggagactaacatccctcttaggcttcaggtaggatatttacattcatatttctatgtctttagctattctggtataaatcaaacctaaagggatgaagccagagttttgctttattttgtgttgcttttttacctttaatgcttccagtcaactgaatcatagttgatgggggctgctgtgtaggtgatagacaggcctgcctttcccggaggggaatgtgttctatagtactaataggactgagttactggggactaaagacatgacagaagatcaaacatagtttcttcagtccacacccacacaaggaacttacttgtatataccttcattcatccttaagttcaagtgcaaggaatacccgagaaattcccacatctggatagttttctgagtttttcttcatcacagagtaactatgctgatacagataacacagccttactatgatgcagatgggtttaaaagtttctatatcctttaagagggaaaagagttcttatcactcttaccttcctgtgctacagagaacccagatccagacctagaaatcaggagctgatgttgcctacagattacagagaagtccacaagtgagcatgtattcctgtcgtaggaagtatttcatctgtgcagaatgccagtgcctgcttttacttctcatgggccctagagaatggacagactgggttataatctttgcagtctttgctattcagaaacttggctttccaatgcataaaagagaaataataataataaaacagaaacttgctaggtgcaaaaatcaataaagaggataaaaaattaaaatgtgaatcatttacagaagtatatctcttctggtgggttgacaatgcttcgggcctagtcacaaggcttggaagtgggttggggaggcacatattaaattttaatacctacccaccccccccataccacctgcacaataatgctcagtggccctgcctacttaaccagattattgtgataagtcaatgagatgatatatatataaagtctgtcacggcagaggtgagtatatttactcagtcatttaaaatttgctgaccatttactatgtgccagacactgttctaggaactaggaatatggcagcaagcaaaacaaacaaaaatccctgctcggctgagcagcattctcttttcttgctctgtgaatggcaattcgacataataggtacatggaagctaagacagaacctattttattttgttctgtctttccttccagaaagtataattgaaagtataagagagaagaacacatatgttgattagtcttgccaccccattctacccccaaaaaaaccccagaaccattcttttgccctgatgtgtgacccagaagactggccttctggactacattacccaggctctcttgtccttgggcttccctttgaatttggccaaaaggagacatcagcaggagatgtgaaagtgggggaagagagaggtcaggaaatgtgttagttcagccctccttcccaactccaattctgactggactcagaattcatcaccattttacttgccccttcagtttaaatggtttaaagctttccactactgctagtacctggcagtctctactattgctagtacctggtgctatctctcttgaggtcccttaacctcatctgcagctccaaatacagttttttcattaaatcctctttagctaaaaactttgcatgtgccatctatttttgccaggatcctgactgatacagttaagaggaaattatactgaaaaaaaaattataaatcagccctgccaaggttaaaaaaaataagattgagaaaataaaatgtgtttaatcactaaaatatcttaaattgatgtgaggacatcagaccaggtagagaaatgataaattgcaagaaaacacgataagccagagtcccataggttggtctcaatgaatagaccatagtgtccaggcttgatgggcttctataggctaagtgcagcttgctcaaccctcagcttcaaggagctcatggtgtagtgtagccacagcaatgacaaacatgtgagcagaaaggagatgtcaggaagtatacagcaagatcaaatgttgaggaagagattgctggtcctaacattgtttctgcctttgctacaataacaatccatttgcccctacccaaaatctagatatctaaacagattactgaaatgaagggaaatgtcttctttttcttttgtttttttcttgctccaggctgcagtgcagtggcgccatctcggctcactgcaacctctgcactcccgggttcaagcaattctcctgcctcagcctcctgagtagctgggactacaggcatgcaccaccatgcccagctaatttttgaatttttggtagagacaggatttcaccatgttggccaggattgtctcgatcacttgacctcgtgatccgcccgcctcgacttcccaaagtactgggattacaggcatgagctaccaccccttgcccggaaatgtcttcttaaagctaacatgatgaatatcacagaactaacaatccctatgagaggaactaccattattgagctcttaccatgtgccagcacaaggcaaatcactttacatggcttatctcatttgttcctcacaataaccctaagcggtaggtattattattcccattttacagatgaggaaaatgaggctcagagatgcggagtaatctacccaggacatacagctaataggtagtggagcgcagttccgctaccacccttattggggtggtttgttaccacctaccctttctctcctgcccagatactaagcctatttaatgtattgttggggaaaagagtagggaaattgttacgactccagtaagattgggggaggcatcactggtctaaattatcatgagccaataggaggttccaactaattttttcctatctgataagtaacaggcacattacttaccagataggaaaagaccaagctgataagtaaaaggcacattaacgtgcaagagagggtgggagcccagtgaagagagaaaattgggatagggtgaaagaagagagcactctcaacaccctggagactgctaagagctcacacagataaaatatttatttttccatatgttgcagaaagcattgccatcactgtatgtgtgcaatatgtgcaaaagagtgtgaaatatatacatcaaatgccgccgatctggttaatttccatgcatttaacatgcttaatacctaccatatcatcaatatgttttaatgcatatttctttccacatacaatatggtctagttaggaaagagccaacatcctccacagccttactcactgctatgtttcagcctaaaacttcttgctggggccagcacaatgagagttaaaaaccagaaggctctgctggctaactcggccgccagtctccttaaaacacactcccaattcttgaagcagccttttctcataacagaaatgtttgcagtgaggagatgaaaatgtttttgttctccttggacaattgagagatgttcagtcagaatgtcagaactgaccgttgaaaggcgggtgcctgcggccacgcttttttgccttttttttttttctttttttgaatgcagagctccaccagtgtggcgggaggaagtgcacaatgattggtctgtttctctgtggaagtgttcagggtacacccagttttgctttgcatatatttgcgaaacatctgcccttttcttattcttaagtccttccctgtcaccagcccccttttcctttttccctggtttctttctttgttgttgttggcttgtctaactttttcattggagctttcattttccggttgaggggcgacttcatcagagtgtataattttaacagagagagaggaggaaggggttggagagagagagagagagaaaatgagagagagagagagagaatgagagagagagagagagagagagagagaatgagaactgaaaagaaagagactgagaggccagagcctggcaaatcaacctttggcatggtgaccaggaggaaggttctggtcgggagttcgcctctctgaaatccgctggagtcagccagtgtgctgctgccctctaaaggctccagggaatagtgcatcgccacagaggcttgaaaagacttgccctcagatgtgccatgtttataattctttttatacagcctcaaaatgtattttcaactaattatgacagggcttattctttcctccttaataaactatgaactgcaaaaatggggtcaattcacagcacctgtgcatgtctagacgtaaacgggtgctatgttttagggtttctcagctccggaaaaaggagtccgaagaaccattagagagggtgagacaggacatgaattgcttctgaggatggtgagcagttctctattatctggacagttgggaaacagcccagtggtataagggtaagtaaagtgatataagacaaataagggggtgagccaaaaaggttgagttgctaacatttcctgtttatagaggtagctccaatgcctctgtgctatcaatattctcccaaagtgatcactgaggcaacaggagggtgtgatacaagatgtcaggtaggaaacaagagcgaatctagggaaggaaacaagggcattgatatgaagaacaatataatttttgcagtgttaaaaataaaagagtaatatattggtggttttgctatgtccttatgtttgaaagaaagctttcttaattttctgaagcacacatctgaaagtatcctaggccctgtctatgaatatcaaaaataaacacttttttctgctaggtgacatatgtcattactgttttgaccctatatttaaatgaatcatgagggccagcctagccttactgagcaaaatagtcctgctcttattaaatacccctcacagacttaaagcaaaagcagccagtcaggtagttttgctaccttgctgcataaaaagtaggaaacttaattgggattcagactatgaccgttcttaaaatacactttaatttcagcttcatttcattctgtccacaatcaattattgaatgacagctttgtctaagctacattgcttaatagtatagacaaggcagtaaactctgggagggaaggaaccagtcctgttttattctttagcccatgttggcacatcatgggtacatcataaatatttgtaaaatgaatatgtaaatgaatgaatgacaggagagaaggaagaagaaaagaataggtgaacactaggaatactaaaataactaagacatttccttaccttcagagagcttacagtctcacaagagggatatgcacataaatagccattattgaaataaaattgagtgagtgaaataagattaagaaaaaaaagagcttaggcatttcggagaaagacctagggaggaattcactgtggggagtgaagtcctacctggcagagaggaatcaagacagttataagatgaagacaccatttaataagtatgaaggataataagtatgatttcaacagggcagagatgaaatatgggatattcaaagtaagagaaaacttgagcaaagatgtagagcccagaatgtagattcccaggatgttctggaggatattcaagaaatctgagggtacagtatggccaatatacaggacacatgagaaaagttagaagagatacggaactgaccttgagtgtcaggctaatgtagtcatcttagatttagtgaatgcaaagaaacaggactagaggagtgaaagaggttggagagccagttagtaaacaatcagctagataaaaagcagtaggtgattgcagtgaaattggaatggaaacacagatgtgagaaaaaatatgaaggaagcagaactgtaagaacttactgatgaattggctttaaggcagaggaaggtgtatagtgaccctgaggtttccaacctggtggtagacaacagtgatagagatatggaccttagagaaagcattggttttaataaaggagttgggctttagcaactttgatcttggctacatctttaaactgaaaatcagaataccagctccttcagggtccatgtagacactcaagatttgggggttactcccatagtcaccattcaaaaatcaattgataaggtcttataatttgttgcttctcttgtattggcttcctccatactgaaaaagatgtctgaaagcctcacctctattctaatctttgccatgccatctctgcctcctgccctctgaagaaacagattttatttcacaacctgttggactgaaaacacagcatactaatcataacaccatattctgcgagggcagatttaactacccagcacaacaaatttaaatacaaaatattctgcataacaagtacattaccatgctcacagaaacaagggaaacatggaaacaaatctacttacaacaaattctgtaccacacatagtcttctacaaataaaataaatgctttttctggtcatgtccacataatgatagaaaaagacacaaatccaagggaattggagaaatgttcaggaactattactaataaaccagtttggctgtggtctagggtctgtgtagtataagctaagtatttgttaatttcatatcagttgcattgtcctggggagaggagacctgagctgactgatagctgtgctgttttacttcctattcctgaccccatataacaattagtaacaattactttctaattcccttcacccttctcttcctcatgtcccaaacacacaatcacaccctaaactccaggacgatgcaccaaatcaaaaatcttaggcgtaggatgagtaaagagttggagtagaaaaatctctgcatgacaccttccctctttagctactagaatctaagctcttcttttcacttttcacttgctactctaacagaaacctcccatcactaccccctcatccgtacaggctgcaaatttaaattgtgatttgaaattttatttaaaataaaatcttaataagagcaggaaagttgaatgttccttaatgtagtccatgagtagaaatttaaagttggaaggaacctttaaggccttctaatccaagccctttattttacagatgaggaaactgaagcccagagaggtgaagtgaggtgcccaaggccacacagcaagttagaggcacagctagtacggtagctcaagtctcctgactcccagtccagtgctcctcccattactccacgagtcctgtctctaagcttcctgacaaatgctagaacggtaaaacttccactagtatttttccagaccatgttaaaactcctaaggggggaagagggatgctttcttggataatgtcagccatacgtagctcaagctgtctaaagttctgggacagggtctttttatgcagccaacagagtccaaatgtggtgctgtttgcttggcccatatgctttcatgtgttcccagttaggccattactggagggaaaaaaaacaagaatcagcttgttttaaaacaagggacatactggactccctcccatcccccttcagaaaaaaaaaatcaagttatctttaacagattctaaaaatgccttttcccaaatatgcagtcagttccttcaaagggccctttgtttattttcaggaagaaacccaagacagctgaaaaccagaaggcatctgaggagaatgagattactcagccgggtggatccagcgccaagccgggccttccctgcctgaactttgaagctgttttgtctccagacccagccctcatccactcaacacattcactgacaaactctcacgctcacaccgggtcatctgattgtgagtacaccactaaggtgatggtgtctttgcagtgcttggagtagtgcttctaccctgggttctggcttttctactttcagagcgagctctttgcatttggtcttctaaagcagccaaaagtaatgtgccaccattttcattcagccaatatctataagtttgcaaagctagagtgtatttaaaagccaggtgacatgccatttggccttaaagggctgattaattacataaaacacgttcttttcataacactaacccagaaaatgaagttttgttgctggtatccatttattcttgatctggataatggcacttccacaattactaaattgaacaaccaaatgtggacctcagaaggccagttagacacaaggaaacatccattttgaaattacataacacaagtcagatttgcattagttattggagtctcatgtagcttggctgaatttctgtctttccagtttttaatttattttgaagtggttaaaggatagcataaatttacagaagaaaagagaatggcttccaagaattcagaagccacccagacttcacacagccaatgagaatccaggttaaaaatattttttaattaaaaaaactgcctaagggctaaatttggaaatgggcagcttaatgagatcgtcgctattgaaatcacttctttgctgtttatttttgccatcttcccactaatctgggagtcacttcttctaattctattttaagcaagttgataaatcacgtttaggagatttttttctttttctgaaatgtaacccaatacttcagagaaaaagaaacatgtgtgttgacaatggaaaggaatgaaataactttggagtcgaatccaaaagaatattccttttagtcttaacatacccaacaactcttctgaactgatctccataaaggatgtctggtaacatgcaaataactggcatattcttctttaaaatgagtaacataagacctgcaaagttttatttcaaaaataaaattttgtccacaaagacaaaaattattaggaaatgagattctaaatcttttattgttatttttctgacagaacaaatgtaaaattctgcaaagaaggcaagagacaatggtccaggagattccattctctacttgcttcatcatgatagtctctaaagagagggaaatgagctggcggcaggattggggtgaagagagcttgttctatttaaggttgggctaagaccatattctagccgtcactagaaaatgaaaagggaagtaacgtgagacaaatctctgtggcctatgtgatttgaacagtcgaagttgaggcttctatagagaaaccagggggcagaagcagggactgtgttctgaggaccgtcctaatagtcacatccttggaccttcttgcctggcaatcttcagtgtaatagtaatgacagaaagaattggaaagtagagtggcacagtgcccataggcatgtgcacactgtcccttcccaccaggaaaatagcccgttcctgtggtgaagggcctggagtttctacatgcaggtcttcattacccagctttctgccacaccttatgggtatggattacatagaattgccttaggctagaaatcttctgttacagcaaaaatgaatgttttgtgaatagaaaaagcattgggcttcacttattgtgctttatcataagcatcctctggccaggccttagcattggcatgaagtaagtttcaggaacagcgtgagtatggtgtcaccatacatctccttggtggccctggggaagccagtggatgtgagctcagttggaaaaacaaaccaggaggagaaacctgatctccagctgtttttagacagtcactttgattttgccattaagatgtgtaagtcttctctgttccaacctgttgtttaaattgattatacttttctccaaatatatttggattgtagtttgtcctgatttgagcctacacttagaagaaaattgtttttaggaaagattcacagaaatctgtccatttggagattgcttgagagaagacaggaaaaaggtttattttaagctgttaaaatttttggatgctcttcttgcattcaagaggatttttttttttttactttcaaatgtcattcttaccatagattaatttaaaagcctaatttctttaaggtaaaatattcagttcctatttagaactaacagatttggggcatttaaaaatagtgcccttgacttgttagtctctttaacttcagaaacattccaccagtgtgtgttgttccaagctttcacaagtgcttgaatttttatagcacctttttatttgtcatgtgtttagcaaaattattcttagtcatgatttaatgcccatatcctgtcagtatgatccttcccaatttacagatgagaaaactgagaaaattgacacccaggtagatggaagactcgcttgtggttaactcatttgggtaccgaggggtgtttatggatttgctctcattgtgagagcatttcttattggaattctctgttctgagcccaaagacggcattcctggctctgaacaggcatcttgaaaatgtgcaactactcatattggtgactgggttgtaaaacatgatggataaagcatcgccacaaaagaaaagtcagctctgcatatgaactgacatgggtgggtaagccaccatcttttttgcatatgaaggacacaggctgtgttttacagcaaagatgacaagtctgaccccctaaattctcagttggctgtttaacctcctgagcctcttcaaattcggcaaaagatcccagtggtattcaaaacaagaagaaatatagttgagatatgctttcttttgtgagatgatgaggttaatattgctgctaaaatgtatgttgctttgcagtgcgcctactaacacaatttccttttagcaatattcccccattaccccctagcttaccacctcttcaccattgctaaaaatctaatggtaagcaaattcacatggtgataatggaaggcattaagatgagttatggaatctgaagggtaaaaaacaccctaggtgtttgatagagcagttactcactaagcaagctgagtatgagctgagccaagtgctccctttaaatgcttaagcaggactaaaccaagtcagtaaagcagacgaagctctccatatgaaaaacctttcttgacagctatcaagctgtagcacatcacagtcatatacatgtgatagacgcgaccagaacttttacttgcatatttcttccattttgttttcccccaaataaggctcccattgaaagaagtgattttcctccctgtggccgtcctccctacttctgctgtagatccacctattctgatgtctttcttttgttggaagctgatatccatggtgacttaccttcccatgttttataccggcctcatcagactgtctcattttttgtgtctttgccaagatgcacttacgcatgaacagtttttatttatttttcattgaacctttacacatttccaaactgttgtgtgggtgggtttaactttagctccgtaggtagcatcattctgctggggctggacactcacagaggccaatgggctcttccttttccaactcttgccatccaccttccttggcctccccctcccaaccatttgcttcacccgcccaagtctgtgtgattaaaatttttagtacacttggctcattttgaacttttaagcaattttttagagaacaaaacagaagatttttatggcaaactccattaatgccacattaaggctgacattttaattaccccaaagtcaggaaatgcaaagttcaggttcccacagcaacagaaactgtccccttgagtgctggcatcacagcagattctttcattccctgattacacaacactgggtgtggggacattgtttttatccacgtatgtggaaaggagcacagcttttatcctttgatttttttcctgtaactacagttgaggatatgggtctttagcttccctcccaaaaccatctatacgtattatcctggaacggaagactattatagctctacatgtgcacacggacagaattaaagttgctgtgggaacattaactctgatttccggacttccgtgccagtcacatttaaaccataatgttgtaatttttggcatgtaataaatgtgcatttcatgtacacagacagaaagaagcataaaatgtattttaaagagcaattaattactaactttgtgattaaaaaacatttggtgcatgttccttcccatttagcatcagctgctggtcttagccaggcctaatagatgacatactgtgtctcatcctgtaactcagatgtacttactgtatgttcctgttcttccagataattaattcccttagtaaagctgtagggggaaaacaaaatggaaggaatatgcaagcatgtaaatagggtaagggatatttcgaaggaaattattcatttctgtgaataaaccttttagtccctgataacgagccagaaatctgctaagtgggtgtagacaaaggtttctggccatcttagagcatctggttcggggccattagaacaacttgaaagcagatttccccttgaattgcaggcatgcccactgggggagtgattttactctgtaaaaacttataggcttaaggcttaaaaagttattttactctataacaactttttagtctatgctgtattcaaactggaaagtaaaagttatagggaatcaggtaagatgagggctttgctaaagaacccctgacttaaagagtaattttttttcttcctttacatttaaatctggtttacccatttgtgttagagaaggcagtgtttcaaaataactgtttgaacgggtttgtgattgaaaggcgttagtagcaatactctatggtgccgtgtttaaaaatgcgaatgcttgagtatatatttgaaaccagatgaaataaaaaactttactgaaaggatgtatagcttaaactctaggtaaggctttaaggcagacacgctcaatgaagaacctcgtgctatccgttcattctgtctcctgttgtgtatttctttttgttcagtttggttgcatatgatatttaacctttaagaaaaatacttcagttttacagggctctgatttgcttttacttgggctgtctgtatgtgtgaatgtatgtctgtatgagtgaaaactgctcaagcaagtttgaaggtctctttggcaaatttgactgcatgttcagaaagtttccaatcggaaagctgattcagtgtaaaaccttccaaaaacttcctgaggcacctgttcacatgaaaagattggatttctgttggaggtgctcagaaggcagtgtttataactgaagatctctgtttggtgtgccaaaaaatgaaaaacattttggccccagaaaacctccataaatgttcaaaatgtataatcaaacaaaagcttcatttggattcaaatgcatgtatctcagcagatgtgtctaaactaactggaatcccacaggagcagctgaactggattttggtatgtcttgataactgaaagagttattcttagactttggaaggacaaaaatggtccatctgtgaagaaccgtaatagagacatggcaaaaaacagcatcctctgaaagagtttatttatggaatttaggacaagttggacaatcctgaaaacattttagggtcacactaatttgcagagaaaatatagccaaaatggaatggaataacaaccacagacagttactatccaatggcttgttattaattttctaataaattccgtatcagttaagcagtaatagagtgtctttggtacaactaagtgctctcgttgcccccagtgttctgcattctgctttattctatgttctgtaaggaattatatatttatcttttcatttaaactgtttttctgtcatttcattgccaagtaagcccctcatctgttaaatgtggatttcctgtcattaaagatagtctttcccgttttaaaaagtcacctttctgcctcttagttaattgatatataatctctttggaattttttcgttaccttttataccctttatttagagattttagtgcttagtccagcacttatacattggaaggccagttcgttttttttatttgctctaatttcctagagtttccactttgtgcatttggggacacacttattttaaaaaagcacaggtcttgaaactttgtatcttaatctacctctattttttaaattggccctctttttataaaacttattatttccctacaacaccaatttaactgggtttcttccatagtcacttaatgcagtaatttctggtagtcgttcttattcattcattcatttagtcattaattcagtcattgatcaaatgttatcagatccctcattctgcaccaagtcctcagctaagattagggacgaagataggaataagaccccatccccacactttggaacataacggggtaaatataaatgcagaattaaagtgttccagtatgcacaaaatgctacagagcccccgaggaaagagcctcttgaagtggaaagagctccacaccaaaaatgaaattaaactggatcataaaggagtgggcatttgtaaagtagaaggcagaagtaatggcattccaggcagaaggaatagaaagaagcaaaaccatagaggcacaaacagagcgcagagttttcagaaaacagaacagttcagttatgacactgaggccttcttatactttgcctcattttaatcatgggaagatttgtatttgggtaacattgtctattgttataattcagctgagctgaatcctatatccatttcagagacatttgctttccaaatatataataaagcaagacatctacttattttctaataggcaaaagaacccttccttccacacagccagtcaaagtaagaaagtattctgagggggcaaggcgcagtggctcacgcctgtaatccccgcactttgggagaccaaggcggccagatcatgaggtcaagagatcgagaccatcctggccaaatggtgaaaccctgtctctactaaaaatagaaaaattagctgggcatggtggcacgtgcctctagtcccagctacttgggaggctgaggtaggagaatcgcttgaacccaggaggcggaggttgcagtgagccgagattgcaccactgcactctagcctagtgacagagcaagactgcatctcaggaaaaaaaaagaaagtattctgaaggacctagtgatgattttgatcagtaaatcacaaaataaattttctttttatttttcttttttgtttaaacagggtctggctctgttgcccaggctggagtacagcagtgcaatctcagctcactgccacctctgcctcctgggctcaagcaatcctcccacccagcctcctgagtagctgggaacatagacttgtgccaccacagccagctagttttttggggggttttttgtttgtttgtattttagaggtgagatttgatcatgttgcccaggctggtctcgaatcctgagctcaagcaatccgtctgcctcggcctcccaaagtgctgggattacaggcatgagccaccacacctggctcagaataactaattgttgagaaaagttcattcatggagccagagtcacctacaggtgtcatgctggaactttgtcatggatttgtggcccttcccgactctaacagtctgtcctcttataaaatcctcccaggtcccttggcaagtctggtctcaatgcccattggctcaagttacactgtgtcatattgctctcccaaacagtgcatagatatgattatccacatgtaattgttagggcccaatgctgattttcacggttctgttcttcatcttgccatctcatcccatgcaggaatacatctttaattcttatctacagctgctagtgacagtttcatgtgtgcttcctctgttcatggcagatttcattatataaaattagtgcttctccatatctgtcaagacttctcacatccttacttaaaataaaagaggccacatgcactactgcccttagagttggatcatttaggattgattgagagcaagcatgaggattctttaaggacttcttgctttaaggaaatttcaagtcggatctttccaccagtcacctcacactaggtaccataatcacataccttattacttcatcagcagaatccctttttttttttttgctttcttttttgcttttcttctgcctctgaatcatttgttctctctgaggaatgtgtgccagttctaactttttatcagcagtgcaagattaaaggttacctggtctatacccattattgtacacatgagaaaactgaggcccaaataacacaagtgttataacgaaagtttcccagcataatgaatgacagagtcagaaacagaaccctgccctttctcccaccatttatgctgcttgttactaagtctgcttctggacaaacttaatgttctctgaacagaaaggagtcaggactattcatccatcaatatagtggatgctttcaatgtggaggaccacaggctaagtattgtgcaggacgcagttttataaactggagccctaggctcagagacttagagtcttgtagagaagatcaaataacattcacaaacaacttccatgcagcgtggttaaagatatgtccccatacacagagacccaccggagcattgattcactcactcagcaagtatgtatagaatatatcttttgtgcctgtcactacagtgagttccatgaggacacaaaggtggagaaaaacagaccccaccaccaagaatcttaaaacaatatgtatcctcacatcaccagtatctgagaatttagaaagtttgtaaagtatattttaatccagttaacagtaatatctaggtaggtttattagacatggctccatttgagctcttttgaaagactggaaatgaggcatcaggactaggtatgaggggtttgcacctctgttgcagagctgtggaagggtgttaagtagggcctaccatgagcaagattttgagaagatctaatttggcagcctggatgtgagaaggagcaactggaggaaggagagggtccagacagcactgtcagtatttcacactattggtgacctgaagggggcggtaataggaggaatggggaggatccaggtgcaacagattttgtggatgagggtagacagctctgggagctgagtgttagttacaacaaaggcagttatcaaagataactccaaggtatcaagtaaagatgaaaagcatttaaaggaatcaaattgaattccattttatatagtgccgagtatgagctaccacaggtgttcccagtggagacaactaacactgagttacaaacagggtcctggggcacagcaggaatgcgtgagattaggactagcaaacactttggccaagagcactataagccataaatatgggagtaaacttcaaagaagtctttgttgagagaaaaaaggaaagcaaaaccttgggaaatatttacatgagtgataagaaagagaatgaagaatgaataaatagaggaaaagaaaagagagttctaagggataggagaaaaaccaggatagtgcagagagaccatcagggagaggaaggatcagcagtcagtatcaggtgccacagacaccaacgagggagagacctaggaaaagattaccttaggttttgggattactagcctcctgattgttgtcaagaaaacagaatcagatgtgtcacaaaaaagaccataaagaggggttcaggagcaaacataggataaatgggaaagcaactattacaaagtacaagtttaatgttttaaaaagaaataatgaatgggtaactcaaaagtggagtaatgaatatttttatgatacaagagttcctagcccattatagactgagaaaaaccagtgttaagggagactctgcaattaaataggcaaagtgagaaggaattagatcttccatttcacagggcaattggaatggtaaatatatgtgaaaggaatttgaaggcactacccaagcccagtgaggcagtaattatattatactggttctttctctacttcttctcaacattgctttctattattttttatgagaaataatgttttacaagtattattacttcacaaatattaactcagttccttaccctcagtaacctctgaacactaagcagaggataggtgtcatacactttgaacatttaaatcatcttaacaatttttaaaacaatttttaaaaacaattgtttttgaaatgacaaagcataattctttaaaagccatgttctgtgtacttctttcatgatatgcccaattcaggtagctctgtaattactaataacaaacctatgtgttgttctcaaggccaccttcattgtcatgggacatcctcaaattcattatttgtagggagggtttcaatttgtttacttaaagtatgctgctttctgtgatggtccaagacattccaaaggccaatcccacctgtacacaaaagtatctgatatacttctactgtaggatggtgatctggaaccaactgaatcaaacgatactttgttctactattaaattacctgtaaaactaaataaggagattattttgtcactactgaaaattatataaacaaccacatggaacaatgttgaacatgagtctttataatttcacaaggccaaatgaatttatagttgatgtcaaaattgaccttgaggagttttttcctttcctctccaattctaaaaatgagtttcctcctacttatttatcctcactagttttagcttggttatgttatcagttttataccaagatattagaccaaagagtacagaatttttaaaaaagcttggtgtggcatgtagaatactacaaagaatttcaaaaagcagtaactgaattaactttgtccttcaattttttactgtaatcacgttcttccctatataatcactgattatctctttgcctcatatcttaaccaggtatttagatgtaaaggagacaatgaaagaaaggtgcatataagtttgaactacaaaagataactctgtgtctaatggaaaagacacatgcaaattctaaactaaaacttttagaagttaaccccagggtaaaggatacatgtcattttctcagggaaatactgtaggtctttataggtacacctgactggattttttccaattttcataaatctagcccattccattttcttcctgacctaaaggtcccagatgggtgactagatcctgggattcctgaagtggcctaagtaatcctgggttgacatgctaacaggcactgcaaagcaggcctggtttcactgggcagtgatacaggcaaagcgtgcccccacttccagccctgctccagagcaggagttcttgacctggaggccttggactctactggtaccattactgggcctttcttttagaggttcatattctttcctgcgtgttgttctgggacacaggtttaaagattttgttacattagggtcagagaactaacagaaggaaaaagccacttccccaggacatatcctaatcagaatctgcaccctcaaacctggcacccaagagtgaacttagaagcaatgaggagaggtccctgtgaacatcccaatgcagaatggctcctgatgtcctctcgggtccctccgatatgccttcagggtgggggcaggtatgataacagactgctaaagctatttcttgaacatgttgctaatggactaagactggggctatgtgttgttttccaatattcagaaaatattttctcacccccatggtctacttatttgctctttttaacatgaacttcagcctatgaatgcattttatgtgcctttaattaacctccctatgtttccatttcctcatgtgcataattgcataatgagaataaaaatagtatgcatctcatagggttattagaaggattcgatggaacactacatgtaaagcccttaaagcagcaccagaaaaacagccagcgctccgtgaatttgagtgtcggctacagttttaagtgcttgaaaattattaatatgaactaaaattgatgcagcctaagtgaaagttgttgcaggtccccatcctttccccctgagaacgactgaggctgaaaagccctagatctatgggaggagattgtgtgtaagacagttacatccttcacttcgaggaaaagccagtgcccttcttcttgtcccttcttggattcaggcctgaatagactgggaagtttctccattatctctttgccttcttttattcccccatttgtatgtttttttttcctaaaaatgaaagaggactaatatgcataatcttattacaaaacaccccatttacagataaggaaactggggctgaaagaagtttcaaatctctctgaatgttgtcttcttggtatagggaagggttagagtgttattaatattatagcattacattctagtgttaacctgttaagttcctttttgtcttcaagtgcattctagtcaataagagattttcacgctgggcatggtggctcacgcctgtaatcccaacactttgggaggccagtgtggatttatcacttgagcccaggagtttgagaccagcctcagcaacatagtgaaaccccatctctacaaaacagttagcggggcatagtggtgtgcacttgtagtccagctacttgggaatttgaggtgggaggatcacctgagcccaggaagttaaggcttcagtgagccatgatcatcccactgcattccaccctgggtgacagagtgagatcctgtctctaaaaaataaaaaaagaagagagattttcaaattatagggaatggacttgtgtgctctcttacctcagaatacattgtaggagctgtacattttcctgtgtgcacccatctacaatctgtccattcaccttaggtgccctttcaccgtagctccttccagccgggatacccgaagagggcaaaacatcagatccttagaatgtgcaaacttctgtgctaccatatcagagagccctttgcaaagacaaatacttacaagtaaagaaatgcatcttttatttttttgaaagtccgtcggcttgatggcatgagagttgtctgaaataattcaaaacagaggtaaacttagaagagtgagtttcacttccgaggaggattgcttgtaatcaccctgcttacttaccttcttctattctgaagcagtctgcagtagttgggaaaagtgtaatcttaagaaattcagtaacagtcactggctcattgtacctggtaagttttccccgtgccgtggtgcccacggtttttggtaatgcatggagataatttcggacgtctgcttctcttaactcctgagcacttttgcttctcactgtagaattccagagacacatgggtatggaacttgatctaaaagcctcctagtaatagttgcagattagattgaaagccaaactagactgtacacaagtctgtataaatcccaaaatagagctttaaaataataacttactgagtcatgatttctgcatctcatatgcagtattccttaaatcacatgttgatggctaatcaacaaaatccaaagacgcaaattagatggtacaatatttacagagaaaatatatgtgtagtttgaaaagcaaggattctcagggttacagtcccacccccattccccccagaaatgatagcagttgcaatctgaactctccacattgtaaccaagaaaggaatgaatataacaatggaaagagagagatttaagatagaacttcttagttaaaggagtctggaccttcaagaaatatgtttaagaaagattcagaagaaatactaggtaagatgaattattcctttttctcaagtaaaattctagcagcgtacttgttaaatgtttattttggccaggtgacagaattcaggagggcggaatcttgtttaccttgtccactgctgaatccctagcacccagcaaagtgcttacacaaattaggagtaggtgctcagcaaatgtttgttgaatgaataaatgaatgttgtggggagaatgaagctaaaataatgatgtagtgcatttgtaagcattatgcccatttgtgaaaatataggtactaattttttacccgattatttttttcattcagcagacctacaaaacaaagtgtatcacaaataccctctgcttttcatgctggggaaacagaaaagctttcttttgaatgtaagctgctacatgttttaattctaatagcaatatggcaggtcaactttgtagtataatctggtgcctgtttttgatagataccatggaaatagatacttattttcaagatgctcaaacagatgattaggcaaaagctctagcaaaccttgaaacaacaaaaaggaaaggttttcccactcccacctcccgttactgtaacatcctgcacagttttctgcaaccccacatcctcctccttgtttcatctttttcctgggtctaatctttgtctagggaatacagcatgtgactgtcagtctagcaaggagatagttcttgagaaatccaccccctacacactgtgttcccaagctcctcttacaggaatggcatgatttgatcagcagcaggcagagctggcccagggaaacaagagcttggcatagaaatcttagtgccctcctgctggaagggccctcaagagagatgcttcatgcccaccctccctcaactggctggacagtagatggatgtgtaggaaaacaaattcctggctgaatgaatagaggattaaatgaatgagagatgagttcactcctccagaagtccccgccatcccacttgaatagaaaggctaactttgaagccactctgttctccatggcactattttatgtatactcagctttggaatatggttgccatctgctgccagtgcttaggactaaggaagtattggggtgggtaggaggaggctgggagggaagaaaagagacacttaaaatgagctaatgatctcctttgtgttagagcctaggtttcagaacatcaatcctgtacttcaagaacaaaacaccagtgtgtcttagaccacaccaggcgccggcacatcagataaagcctgtgctgtgtggtgtttagccaccgagcctagagaagttctaaaagtgaaattacaggtgcaaactgaggaaactaaaaggagaaaaggccaagggtaaaatacaatcaggagggctctgccgatatgtatctttggggctacagtagttgaaaaatgaatctactaattaatcagttggataatactataaaagcaaggaatttaaggatctttagaagaaatgagacacttttccatacactctgagcatattgtgagcctttagtataatctcagggtgaaagtgacctggctattgtgtattgctgtagacgtaactgttgattaagtgttagagattgctgtactagaggcatgcatggtggtcctttaaaaacagaaaaggctgttaagctcagctagtaagacaatcgaacatatctgaacggcagagaatagctcatagagcttcctagcttccctgatgttgtttgcataaattgttgggggatgtttgtttgtttgtttgagacagagtctcactctgttgcctaggctggagtgcagtggcatgatctcagctcactgcaacctccgcctccagggttcaaattattctcctgccttagcctcctgagtagctcgaattataggcatgcgccaccatgcccagctaattttgtatttttagaagagacgaggtttcaccatgttggctaggctggtctcaaactcctaaactcaagtgatccacctacctcagcctcccaaagtgctgggattgcaggtgtgagccaacatgcctggtcaaattgttggttttgacacaaaatcatattgataatttatgtactgaaataacatgccagagaatagtaattaagctggggatgtatgctagtgaaaaaaaaaatattacagtgaagtttattttgggaaaggattagctaattggctaggcatgacatttgaaggccatgtactgttatgtattcaatagtaggcctgtatcttgaattggaggaaggctgaaatttctttttgcaagggaagaacctcatcagcgatgtatataagtataaatttagagacaatgacaatcctagaaatgcaaaataccactttagggagcagtaagtgattgctgagcagtgtgtcagactcagtgtctgagagcagcaaatcagaacatatttgttggctgtgtgagctctggccttgactactgtcttccagcaggaacaagtcatatacaactgtgactcagcctcaattagaatactagtaatgccctaaatctatctcatgtacagtttctcttcctaggaaccttgtgtgcctcatattctatttgtccctacaacatccctgtgaagcatacacacctttgttttacaggtgggataacaggtccataaaggaatagtttaattctttgtcttcaaatgtgaaatgattgataatcagtatactgacccagctcattgtaatgtttttcacattatttcaggtttcctaggcaaaggacatattttatcttctcattattatttttaattagttttcagaaaaggtgagataaaaacagaatctaacaaatatcccatagagatatttggtgttctcttttctttcaagaataaattaagaccttctctgctcctctctgctggctctctcggcagatagtcaaaatcccatgccaattttcaaatgaataagggatcattctaatagctgatcacagtcccctctgttgaggaaacagcctttaaaattcatgtctggaccctgaataagttactcttggttataaacttttaacagtttgacctgaaggtttttaaactgtactaatatataacctgcttgtgagttcagcaataaatttatccccagtatgtgaagggccaaagagaaaactagtgtcttttattctctccagtgaccttcactaaatattgcatatttactttgtaaatgaggacacccagtggccaccaagagaaaatattctaaacaatccttgacactactgttaatgtacatataaataccctgttatcaatgctgattgatagatatttctgtaacatctgttaccaagcaggttagcttccctaacataggcaaaagtgatcggagtttggcctgatcatttttctatcacatcatagattggtcatctcttcttattttttattacaaagtatggcttagctttgggttccactgaatcctctgttgacagggggacccagtgagctgtctctctggggaaatggaatcagggagacagagacagcatggcatgtatcagaaatcataaatgaatgagcagagtttgtgggcaactcagtgaacacataaaacaattgcttggactttaaattctattgaaaatagaactgtgggtaggtagggaaataaaggacaagaagaagagcattacacagaacttcaggggcaaaaaagccctgtcaggaccatatcacatagacatatctcagagtaaatgtgcgccctgaggttcccacttgtttgtgaagtgtagcgaagagctgaccaaacaagcactcacatagaacccacacattataaagaaacatgctgggcacaatgagggatccagttacatatttgtagttgtcattgtagttgtggttataacaagacaagatactagcctttgggaggctttgagtcttagagagataagacagacacaaatgaaaaaagaaacaataatatattggtaagaactaacttaggtgctacatgtataggaagttcaggtgaacttccccaacactcctcaacattcaggtacaaaaaaattcccgtatttttctaaagaaaattaaacctgaggcccctgtcaccaaattcgcaagaaatacagacaagttttggggctcccttctcatccctagattggtacaagactcattaaatctaagtccttagtccatgatggtctccaacattgacattgcttgaccaccccacaaagatgccattgagcctcgtccttctgactgccagcactactgcactagctgggtttacagatgccctccacagtggtccttgctgttgaccattggcccagcccccagatgatcactgttcctctcaaagtggtgcctttttatgtccagcctccagaagtgtgccaagcaattaccccaactggagctgtatgcaagtagagaccttgctaccttctgcatttgagggaaagtggattgtttttctctccagtaatgctatccaattctctaactccaaagcatcaatcagcctcactctccttacccattctgggttaataattcattttagagaacagacattaggaaagaaaactctttgttttatggtttattctttagggcttaatgggctctgaaaccacaactccctgaggcaaaggagcctataaagtatacaaaaacctggccattcattcctacaggtggaggaaaggggagataccttctcattaagaaagttttctaattcagtgagaacaagccaaaaatgaatgtcttagtttattacctcaccaaccagtggaaaccaagaaaagtgaactctagtaatcacagaaggcttcacagaaaaggaaaaagtttgaataaggttcatggggatgataagaattggtgaggagagaaaccacaataacttcagaactgcggaaaattcagcagaagagaagtaaaaatgaatgtaatccacacacaggaaagcaaaatggccaaccttttggattagcacagagattttattttagagaaaatcaaatccaaccaaatcagtgaagtgaaatcagataatttgaatgttagctatagctataggagacttctatagctcaatgtcttttttgacaatatgtaaataatataataaatattatacaaaagactatataaagaatatcataaagataaaatgcctacttgtgattaaaataattataaagtatgccttctactttacttatttaccagaacctcccaaggttttgagttctatctgacagcacttattcttcatctcagtatgagccaaaaaggaacttaggtcctattcttttttttaatgatttcccgtgcctggttctataccctaggtgcgcagatgaatttcagctactctcttaacctagcccacacaaatcatctcagtgcttccattttaaccagtcatccaacaaaacagatttacttttttccttggcttttccctgttgctttgggatagaaggtctttactcctcagtgaacttatctatcatggctcaagtccatagagaaattggccgggcacagtggctcacgcctgtaatcccagcactttgggaggccaaggtgggcagatcacaaggtaaggagttcgagaccagcctgaccaacttagtgaaaaccgtctctactaaaaataccaaaaaaaaaaaaaaattagccgagtttggtagcacgcttgtaatcccagctactcaggaggctgaggcaggagaatcacttgaacccaggaggcagaggttgcagtgagctggagatcgcgccactgcactccagcctaggggacagaacaagactccgtctcaaaaaaaaaaaaaaaaagaaaatcttgcattcccctcctaccaacaaacagagatactcttgaaaaacagcggtctcattggaagcaacttttttttatttgttagaaagacccaagggaagagaacatttgagcatgaatttgaagacctgcttcaaaagcagtttcagaacagcacagcaacagaggactaaaggaagttctatgaattgggaactcaatgatattttttgccagaaagctttttttttttttaatgacactattgagttctgttttctcactcgtttaagtccagagaaaagttttcccaaagtcaaaaaatcagtttcttacctaactataattcatcagtgtgtgatgatattctttaaagaaatgccatacctgagagttatactgaatctttgaactcactgaatttataaatctgttttttctataaaataagtatatgattatgtagagaccacaagaacagattatcaagtaagaagatgctggttttcatatactcaatttttaaatttgtgattgcttcttaagcaaaacaaaagacctaacttattaactgtacaattgaatatacagatccttctttaaggtctattcaaagccaagttcaaacagcacaaatttgtgaatttaagtagatcctttggttcatttttgtataccacccacggatgtagcatctctgtatttttgttccccagatttagtgaacaaaggaaaaggttacaatagggcagtagctaaatttgtaaggaaagcgctttagagagagaaaaaatgaaactcctaaaaggtgtctcaaaaggtttacaatataagaggatttaaaggcatcaacctcagatttcattgacttttttccttagtcccagcaagtcttctccccctcatttcatttcaactttggaatgacggcgtaagtgtctttcagaatgttgtctggaattatctatccaattctttattcacagagtaaaacttaattttcacaaactgtactgtaaagtaaatttcaacagtttacctcattggaatcagatgctcaaagtataaaaaattcataaagcatatagtgtgataatactcaagactgaagttttaacttatggttggaattggtttcataaagtggatgctcaattacttgttgattgattgattatgccctcacctcataagtaagggatttgaggtagcttaaattaatattcaattgttaataaatatgtaggaaatgtatttctatataactacaaaaaaaaagaaatcagagtagaggtaaaataaagaatggataatataatgaggctggtgaaaattttacatagaaaagcataccatgaggtcctacatagttgctaaaagggggcctaaatttttattctgagctccctagtgaacagagccaagagggaaacatgatcagttatgatattcacaggctccacaaagaaaagcaaaacacagcttttcctgagcactgaggtctgggagaagttgattgattaatatatgtttccaatatcaaagatccttatggataaatttcttctattgatttagatttaagatcctttgtatccttatggttccatttatactggggtattctcagtaaatgtttcactaatgaattggtgaaaattcaagtgacccccaaagcagcttcattcataagtcagttgtatttacagttttacaatatggataggcatgccctcatcctttcttagagagaacagcagacttaacataaaatcaggcaagccaaaggcctgggctaaccaagggagactgtgagacctctaaggccaagtaaaaagacttttctggaattactttctcctttggacctgtaaaatcccactagtactgtaaatctattctcagccttagataaagtataaagctcttattttttggtggagtgaagagaggaaaaagaagtcaggaatggaagataagtcaagatttggggatgggcctgaaaatcacagagcaaatgtttttctagttctcaattttgcctctttgttccccatacttcaaacttagtaaaacttcgtggtatgacagcaaaaaggaagaaagggaaggaggaaaatagaaagaaaggcagtctccccattacaagtgctatagatcttgcaagtaaactatttttttggctgattagatgtgtatattgagtttatatttattttttattcaaattataccacaatatctaatttttaacagtcaaaagatgttaaagggtgttttctaattcttctgtggatttgtcttaactgtcaaaagggacttactctgagtaaaacaaagtttgctaaataatagttagcttcaacagttgtaaactatatgtctgtcataatccagatttctgctaatattagtagttacctacatttctctcttccctttcaatctttttaaaaaatatttctcttctgaaaagtaacttttctcattttggccaagattgtttgctttctcatacaaaatagtatcagctcaacttaagtaaatggaaaatatcagttcaacagaccttatgcatcagagtaatgcaatcacaaagtttgcatcagttttagaagctttgattatggaaagtagttacaagtattttaaagagggatgcctgaatctcaatccacagctcttaatttggggaaaacacagacccctttgagattttgatgaaagccactgaccttattcctataaaagtataaacatgtccatttataaaaactatacataccccccaaaacccaaacataaaaccaaggacctttaaatacttttaagtattctctagaaatgttctatgaatgaataaaaattcaggtaatattaaaggcatacccaattacagtattgggatcataaatagaatggtgttgtaaatactgtaaacaagttagtaatttttaatctttgtctagataaaataataagtagtgactaaaaaagcacatccagctagtccccaactttcataggtagccattcctgcaaacatgtttgaaagtcaaatttctgcaagttcgaagtcaaatttctgcaaatttcaacaattgatatatgttttatgtgaagaattctgttaccaatggctaaaaaaacgtgctgaaatccttgatggttcctccacactgggcttagacaatctggaagatagaggagaacctttattgggagatggcccaaaacaccccccttttcacccaagaatgggtaagtaaaactgtacagctcgccctcccataggctgatgaccctccctagtctcactacagaggtaatagcagctgggatatgctaggtatatagagccaagataggagaaagagatcttgtctgcttgctgccttccacttgcatgtgtgatttctccagtgctcccagccacctcccaagactgtgatgatactaatgagatagaaagagagagtggggtggtgcagagtcatttgctgtggatggaacctgttagcaagaaactactatacctcctatagtgcagggattcagcaggactcccttggcatatatgaggaggtaaagtacatgtaactgaagtcttaccccaggcagggggtttggagaataagggggctcagtcaccaaaatacatcccccctttctccagagatgactggctctttcctagtgtgactaacttggcaagctgcaccctgtttcatgtgcaagacccactaacctcatctggtgccccaaattgaaagctcaagggctttctggccctgccacttgacttaggcttattaactggaccgaaatttatattggttttcatttgagagctgatgtttccttccaagtccagagacttcaaatccccatccccctctgtagcatcttacccttgcactagtctcattttatatatccttttgctctcctgattgagaaagaactggatttcacacctaattaaaagagattgtattgcctgctgtttcctttcttgctcattttctcttgtgagcaggcagctttttattctcatgctaagtcctatccctggacccctgcagcttaagggacaggcaggagcaacgttcctgcaaaacagagagtcaggccctctatccccaattccccacaggcagattttcccttcggtactcacccctgctttagccccgtctgtgttgtgctctcgcagaacagtctcttagaatacatgatgactttcattactgcaattccttccatgttttgagggaatgccatcacaagctgactctgtatttttactctagtaaaaaggaggtaagttattattttaaaacacagagaactatttttatcactatttcattttgccatcagttttgtgttcataacactgtgcattttttattttgggtggggaagaatccccaaatacacatgatcacataatctatgtaaagttttgtggttttgtacagttgatagggttggggtttgggtgtgtgtgtgtgtgttttttttttcttgaatagcccaaatgcctattcagtgccaatctaagaaagaatagagttagcattttcacaccattccttcctatacactccctgaataaccatctaatcaagatttgttttcaatgggggacaaatcttctacagtagagtatttcagatttattccattggaatctatacattaatgcccattggatgaaaaggacatgctcacaaaagcctggactttgccttgctgtggcagaaactttttcccactgtattagtgttaaaaataaaagaaagcctgggaaaggaattgcctcagcattgtgtgctggaggaatgaggcatgcttgaatggggaggcagggtcccccttcgcatctgtactcatatcagcaaaaacgattcagcttttcatggctgttcactgcagtgtggggccagtgtactcagggagatatttaagaattgtgtgtataaaattcaaccaggcatgtcagatcaggttgtgtacgtgtgcaggtttaggtttgtctctgtggtttttaatgaagttggtggcaatattatcgcaagagtcttaactcagactattcagtagataacttgattgtttagatgaacaaaatttgcaatccaatctggtcaaacagtttggatttttctcatggaattgtgtgtgtgtgtgtgattatctgtgttcatttcttatctctaaagcaaccttcatcattactttcagtgtctttcttttttctctgctgagaattaagataactctcgatctttgggcacttcaagttccattcctcagtgatccactgttatgcagtggaaaaagctttaagaggcatagtttctaatcccaacactgccatgtgctactgtgcaaaactttgggcaagtcatttagacattttgagagcctcgactttctcttatatgaaatagcaataataagacttgtcctgaagggctgggcacagtggctcatgcctgtaatcccagcactttgggaggccgaggcgggcagatcacctgaggtcaggagtttgagaccagcctggccaacatggtgaaaactcatctactaaaaatacaaaaattagccaggtgtggtggtgcatgcctgtaatcccagctactcgagaggctgaggcacaagaatcgcttaaacccaggagttgaaggttgcagtgagctgagattgtgccactgcactccagcctgggcaacagagcaagactctgtcaaaaaaaaaaaaaacaaacaaaacaaaacaaaaaaaaacctgttcagaacacacataggattgttgtaaggaataaatgagatgttacatgtaaaaaagttgtatacacagtcaaacactacatggatactaattattgtgataattgtgatagggctacttcccagaattatctgaaagaaaactgtcatatatgacatctctagtgttattgttgtaactaatgttatgagcaaatgtatgtttaaagagtgttttcacttgtgtagaaaaaaatgttgtaataaatccatcctacacagagatgatcacagacacaaccagttttactgcttattgttttacttaaatgaaagagaccttggttatagtaaaattgtatatagaaaatcctaaaccatagtgccagttagttgtcttacttcttgcactgtgacatctaaaaaaataagtcctttaagttacacaactgaggctatgtcaaagcatcacagcctaaaaacataaaagccacactaaatcacggataggtatagaagtagctggaggtagtagtggacaaagcctttcacacagctttacaacagagccgtggatccctaagggccagacctcagtaaagggcaaactatgcaatataatgaagcagttaagagggtgaactctagagccagactgcctgggtttaaatgccagtctaccagcaattgcctgtgtgtacttgagcaagtttcttagtttctctggcctcagtttcctcatctgtaaaatgggaataatatcatctacttcccatggttgctgtaagattaaatgaaatcatatacagaaagcagttagaactgtaacccctaaaaaatgttatcttgtgattactatcatggtatgtatgtatggcgaactcagcaagaacttgaaatttggtctgctgctgattgagctcctgaacagcccttcctgggttatttgtgccttcttttggggccatattttgtgttcacatggttacaggggatttaccttaattctttaatctggcaaagagaacttgtcttatataagtaaaaacgatggaatctgtagcctaatacaatattttaggcacataacagacctgatagagtcagaacgagaaagaatgctcttatacaaattagtgcaaattgtattattgaacatttattaagttaagctcataccatgtgagggtgattgagtgaagcaaggtagaaacgctcattgaactcagagtttcctgaacaagtcttctatcgcaaggtagagcggaaagagtttgaggaggtaggccttcttcctatctgcaggctgttacctctcaggtggcttctcacaagacagagagatttgggtccaggccaacaatcagtgcttgggccatttggttttgaaagcccacttatttcactttcccaagctgattgttcagttgtaaaggcaagaatggggaatctgattgaagaattatttggagggggattctctagagccatctgagagatgagctagaaaaatagaaaagccctaagatctactgctgtagccacctgttttctttctcattctgaatccaaatcttatcaatagtatcccttgccataacagcctacgttatagggtggcgctgggtcaggctatccgcagcctccacatagctgttgccttcctcctgggagctgtttaatacttccctgtggcaagtacataaagcaccctattacccaaggagatcatatatcccacttctggcttactcctgctatcctggcctaattattaacaatgctctctttcactcttgaaagtgccctgtttgcataataaatatgatcaccaatgtactgtagtctcctgggtcagaactgccatctctgacctttttaacattcctccttcattaagcctcagaaaattcagaaaaccttccatatcacatgcaaccaccctagaaagtgctcaaacaggttgtcagagatgacaagaagaatgagtagatacagaaagcagccatggagtgcccctttagctagcagattgctttctgtagcccatccatcatccggaaagcatgatcatgactgtttggtagatatcttagtctgggttgaattttccaataatttttgcatacatggtgtgggttttgataatatgccatatgacttaataggaagggggtttatttgttaactatgaatatggtcactgtgtatgaataaaataagggactttgataagttgggggaaatgtaaactttcccaaagaatctgggcttaggcctgtctaaagtgaaggcaaagtaaataaatacataaataaaaataaagtggaggtttagtgttccataagaacaagtcttccatttgcctttcagttctttgctgaagctgtaggaatagcaggcaaacaaatcatctggttattaggccactctacctcagccgaagctctggggagttaatatggatacccaaaatggctgcggcactaaaggccggaattggagcaaaattcaaggtccttttccctcaggtcatcgtacctacagcttgtatgccgcagcctgtccatctccccacttgcgtatgtaagggcagtgcttctaggagccatgagcattactcacctgaaacctaggtgttaggaatgcaaccagctagatctgacccatgccctgttttgtgtctgcgttgacatgctgcaggtgacatcagttgcaaggggatgaccgagcgcattcacagcatcaaccttcacaacttcagcaattccgtgctcgagaccctcaacgagcagcgcaaccgtggccacttctgtgacgtaacggtgcgcatccacgggagcatgctgcgcgcacaccgctgcgtgctggcagccggcagccccttcttccaggacaaactgctgcttggctacagcgacatcgagatcccgtcggtggtgtcagtgcagtcagtgcaaaagctcattgacttcatgtacagcggcgtgctacgggtctcgcagtcggaagctctgcagatcctcacggccgccagcatcctgcagatcaaaacagtcatcgacgagtgcacgcgcatcgtgtcacagaacgtgggcgatgtgttcccggggatccaggactcgggccaggacacgccgcggggcactcccgagtcaggcacgtcaggccagagcagcgacacggagtcgggctacctgcagagccacccacagcacagcgtggacaggatctactcggcactctacgcgtgctccatgcagaatggcagcggcgagcgctctttttacagcggcgcagtggtcagccaccacgagactgcgctcggcctgccccgcgaccaccacatggaagaccccagctggatcacacgcatccatgagcgctcgcagcagatggagcgctacctgtccaccacccccgagaccacgcactgccgcaagcagccccggcctgtgcgcatccagaccctagtgggcaacatccacatcaagcaggagatggaggacgattacgactactacgggcagcaaagggtgcagatcctggaacgcaacgaatccgaggagtgcacggaagacacagaccaggccgagggcaccgagagtgagcccaaaggtgaaagcttcgactcgggcgtcagctcctccataggcaccgagcctgactcggtggagcagcagtttgggcctggggcggcgcgggacagccaggctgaacccacccaacccgagcaggctgcagaagcccccgctgagggtggtccgcagacaaaccagctagaaacaggtgcttcctctccggagagaagcaatgaagtggagatggacagcactgttatcactgtcagcaacagctccgacaagagcgtcctacaacagccttcggtcaacacgtccatcgggcagccattgccaagtacccagctctacttacgccagacagaaaccctcaccagcaacctgaggatgcctctgaccttgaccagcaacacgcaggtcattggcacagctggcaacacctacctgccagccctcttcactacccagcccgcgggcagtggccccaagcctttcctcttcagcctgccacagcccctggcaggccagcagacccagtttgtgacagtgtcccagcccggtctgtcgacctttactgcacagctgccagcgccacagcccctggcctcatccgcaggccacagcacagccagtgggcaaggcgaaaaaaagccttatgagtgcactctctgcaacaagactttcaccgccaaacagaactacgtcaagcacatgttcgtacacacaggtgagtgtcaccccacctggaggcctggcagcaggggctgagggggctgtgggaaggcaaggtaagagagcaggtagaagggaaggtttgggatcatctttcagattttaaacagaccccaccacaagcctcttctagaaaccccaactgtgttcctcccatcataagaacaaagcaccctgccaccaagagacaccgtcacaggaaccctttatggagaagggatgtcctagggatgtccagactgcagaagagaagactcaggtcattatataagccatattcaagtatttgtgtttcagaggcagcatactgtagtcaggaagagcttgagctcttacacccagccagatggcctgggtgtaaattcaggcttagctactactaaaccttgtcgccttggaaaaattacttaacttgtctatacttcagtttccttgtgtataaaatgagaataatcgtgatacgccttccttatagtgctgttttgagaataaattaatacatgtgaagtctttagagtacttccaagcatataataagtgctctataagtggtagctattattaagatggttaagaggaggagacattcagtttgtatagtttggctccaaaaggtggaactagaccaatgattggatgctatcaggagatcctttccacaaaataaaagaaaaattttgttaacaatcagatctgctctaatatcagatagactgcctttaaatggagtgagtttctgtaattagacgcattcaaggagagaatggatgaacatttttagggattttgtacacaggattcagtcatcaagatgggcaagatcatgtttcatccctggattctatgattccagagctaagatcttctgatctctcagccaatcctttttcatagctccatagtggtacagagatatggaattcccatagaattgggcattccatggatgtgcctccatataagtgagcacataagcgattgtgatgtcacctagattctcttggacctaagaatacctataacagtgatgatcattatatttgaaattcttttttttttttttttttttgagacagggtctcactctgtcgcccaggctggagtgcagtagcatgatctcggctcactgcagcctcaacctcccggactgaagcaatcctcccacttcagcctcccaagtagctgggtctacaggcacatgccaccacgctcatttaacttttttattttttgtagagacagggtcttaccatgttgcctaagatggtctcaaactcctgagctcaagccatctgcctgcctcagcctcccaaagttatgagattacaggcatgagccactgtgcctggcctcagaatacccttattaaatgacaaataatttaccagggaaaagttacatactcgaattctgatacatgaaaacaaattagtttctcaaaacaaccttgtttctcagatcagctagtaggaatccaagagagaagacataaaacagtgaagtttagattggggactgaagggaaggaaagcaacagagatagaggcaaggcatcaaacatggaattgtacaactgaaacagaacgttgcttaagatgaactttgccttctttgcagggtaatgtaagtcaggacattatgtaaattaatgtatgtacttttatgagaatcagtttttaaagatcacagtattcacacttccaaataaacagagtgactcactactgaatttatgaagaaacttgggtagtggtgagttgctttgtttacttgggataaatgtgaatgtactaataaccagaggtaaatcacaagaaattttccatatggtatggatatcaccattattaggtgaattaatcaaatagtaatgtttttattttgtagcatcttatgatttatagagtgctgtcacatagtttatatcctttcctcccctggatagctgatttataagccattaaattaaggaacatgggggaggggtgcaggaaggaccatctgtgaaagtatctccttaaccaaagttgactttgctggtcttggatccataaacatatctgctctcccctctgtacatctcttcaagtagacctatcagatgtaaaattcacacattctgttagatcacataataaaataagtctttaaatttgcaacataaaattttcaatgtactaccaaaaagtatcttcgtgatgtataaatacatttctccaatggattcactgaaggattctgtggttaaccgagataactagatttggacataagaaaaccagcaaaggatttgtgcactcagacacagatgcaaaagctataggtagagtcattttataaatctgagttatgcttaaaatgtggacttcagttttctagtaaattatgaacatcctcagtaaattatgaatgttattgtaatggtgtgtataatatagccccatctgaaaataataatgtgcatatatcaatcaggcacctaatttaaaagaagtaatgctcttccctttcattccagaattatttggcagtggcagtttggaaatcctatcagtctttcaagactattgtctaactgaaggatcccctaacctaacaaagttttagaacaattggtctagatttcaaaaagcaagacagccggaacatgtggaaataattcaagacctgggttcattgtagctcgcatttccaaacaaagttcttttcaatttctagggaaaacataaaaaaatggagcctcaaaactttccaagagcccagtggaagtgataaaaattcaaagcaaaaagtccaaatgttagtataaaaagattctagaaagcacggggatacttgtaagagtagagttggactctgtgttcccacccatactctaaccaaaaagagtcctaaaaaaaaagaatagcttgacaaagttaaaaagaaatttgagttctctccattacagctgctatgcaaaccaatagacctgcagagtaactgtcttagcaattcagtaactccaaagtttaatatagatggtagttgctttcaacaactgcagatataaattgtgtgtgatggtacacaccaatagtcccagatactcaggaggctgaggcgggaagatcacttgagcccaggagtttcgaggccaacctgggtacctatctcttaaaaaaaaaaaaaaaaaaaaaaaaaaaaaaaaacctgaagagaataaattataagattcatattccaattaaaatcttgtactgctctatgttaatgatccacattcatgaaagaaagtgtttggggccaggcatggtggctcacgcctgtaatcccaggactttgggaggtaaaggtgggtggatcacttgagccgaggagtttgagaccagcctggacaacttggcaagaccccagctctacaaaaactataaaaattaaccaggcatggtgctgcatgcctatagttccagctacttgggacgctgaaatgggaagatcacttgagcccagaaggcagaggttacagtgagcggagatcacaccactgcactccaccccgggcaacatagcaggactctgtatcaaaaaaaaaaaaaaaaaaaatctgtttgagacaaagaagtagtccatcatattggctttggagctaagctctacctttaagaatcaaggaagctttagttgtaaagcatatttcatagtgattataacccaaaaatttaaagtagaggcataaatgaaagacgattgtactgtaattagatgatttggatccagttttgtttcctctaaatgcctgtgtgtccttcaacaaatcagttaatttcacaactgtctatttctttgagtttaaaataaaaatgattttttctgccttttgatgtaaacgtatgatgcatgtgagagcttttcagaagaggcaaagtgttacttaattagaaaaattaaaaatcctcatcattattacttttcgcccctactacccaggagacacttagtttctttgctctatttcctgtctctgaataatacatgcttgacatgtgtccttcctctttggaatttaaactctgaaactcctttatactccttagattgctcttgaatattcttcataacaagaatttttttatttcttaacaatttttataacagtaaaagaaaattgctcacctaaccactctttatccactgctaaacaaaccacggaggacttccttatctctaggagtttctttcattcacttactgcagcttcataaaagttgtgagaaaggaaactaagagttaagggcatgtttgaaagcaacagaattagagagaaaaaaacaaagataatacaaaccatcctgtcagggaagaaagcagtgctcccctctacccccttcatcaagagaaaaaagcagaagtcaaataaaggaatggaaatgaaagggaaagacagagaatacaagaaggataagccttggtgtcaacatggatgtggaaggcaagcaatagggcaaattcaaagataaccctggagcagtgtgatccctacactagcagcatgcaaattatgttcccccacccttcacccccaccccagacatcctaaatcagaaactcaggcaatggagcctagaaatctgtgtaacaagccctggttcatgctgaagttgagaatcaattccctagagaggtgagcctgggtaattagaagaatggcatcaggttgcttttgttacataacattttttaaaattccactaataagaatctgtttagaaaaagtaaatcaaaattatggatcaaagcttgattttgtagtggataaattatatcacagaaactaatcactcacatatgaggtaagttgagtcttccaaattacataggtcacatggcaaatgtatcccttctggtatttagcaggactgacttgtattattcatatcatcatgtattatctttacaccttccctttagaatgtaaactctgtgagagcggaaacacacacacacagagacatacatttcacacacgtatatatacatgtatatcacactttcacatgcccattcatttggtcaatgtgcacattcaccgaaaaccacctgatctccaaaaactattgaaataaaataaataaaagaaaattttaaaatgtgaacacgctttccaggagaatttaattcaagggacttatacacagatacattcttttcacagcaagagttttaaatttctttgttttttctctttttttatttgctatagaatatattgtacacatatctgtgttcacactttcgtgttttttttttacccacaagagataaatattttggcgttttctgaatcatattatcaacagcccgttcactggtgactgtttttagcccattggtatcctctgcacatacggtaattttgcttattactttgagaagttcagctatttcagccatgaattcagtgtaaatagacatagtaacaatagtagcataacaatgttggtgattgggccataatagtcatatgaagataatgtgttaatcctcatatggagcttggactattaattatatcaagccagtgggtgtaaagtaacaagtataaggcttggagtgagaaggccatgatattaccactttctggctgagtcactttggctaagttctgtaactgacctaagcctcagtttttcagatctgtagtacttactttacatgattgctctttgaattgaataacataatttatgtgaaaacacttaattatgaatgctgtaaaactatcaaagccattaatatgtgttatagtagcatcatacattttgcagcataatccagagaacaaggagttgttaacaagggagaggaagataatctggttgggctagtattatactctcaggtgctactgacttcttagatgaccttcaagatgttagtacaactctctacttggagatgctattttctggggatgttaatatccactctattcacaaaattttaagaaaagtcaagtagcatggatgaaactctccaaagttctgcttaaaactaaaatatcttagttgtcactgaagccacagatattttgtgaatgcagcatgttcccaataggcagtccctcttagcctcacagtccaagctggcaacaggatcacatcccagggaatgaacagaaaggctggcaggcaatcacaccgctgatatctcaggtgtgtgggccccccattttttttttgagatggagtctcactctgttgcccaggctggagtgcagtggtgccatctctgctcacttcaacctccacctcccgggttcaagtgattctcctgcctcagcctcctgagtagctgggattacaggcgcccaccaccatgcccagctaattttttgtatttttagtagagatgtggtttcaccatgttggtcaggccggtctcggcctcctgacctcaggtgatccacctgcctcagcctcccaagttacagggattacaggcgtgagccacggtgcccagccgtgtgggcccccttttaaacagacgtctcttgacggagactagactctgcagccagtaaaagctccatatgattccatctgaatgtacttccattgttaatatggaaccttccccattttctggtcgtgtcttgatgttccccattcagaggacctggactttcaagtgttccttctgctttcctcaccagtggccaccttctgctacccaccttctcctctttctcctccttccttgctgcctgctgtctcatcaagcaccctgtcttggttttttgacccatcactgtactcacgaaagaggagggcattgtactagggcagatgatggggaggcagagagaacaggagagtcaggtaggaacagtgcttctgaaaaatctcctgataacagcattcattgtctttttcacagctcaggagaagccttggttaaaatgaggggaaaaaaatcagtagaataagtgggttcttgctgagcccccagtgcaagaggttcctattcaaaattggggtgtctttacccattaggatggcttttacttgaactttgtgagcttcaggcagaaccctctgcatcttctaacctaagcaggatctttcttcctttttttttttttttcacttttcagtcatggtagagttaagtgtcagagctggtccttgagaagaaggtgatgagcaggcattgaaaaattgagaaaaacgtatacttttaccacgcccaacacccttggcaaggcagtaaagggcactgcctccccctcagtttcttcccttgctgtttggtttctgtgcctccagtgctcagtcacgggtttcctaggaaatcctctgtctgtgctctgtgctgacattttatccatataccacttcttgccattcgcatatgtaattgagagagtagacgatacctttaactctgaattacatagctgcaatataatcacttgttttactgattatctgaaataattttttaaaaattcaggattgacttccatatgccatgcaagtcattttgcagttggtttcatttatccttggttcctttgtgatgaatggaacagtttaatttttcttaaaatgaccacatgctctgtactaagtgctttatctcttcaattttcaaaacgccttcacgagacaggtacttactatattattctcaagttatagataaggaaactgaggcttatagaggttaaatgacatgcccaagtcactcagccaaggaaatggaattcatatctgactcctacatctgtataggcccaaaatggatcatttaaagtgaaggaacttatatgaccttccccttgatgttataattcaattatccactttttactttgtgtccccttctgacaaatcagacttgccattcctgaccataggcttaaacctggaaaaccatctctgaccatttatcttcactttttgtttctttacttggagagcaacaatcgacagacctcatccattttatgcataatgtctaaaaccattttgggattgctgtaagtaatatgcaagaaaatagtgggaaaaaaaattttcttaaaacacaatcattcattcctgctgagtgactgcgtttcaaattcatacagaaatgaaagttgtgagcacctcactaatctgaaaatataccccatttagtaagacagtttctgaaatacctacacttcaccatcacagcaccttaataattatagagagcaccttcctttaaggagctcccaagttctttgcaaacatttctctttattaagtaacataccattgttctgtggcagggaagggaacaggatactttgtcttatttaaaatgtgagactgttaatgcattcagtgactaagtaggttgcccttgggtcattcactgacaaggccaggactagagtcctcaggggttgcagtccaccacggactcaggaccactaaatccacaaaggaccatgtgcaactgcctggtccaactcttcacatacagaaaatgaaataaacccagagaaatgaaaacacttaaaaagcccagggtcacatggataattaatggtagaaccaatactacatgcacacaaacaacatacctatatatgctatagagagaaacatgacaactatgaggaatcaatttatagacagattagaagagtgtgaaaataaagtcttcatcagtgaccttgcctcgaggaaaaacacacagaaggtgaaagtttcaaacagcagagcattttaacataggtgaagtttcaacttcttagcagccaaaataccatctggaatttaaggcacgcttcccataaaaggtgacaggtggacatgttttaaatgatagttggccagcctatcatagcctctataaatcgtctgaaagcatgaggatagcaaagaccagctgacttccaggcatgtttacagctgacagaaatgtttcagctaaaaacatgcatgactgtctctcttagggaatctcttacttcaaaaaaaaaaaaggtaccaatgtaaacactatgcatagactgaagtcttcagcaaattgagattattagcaatgaggcttccctaacctttcctgttttaatctaaaagtaaaattatcttctaaccatgtgatcttacgcagcatactgtctggtcagtgtgcttcaaaacatatctgtttatgtttgaaaacacaataacaacaaattcctgatgagagaaagtttaataaaatggatcatgaacatacagcacttaataccaaccctgctacatagtcagcacttaataccaaccttgcttcatagtaagcactcaatacatggtgattgttttcattgctgctattaccataatacatcaaagctctcctatttcataatgggaaaaaatgaaaaacagtcaaggcatatattttaagtggaagttagctcaaattttaaaagacttcttaccttgatgcatagtccaaatgttgaaatattatcctaaggagtttcagaggctttcagttttagtttggatcatggaaggacttttttctctgaggtgagggcctacactgggcagtcaggaatgaggtggtagagatggaccaaacacgcagttcatctcacctgtcaggagcagagctgagaacaaacagcacaaagaaaacaagtctttaagtaatcatcttaaagagatgtcacggacccatggactttaagaatacctcatgcactgagtattattatttaccttactgtttgtaacaaacttgatcatttggtttctaagccaaaccaaagcagtaaactgaggaaaaacaagggtttccgccaacaggctgagagcaaaggaggacgcaggaaaactattttaaaaattgacccaagagttcaaaaggcatatggaagcatttaatgggggtgggaggtatccttgtaataagaataccatgcatgtattcccacactgctcttggtggtctgcaaagtgatttcatatgtattttatgtcaacaccagcacaatgaggtaagtaggactgtatacctcagaggcatttggtgatttgtcagagtggagtgtagtgtgttggtgcccagatttgaataggatcatttgagtctgatatcatcatgttgcccaccgcctactcagcctctacacccgatgaggccaatctgcagctcactacagtcaatagagaacaggcaattaacccttaagttatattttagaaagatttctgtctaaaatagataaacttgaaagtatagctcttcaaaataacgtattcctgtgttggcaaatattttccaaactcacaatcaacacataggtgtatttcttagactactagaagtggggacttaccccaaggaaccaagctatagtgaccaatatccttagttctcaaggattctagagcaccccatgtctccaacgatctttcttctctcttatttcttctatttgtttgataatgttaatgggaaacactaaatcccctaatcaggacactgaaagtgacccccttcaaaagtagccctcccttttccacggagtgaccttgaagacttttagtggggaatatctggtagctttccaagaaagccgttttatggcacagggaaatggaaaacaaaactgtcctggcatcaccataaagcaaaatttctctgcacatgagaggctaggagggcctggatttttccaaacgaggatgatccattaagcaatcaaattttattttttaattgttttatttttcttttttgttgtcttgtttttcctgtccttcattctctatcccttgctatgtctcgctctgtcctgcttgctgtctcttcctacatcaacaggtgagaagccccaccaatgcagcatctgttggcgctccttctccttaaaggattaccttatcaagcacatggtgacacacacaggagtgagggcataccagtgtagtatctgcaacaagcgcttcacccagaagagctccctcaacgtgcacatgcgcctccaccggggagagaagtcctacgagtgctacatctgcaaaaagaagttctctcacaagaccctcctggagcgacacgtggccctgcacagtgccagcaatgggaccccccctgcaggcacacccccaggtgcccgcgctggccccccaggcgtggtggcctgcacggaggggaccacttacgtctgctccgtctgcccagcaaagtttgaccaaatcgagcagttcaacgaccacatgaggatgcatgtgtctgacggataagtagtatctttctctctttcttatgaacaaaacaaaacaacaacaaaaaacaaacaaacaaaaaagctatggcactagaatttaagaaatgttttggtttcatttttactttctgtttttgtttttgtttcgtttcattttgtactacatgaagaactgttttttgcctgctggtacattacatttccggaggcttgggtgaataatagttttcccagtctccctcggatggtggccttaaggcctggtagtgcttcaagaggtccactggttggatctctagctactggcctctaaatacaacccttctttacaaaaaaatctttt

SEQ ID NO: 36749 - DNA, 4223 bp, Homo sapiens
tgctcagcccccggggcacagcaggacgtttgggggccttctttcagcaggggacagcccgattggggtgagcgtcccccactccttccctccaggcctcacccctggtctggctgggccgcctattttgggagcaggagtggccagcccgaggcttcccaggcaggccaacccaagagggagggagtgtggttgaggcagtgggttctgcagggtgggatgtgggtgactcctccctgccctgctggtgcgtgtgcaccctggcagggtgtggagttgggacacacacgtgtgtagggctggttgcgtcactgcgtgggggcaccggaggcccagaggaggagtattggatgcctgacggtgtttacaccccacgtcctgctccaaccagcagtttggggagaggttgttgttcatgtccattccggccccactgtgtgtgtgtgtgtgtgtgtgtgtgtgtgtgtgtgtgtgtatccctgccccagcatgtgttttctatctctaaggcccactgggctgggcctcatgtcacttgcctgacatccgattgtgaaagatgtcacccagaggcgggcagaggggctgtcttttccttttctcgttgctgcccagggaggagacggggtgacctttcccacaggggcagcctgtggcgatgtggcagctgggcctcaccccggcagggctgtgcgtgaccccctgagtgggggaaggcaggctgttgccatggtggcctgagcgagcagaattcctccagggtgaagtgggagatatttatacccggggtcaggccgcgagcgggcgggcggagagggcagggagctgggatttcgcggggcacagtgaggccgggcatgtaggcaggtgggacttgggcgtgccctgctgtctcctgctctgtgtttgtgtgaggcagcgcctcctctgccctgccagggtaggtctgggaatcgggggcctgctgcgggaggtggaggcccaagggaggccccccggggactgtgtgtctcacccccgtccctgctacgttgtgttgttgtgtgatcccatcgtggaggttgttttggtgacactgtgtccccacgaagctggggatacccgtttctctagcttggagccaccaagatagaggacaaacacttctgtgattcagtccccagactgtctctgacttaatcccttgggttcaagccctatgtgggagagcaagggcacacactgcctaatccgtggtgtcccccccaggacaatggcgtctcttggccacatcttggttttctgtgtgggtctcctcaccatggccaaggcaggtgagtgcaggggaggctgcccgctacccacctcagccccaggggtggcggtggggaccgaagaaccaagttggagaccccaacctagactaagtcggctggggtaccaagaagtttgggggtctccacgtggggtccagtcacaggctggtatttgggggaggggagaggaagccccagatcaggcaaagatggggtgggatggggctgaatccccgatgggataactgggtcacagacagcctgccgtgagtcagggagctggggcagttaggtgccacctgccccatctgggacagtgcagagggggcagctgggacccagagagtgtgggcagcctgcccagacaccctcagactctaagcccagcaaggcagagcctccagtggtctcctcatgcccctccctgccaggaccccaggaagcattcaacccctgatttctctctctttccagaaagtccaaaggaacacgacccgttcacttacggtgagcggggggtctaattttgagtcctgggggagagcctggctttgctggtcctttgattccccctcgccctcccccagagtcccagtattgatatctctgtcattctccttccctctattttgtccttcctctctgattccacctgtctgcatcttttcctgtctgtgtctatctgtgtcactgtctatgtgatacctctctggttctctttctcttgcctgcgtctgtctcagcatctcgtggcccatcctctgcttcttcccgtcttctctcccccctgtcctcctcctccctgtcccctccctccctttcctatacacccctttcctctccctggtaccccactttcctcctcccatatctgctcccccttaattatcttacttccccccttctgcctgctggtcctttctccctgttccctccttcccaatttacccctctcctattctccctcctgtcttccctgccctcaccttccctgctctgctgctcacagactaccagtccctgcagatcggaggcctcgtcatcgccgggatcctcttcatcctgggcatcctcatcgtgctgagtgagtgcccctagctcccgccctctaccccgcctctccctggccccacctctctctggccccgcctctccctggccccgcctctccctagcccccctctccctggccccgcttctccctggtcccgcccctccctggccccgccccgccccaacccctcccaggccttgccccgcctaccctgccttggttccccggcccccggtctcgcctctagccccgccccgtcccccaagccccgcccctcgcgagggcgagctggagctacagcgccgcttggcgcccgccgggagggagcctcagcttctcctacctctccacgcccacaggcagaagatgccggtgcaagttcaaccagcagcagaggtaagacgcccctccccgccctccttcgcccgctcctgctctggagggcgccgcgggtgaggcggggagtacccctgacccgcagcccgatccccgtcagcgactatgtattaagcacctactatgtgccatggcccaagcctggccctgggaccaagcgaggaaaaaacctcccgcccttcctggccgagctcccagcctagtggaggcggtggccgtgggttccaacagccccacagatagaaaaatcacaaagcgtgataacacaaagtgcaggaaagaagaaacggcggtgaaatgagatcatctcacacgcggcccagtttagcttagagtcttgttcctagctctttgattcctcttcgaataaaatgttaaagcatggacaatgtatgaatatgttagaacaattatagatattatcataagtagtagctaatatttactgggtgtgtaccacgtgttagatacggtttcacttcctctgggagggaggtgctgttattaaccccatttgacagatgaggaaactaaggcacagggaggtaaagtcactttgttcaagatcactcaagtggaagatggggggttctgggtttccaacccaggccatctcatggcagtctgccaagtccccatgactatccctcccccaccaacttcacatccctgcccccaaatccgcggaggtactcactgttaaccagcttagaagccccctgccagcacataagctgctcctgggtgctcctcatttctggcggaccccgagcctgctcttcgtccatatctgggcctagttacaccaatctgggaaaggaggcttgtactggggggttcctagaagggcagcctctccccctttccatcccgaaatccctctgcctctgtcttcccaggactggggaacccgatgaagaggagggaactttccgcagctccatccgccgtgagtctggggagactgcgggtattctggggagagggctggttccaaggaccgcttttcccggccctccctggctgcgtagagggaagggctggatctgaaagcggagggcggggagttgccccgccgcgggccccacctgcccaggagctggggatgcctctccagaatgacccccgatctccgtgttccccccaggtctgtccacccgcaggcggtagaaacacctggagcgatggaatccggccaggtgctgcagctctgacacggcggtgggagggaaggagggaggaaggaaaggcgggagagggagggggccaagtgccagagttgaagggcggcgaggggtggggctggacgtcccccctcgcctctcacccttttcaccctcacaggactcccctggcacctgacatctcccacgctccacctgcgcgcccaccgccccctccgccgccccttccccagccctgcccccgcagactccccctgccgccaagacttccaataaaacgtgcgttcctctcga

SEQ ID NO: 36750 - DNA, 48746 bp, Homo sapiens
ggaggagggagagagagagaagagaagaaaaagaaaaaagaacatcaataaaaagaagtcagatttgttcgaaatcttgaggtaagacttttaaaaatcacattatatataatagtatcaccatttgtatcagggcctagtacatagtaggtcctcaaaaaaatctgctattgaaataattaatctatcgaaatgaacaggagggctgggctaaagaaaaatttcaatgtgaaatgctggtcagaaaaaacaagaagaaacgcccgatgagctttcaaatgtgtaggagggatgatatgataagatgcagatggaaccagaagtctcttgctggcactgacagcattctgatcattgtgggacagaaagtcaagttggaacaaaaaagttgcaaagatagtataaaaagtgtctgcatgttcttttggaattacagaaagacagcaagaattatagaaatgttgtaagcagtttttaaaatcggctttaaaccaatgacagagcacaaacactatgctgtatcttgggaagtacttaaatgtgctgatacctgcatgttgcagccaaacatcagccagtttaatgttattaacatttagatctagagtgttgaaaaggctcattttatttccagaagtcttgttcagtggaccaagggaggcctaaacgtgtccatcaaaattcttcatgtgctattcatctatcctttaatcctagtccagctgggctgctcagaatactgaccctctgagccctaaacgggccttttcagagaaaatcccaacacttgtttcaggtcaaggaactagagaaacctgacaggaaagggaaataccattccccaccctcaccatttacccaaaccttcacttgccatcaatagaccatatcatccagagggttgtggcttagtgatccactcactttggagagattaaaatagctggatgcatgcttcagaaaacatctacagacgacgatgatgtgttttcacaacagttggcttttaagagtccaactcctctgacttttccaacagagcttaccagtatcagagggacacaattgaagtgtttccttcagagccagtgtttctctttggggtttgtgtgagttcatcagagtcggaagctgaaaggagggtgggaaaggtaaggagagatgaaacaatctcacttctgctggcttgccaaggtttgaaaggaactgcctccctgtcattaggatgatatgaaaataaaatctgaaaatcctagctctttctttatactaatttgagtacagctaaaagttctctgtgtccaatttctgagctagaacaaatattaaaggtaatctaatttatttctccttgtttgccagatgagggaattgaagccaagacaagggaagggccttgcccaaagtcacatgtattgtcagtgatgggagggagactggaactcagttctcccagagtcccacccaggagccttttaagaaatcatgaaaactttacaagaaggtaccccagatgtccgagagctcataaacaccgcagctgctgactaaatacaacattcagttaaaagatgctcaagtaatctttccctggcagaaatagaaagaagaaaaagatttccccaatagtttagtttttccagaatctgttttataactgttaggagactagggaggagaaagatttgaggcagatttgtcatgagagaactagaatattttacattcctaccattgatcagcattttacatgtctcatttctttatgtaatcttcatattatcctcattttacaaataacattgttttaactttgctcaaatgcacagagggaataagatattatgatttctggagctcttgttggtaagcccaggatcaggctctggagagacatggctagttcagtgactgttccagccttactcaggcccctccccaacacagacccttgctctagccattcaggctacctgagttgcctccaaaatgccatgctttctagacttcttgcctgaatacatgcagttacctctgcttgggatgcctttctccaacatcctcataacttgtacttagccttcaaaactgagctccaggaccacctcccagagccctttcctgctgccatggcctgtcccttctctacttcaacagccctctacacacattcctattatagtatacatcacgctatggtgagctctgacttacttgccaactttccttgtgcttgacttcaaactccttgaaagcagacaccacatattagtgaggctttgtattcccagcgcctagcacaattccagagatgtattagtgctcagtaagtatttttttaaatggacgaacaaatggaatatttcccctccttttcttcgaataaaaccatgcaataaaaagtcttgtttccatgctcttgactcttcagtaacttgggggtaagtagaagatatcactactataagcttcctctcctttcaagcctgacaagccactcagaaatagctatctagggttaaacttggcactctgaacagacattaatttctgcatcctgacaaaatgctttgatgacagtagaagaatttatatgccataagccacaaggacaaaaagactgggaacatgggaacaacagagataacaacagttaaggaatgtcaacactcttggaagatggaaagtggatggatgagtaataagtgacttagcaaacccaagactgctggagtctgagtgctcatgatgggaagcctcaggagttggaggaacaggtgggggtaaacatagcagaagacccttggcctctacagctactccagctggagaaggaaagtttattttctggagaaacttaacaaagacacaccaggctctgggacatcagacacagcagagggtggggttaggcatggagctggaaatagcgagattagagaaagactccatactgaaagatgagattccccagcccattttactggctcagctcccagaacacaaacagcctagctctacccctctccacccaccctaccccagcttacactaagcagaagaattaaggattcttccctgtagaaaggactcaaccaaagagacaaacactacagacattgatgtgtggttcctccaatgaaaccgccaggggccttctggattatcctacagtgaagtccaaaaattgacaagccctgccctcacacacaaagcttccaacagccaaggaagagactacaaagatcaccaggtgatatagtttggatatttgtcccctccaagttgcatgttgaaatttaatccccaaggttggaagtggggcctgatgtgaggtgtttgagtcgtgggggtgaatccctcatgaatgacttggtgccatgctcatagtaatgagtgaattcttactctatgagttcctgcaagaactggttgttcaaagagcttggcccctcccacccctctcttgccatgtgatgtctgctcctcttggacttctgccatgagtggaagcagtctaaggccctcaccaggtggagatgtcggcaccgtgcttcttctgcaggctgcaaaaccataagccaaacagaacccttttctttaaaaactactcagcttcaggggttcctttacagtaacacaaacagactaagacaccgggcatgggacaaaagccttagatactggagacctcaagagaggaaatctagaaagccaaagaaataattatcagtaacggccacagcaacatcaatatcccccagagataagggaagatatttcatgaattatgatcaagaagccaatttttggctgaaaataaactttccttctccagcagtgtctcatgcctataatcccagcagtttggaagactgaagtgggaggatcacctgaacccaggagttcaagaccagccagggcaacatagagagaccccagtctctacaaataaaaaaattagcagagcgtagtggtgcatgccaagctacttaggaggctgacatgagaggattgcttgcacataggaggttgaggctgcaataagctgtgatggcgccactgcgctccagcctgggcaacagagtgagaccctgtctcaaaaaataataataataagataaaataaagaaccaatttttaagtatggagaagaaaaaagagctctttaaatgaaagcgcaattggacatttaaaaattaaaatgaagggccaggagcggtggctcatgcctgtaatcccagcaatttgggaggccaaggtgagcggatcacctgaggtcaggagttcaagaccaacctggccaacatagtgaaaccccatctctactaaaaatacaaaaattagccgagcatggtggtgcatacctgtaatcccatctactcaggaggctgaggcaggagaaccgcttgaacccggaaggcagaggttgcagggagccaagatcgcgccattgcactccagcctgagcgacaagagtggaattctgtctcaaaaaattaattaattaattaaaattaaacttaagcattggaagataaaattgaggaaatctcccagaaaataggatgaaatggaaagagattaaaaaaataagacatagaaagataagaaacttaaaagatcagctcaggagctctaatatcttctattaagaagtccaaaaagaaagcacagagcaaatgaaagagaataaaatactcaaaaaaatttctctaaaatttaccaaaatacaagatttgaatttccatattcagtggacccagtgggtgcccaacacaatgaaccacaaaaacaaaactcatcaaagaatattattggaaatgttagaaccccaggaataaaaggaccccaaaagtcctggagaaagaaaaatagttcacaaaccaagggtcagaaatctgaacagcagttggacctctcagtgtcaacactggaagctagaaactgaaaggcaagacagcaacatcttccaattctcagagaaaacttacctagaaatccttacccggccaaaaaacaatcaaggagaaggtaatacaaggacaagcggatggggctgaccagaactgtcacactgtcctttatttggccggggtcagatggattaatgccctcttaaagatgttaaaaatgtgaaacatcactcctgcatacaaggtctcaaaacatttccttatcatacatgaggaagtaaatcaagaaagagaaaaacgggagttcccattcccaaaggaaagtccccagattcagggaacaggaggactaaagtcttcagtaaaatgtctccaagaaaaaaataaaggagctcatagattactcaattaatttgacctatttatttgaattttatatctcttgtcagagggtttgaaggacctgtacaactaagaaagcaaacaaatcaaaatgaagtgattattaactcccaggaattcaatgaagactagaagaaaagaaatgcatcatagtatactatattgttcagctgtaaacaattaatcataataatacaaacactattgatttaattaaaattgtgttattataatattaggaatctagaaaaaagggaatgggtgtttgtgtgttgtaaaaacgcaaaatcccagtattccttagcaggaaatgaataagtaatttccaaaattgcaaaatcaaatagcagtaaaagcacatcgtttacaaatgtggagttggttttcaggggaaaataaattaagatttaaaagcgatttgcctgtcagtgggaccagggctgagaaaggaaagagcaaggattgttgtcactagttgtaaaccttttgtactaggtgactttttaagccctcctcatgtattatattaataaatgtaaaaactagtttatttaaaaaaaaaaaaaaaggaaatggctcagttataacacagcagtctcccagggaatacattctaccaaccagtcagcatgttgatgtctggagccattaagtctctaacaagctaaagttaaaagtatttacctaattacccaaagtagaagttcggaccggtatgtctacaggttactttagaatcacctggggactgtcaaagaaaaccagagctagagagcagttaaagtggtaaaaacaggttttaatcgggactattgcaatggaggaaaagagatctcagtaaagaactggactcaattccaaatacaccatgggaagtgagtgataatttacactcaaagagcaggatggtgactggtggatggaaaatttctaagaggaaacatcaaggttggggtaaggagggttctggctgaaaggaaacaggattatttctgaagacaggccagggtggtcaggcaccccctgggggatgatggcaaatgaaaaaaccaattagagatcaaggaatcgggtattaaaatggcgggggggggggtgggggctcggttcttgctaaattgacttagcaggattctttgtaaaactggattttacaaggaagtgcccagatgggcctagaaggttcaggagcctgactaaagtttggccagaaaaatctttgtcaggaactttgcaaaaaatccagattcctaggtcccacccttaataagccagactcaacaggatttggtggggtctaaggatctgcccttagttcccccagatgattcatggaggtttgggaatcactggactagagtggaaatcaggagtgtgtgttaggaggagcaagggaatcagtttacatgtattttatgtgtgtgtaactatttctgtatatttaagtctctctccctccctccttcattctcttttattttcagttaacccataaatccctctggactgctgacggcattgccagaaattaagtagccatccgagctgtctctcccactcctggggctccctctgctggcagaagcatgttaaaattcttagcatcctaaatctagaaattctcgttcagttccctattaggtcagttttttgagactgttgccaaaccctcaaatttcatgaatcctcccatcagatataaaatacaaagtgaagcctgggaaaactttcttgccttaaatttgtgaatatataaagattaggagggagcaggacaaggcagaaatgaaaatgaaaggtatatgctgtggtcaatactgaggaagaggagacatttgagaatttaagttcccaccttcttcttcctggccctcccccaggagatatgaatagatggggaagctgcatgtagctgctttccaaaaaatgcaaagaaggaaacaagttagactaaaaagctcactgaatttggaagcagaaggcaaggattcaatatccacccgtcctctacttcctcgattctcaaaagaagtggtctccttttccagagccatgtgccatatcatctggagtatgactccataaatcatatccttccagtgatcttgtttttagattctactggatctttcccacaaacagaaaggatgctcagcccagcacactgtctggcacaaatgctcaatgcatttgagcatttgaatgaaagtttaactcatttctatcccccaaatcaaaaccctctttcagatctccatgcttctcaagtgcctcaaaattgtggaccagtaaacattgcattccctcaggtacttcactcttcaactcacagcatttccactttagctcctctggaactctcaggcaaagatctccaatgattcctttatgccagaccccctgtattcttggcacttctcaccttccttgacctctcccatctcactgagacctgttcccttgggttctgtgctctctgtcctcctgctcccagctcaccgttgttctcctttgctggccctccccttccgcccaaccctcaaacatgagtgtaagatttccctcttagccttcactctgtccctggtggcttcatctactcctatggttgcaacattaacttccatgatttaattctcccaattctatatctttaacctggacctttcttctgagttccaaatacctaccagacatctgtatctggatgtataagaatcagttcatccattacacactcaaaaaatgcttactgagcacctaccctgtgccaagcaccgtactaactctggagatgcaggggcaagcaaggtggaaatggtctctgccttcccagaactatctaatgggaaaggcagacagtgaatggctaggagtaaaaagtgatgagtgcaatgattagagaaatgcctagggttcagagagcactttttctggtccccagcattccctgaaggtgtgactttgaagagcagtacctgaatgataaggaattggggcaaggggaggttcctggggaagaatttcaaaaataatgaagaacttgtaaagctgtaataggtagtttggactttatcctaaagacaataaggagccactgaatcttctgaagcagagaaatgtgctgatcagttgtggtgtgaagaactggatggattagagcccaaggggaacttcacagtgctgggatattcatgtcttaagttggatggtgagccatgaggcttttgtttcatacttatgctttatacgttattcatgttttcctatattcttttgtgaataccaaatatttcacaagcttgttttaaaaattaatagattggggaaggtgaggtggccagagaaatgtgaggaggtcactaaagcagaaaacagtggtggcctgagttaggatatggcctggctctgtgtccccatccaaatctcatctcaaattgtaatccccaggtgttgaggagggaaggacctggtgggaggtgactggattatgggggttcccccataatctcatctgttctcatgatagtgagtgagttctcatgagatgtgatggtttaaaagtgtttggctgttcccccctttgctctgtctctctcctgccaccatgtaagatgtgccttgcttccccttagccttccaccatgattgtaagtttcctgaagcctccctggccatgcagaactatgagtcaattaaacttctttttttatataaattacccagtctcaggtatatcttcatagcagtgtgaaagtggactaacacagatggtcacaaagggtgaagatttggagatggttctagagatacttaggaggtagaatcgactgtacttggtgattaatggaatatggagagggaggaataaagaactcctaagtttctggattactaattagacggatggtgaagccattgattgaaatagagatcaatgggaaatggtgagtaaaaataacagtcattggagaacagtttggcagtttcttaaaaagttaaacatggctgggtgcggtggctcacacctgtaatcccagcacttcaggaggctgaggcaggcagatcatgaggtcaagagatcgaaccatcctggccaacatagtgaaaccctgtctctaataaaaatacaaaaattagctgggtgtggtggtgcaccctgtagtcccagctactcaggaggctgaggcaggagaatcgcttgaacctgggaggtggaggttgtggtgagccaagatcatgccactgcactccagcctggccacagagtgagactccgtctcaaaaaaataaaaaaaagttaaacataaatttaccatatgacccagcaatgccactcttgggcatgtacccaagagaaataaaaacatacgttcacacaaaaattttcataccaatgttcattgcagcactgtccataatagcaaaaaacaggggaaaattccaaatgtctgtgaactggtgaatggatcaacaaaatgtggtacatccatacaatggaatatgatttgtcaataaatgacacatgttacaatacggaagaatctcaaaaacatgttaagtgaaagaagtcagacaaaagattacacgttgtgtagttctactaatataaaatgtccagggcaggcaagtctatacatggaaataaaattactggttgcctggggctgggggtggaaacagggagtgactgtaaatgggcacaagaaatctttttgggagatggaaatgttctaaattagattgcagtaatgatttctcaactctgcaaatttattcaaaatcattgaattgtacacttaaaatgagataatttgctagtatataaattgcactgcaataaagccgttaaaaaataatcatgtcagtttcagcatgatgaatttgagatgtttaggaggccctcagaaggagagggtttgggtaagcaggtggttatactacctgaagcttaggagaaattgctgcacaggaaatagagacttttaagactcatccatcaacacaaaggttgtaattataaccatgagagagaagggaattacgcagggaatacagacaaaaaatgagaaccgaatcaaggccaactccaacattcaaggaatccagaagaaaagataagcctataaagaaaactgagaagcagtgagagaaacagaaagaaaagcctggtgactatgaattgacagaagccaagggaggaggatatttggggaggttaaagtggcaagtgatacttaatgagaaggatcaaagagaaaaaaagcatggtagaaaaatccagctggttatagggcagcccaataacattgctgggcatagctccaggggctgcaagccctcagggtcaaggccatacccagcacagcctggcaggaagagtgaagtgctgatggagggtgtgaagctggattgaagagctgaaagagtgcagaagattcagaattttttgcataaggcaatgaggggatacaaagagccaggggatagagttctgggatggggatgaagaagccacagagggcaaagccttcatgacttgagaacaaatggccagaactacagactccaacagtgggcattcatggccctcaaagatgtgcctctgcttgcctctccaggcttcttactgtgtaaccccaccttgtaaaattcagttatccagccacatggaactgttcatagtttcccaaacatgactttctctttcacacctctttctattttcccacacagcttcctgtgcaaagaatgttctacaaactagccctcccctctccccacacactcctgaacccaactcaatgctcactgttatcattcttcatttcctggaacattcctgctcatatttcaacatggatcaaaatgaacaacttcctggaagcagctcctgctggcccgtcccacatgtagaatgggctactcccttcattatgcccctactgtagacttccattagcgcactggtaatgtcttacacatttcatttatttccacgtcttcttcttctagggcatggagagcatttcaatggtgtttttattcatagtacctgaccaacagtaaatacctaactaaataaatgttagtagatgattcctccacccagctaccatgtggtatgtacctcttttgcctttttgggctgtttgtggccaggatgctgggctccactttggtaaaggtagaccagatggctatcagtaggcatggtccagaatgttttgtccacacctgagaccatttctcaggttcttaaagcccactgccacttctaagcttttcaaattaaacacagttcacccagttaaatccaaatttcagataaacaatgaatgattaatggttttgttttttccttttttttttttttttttttttttttttttgagatgagggtcttgctatgtttcccaagctgatctcaaactcctagccacaagtgatcctctctttggcctccccagtggctgggattacagccaagagccaccaaacctggcttgaatcatgttttagtgtaagtatgttcctttcaagacatctttccttcaatagtttaggaatatttctttcaacagtttatcccatcttgataggtagacagcttagatagaggataggtagataagatagatagattagatagatagatagatagatagatagatagatagatagatagatagataggaaggacagacagacaggcatccttaaaataactatttgtcatttatctgaaattcagatttaactgtatttgtcatttatctgaaattcagatttaactgggcattctgtatttctatttgctaaatctggcaaccctatgtcccaccaggggcaagtgacttccttctaatgctgacatccctggaaccttgagatgcccacctggctggggctgtggtgtcaccctagcgtgcttcctgaaagttgggctggccaaccaagaaaaaacacaagatgggccaaagccctgtggtggtcatgctgaggtcagtcctctcagctgtgtggggctctcccactgctccccatgctgccaatgtttcaacagaccttccattgaataactttgtttagttcttacatggccccctctctcttctatgctcagatgtgaatccacaggagctaggcaagagagaaaacctgaaaaactacaactacaacatgcttagaactgtctacttagatcatgcccttaaaacataaaaacaacagaatttttttgattataaaaagaactctttgcatctccatctccactgggggcagggatcagaccatgctcgtgacctcgtgagggtctcttctttcctagaaggcccttggctctcccaggcaaatagattccaggtattctaccctctcagtcccctaccacaagctacacgtgccaggcagtaacaggaaagcacacagagggcaatttatcccatgcctacttcattctcccagatccacgattccgttagctaaaaaatagaataaatctgtccattgagattgacatgaaggattgacaaatgagaacttctcccctcgttagacacacacatgagggaggagaacaggaggaagggaaggaggagggagtctgttactggacaaaattgcatgaaatgatagttctttctatagacaggaaaagatcttggcagctgtgagttctgaggaactggggtgagaatgggggtgggggtggcaagaaagggagaatcttatgcgttattgtattagttcattttcacactgctgataaagacatacctgaaactgggaacaaaagaggtttagctggattacagttccacttggctggggaggcctcagaatcatggtggtagccacaaggcacttcttacatggcagcagtaagagtaaaatgagaaagaagcaaaagcagaaacccctgataaacccatcagatcaagagagtagcaggggaaagactggcccccatgattcaattacctcccccaggtacctcccccaacacgtgggaattctgggagacacaattcaagctgagatttgggtaaggacacagtcaaaccatatcattccacccctggcccctccaaatctcatgtcctcacatttcaaaaccaatcatgccttcccaacagtcccccaaagttttaactcatttcagcattaacccaaaagtccacagtctaaaagtctcatcggagacaaggcaagtcccttccgcctatcagcctgtaaaatcaaaagcaagctagttacttcttagatacaataggggtacaggtattgggtaaatacagccattccaaatgggagaaattggccaaaacaaaggggttacagggcccatgcaagtctaaaatccaaaggggcagtcaaactttaaagctccaaaatgatctcctttgaatccaggttacactgatgcaaaaggtgggttcccatggtcttgggcagatctgcccctgtggctttgcagggtacagcctccatcctggctgctttcatgggctggtattgagtgtctgcggctttccaagcagatggcacaaactgccagtggatctaccattctggggtctggaggacattggccttcctctcacagctccactaggcagtgccccagtagggactctgtgttgggtctccaacccgacatttcccttccacactgccctagcagaggttctccatgagggccctgccctgcagaaaacttttgcttgggcatccaggcatttccatacatcttctgaaatctaggcagaggttcccaaacttcaattcttgatttctgtgcaccatgtggaaggctcaacaccacgcggaagcttccaaggcttggggcttccaccctctgaagctaaagcctgagctctaggctagctcctttcaggctcctttcagctgggacacagggcaccaagtccctagcctgcgcatagcacagggaccctgggcccacccatgaaaccactttttcctcctaggctccaggcctgtgatgggaggggctgccatgaaggtctctgacatggcctggagacattttcctcatggttttggggattaacatttggctccttgctacgtatgcaaatttcagcagctggcttgaatttctcctcaaaaaatgtgtttttcttttttacatcatcaggctgcaaattttctgaacttttatgctagttttcccttttaacatggaatgcttttaacagaacccaagtcacctcttgaatgctttgctgcttagaaatttcttctgccagataccctaaaaaacctctctcaagttcaaagttccacaaatctctagggcaggggcaaatgccaacagtctctttgctaacacataacaacagttacctctgctccagttcccaacaagttcctcatctctatctgagattacctcagtctggaccttattgttcatatcactatcagcatttttgtcaaagctattcaacaagcctctaggaggttctaaactttcccacattttcctgtcttcttctgagccctccaaactgttccaacctctgcctgttacccagttccaaagtcacttccacattttcaggtatcttttcagcaacagcccactctactcgtaccaatttaccgtattagttcattttaacactgctgataaagacatacccgaaaccaggatcaaagagaggtttaattggacttacagttccacatggctggggaggcctcagaatcatggcgggaggtgaaaggcacttcttacatggcagtagcaagagaaaaatgaggaagaagcaaaagtggaaacccctgataaacccatcagatctcgtgagacttattcactatcaagagaatagcacaggaaagaccagcctccatgattcaattacctccccctgggtccctctcacaacatgtggaaattgtgggagatataattcaagttgagatttgggtggggacacagccagaccctatcaattctcatgtaatgcaaagatcctctcctgtttcaacgttgcagtgttattctcccaggaaaggcagaacctctgaacacagtgtttacctactttttactctgaggtttgcccaacaagatttcattttcaaatgggagcacttgcttaacaaatctactaaatagtcatgaaaagcactacagctgccaccttctaaatgacaggtgtttctttcatgatcaacgttttatgccaaatgcaaggaacttcccctctggctgcccctcctcacatttttgccatctcctatcagtctccccagatctggcccatccttcacagtcccattcttgttcattcagcccctatgttcttctcactctgttgcttgtgcttgattccatttattctggtgagaatgatcaaatcagagagaattcctggctgggctctaatactcacctccagcagtgaaaagcccattctgtgcaggtaggctccaggtatctgctgaaagcctgctctggaatgggaatggtcagtgtattacaaaggagggtgcaaggagtggagtgaactgttcactgtttttctatggaactttaattcaatcagggaatacttgacttgaaacaaatgctagctgaaacagttgtatttcattttgtctttattattttttaaaactttgttgacaaccccagaaagaagatttgggggatgggattgatctgttctgaccagaatgctgaatcccagtgatttccccagattaaaccaggctccaggaagacagcaattttctcattgctgcagtatctcaaaaacactaaaacagcaagtttattgaatgcctattttggagcaaggctagtgggaaatggaaagagacaaagatgaaaaagacataatctatgtcctccaggagtttacaagctaatgagagaaccagccatgtaaatatggacacaaagtggattagatgtttattatataatatggtcaaagtgtggtccccatgggtctctgagaccctcttgaagggttgaaaggtcaaaactattttcataattatactaagacattacctgacttttccagaggctacaggatgtatgctaatgccactgccctgaatgctaatggaatgtatgcttatgtattcttgagctttagaaaaaaatcctcagtcttaatttctaatgcataaattgcaatagcaatatcaataggtaaaacctacacaggcaaaagttctttgaggtccttggaaattattaagagtatacaagggtcctgagaccaaaaatttgagaactggtaagatttaatgcatcaactaccattacacagtgtccttgtttctcatcaatgcattttatatagcaattattttatctaatcccatgaaactcactttattggatgcttttgccatatccttattttctagcatcgtagctattaggtcatctaattattaatctgtttgtgtctttgggtttaaatgtgtcttttgaggccacacaatgttggacttcattttttaatggagccaacaatcagcaattgttaatgcatttgctttgtgttctattactctgcagtttatcttactcattgttatttttgctttctttaaatttatgttttcttaatggactttaaaattctttatttattttttatgtcagacaataaacatccctagtctgcccatctttctatcatttcaacatcatcatatttccaaataacttttcattgtttcctataattttactattaatagtataggattaagaaaataaaccttatctgggttctggctggcactgccttccctctagggatgaaaatggagtgtagtctgtaatatatcctggtatcataaatatatttataaaattatacaaatgtagcttgcagttctaaaggcatgtaatctaatttttacttgaattttatcttttttctctttttgtccttcatagacctcgagctctgtctagccctcaactgttctcaaatctccattgttttctacaagtgaccctcacagctgtgggcctttgttgacaaattgtttcatctcctctgggtcttaaattattttctcttactctaaagtgaaaatttgatgaatgtttccagatactgcacttggaatcataacttaatttcccttaaccttgtgtaaattctgtccccccactactcccaactcctatccctcctccaaagcactgatacttattatcacatttaaattttttccccgctctactgataacttacagaatgcaggactgcattgtgatggggtaatttccatgagttgattggttggttttgagttgaaaaacttaacaatgatacatcttaaattctttctttgaggattattccttaatgaattcgtgctacggacatactgaggtggttatttttatatttccctgataataaattctaaattgctaagggtttcttaccaccctcgtccttttactgttactagatctatttttagctggtgtgggcgtccccagctagtttcacttgcctaatgctagttcttttttcttctacatcaggtcgcctcttcctagcatcttctccatgtttcttgttgctctacagcatttacaagacccagtttaatagtttagtgccttttttgtcactcattatttcttctttgttctctgttaaaataataagtgtatgatccattgcacttgccttagagtcttgaaccagtcttggatttcccgccatctgggttctggctggcttgcaatttctcctttgatgttgtaatactttttcattgaacttgagtgtggggcttatagagcttctttgctttcattattttttcccaaaatgtgcacattttttttcttaagcttattttgctgttttgtgctgttatttttaattgcttcccactgggtgggggggtagggggactgagagtgagatttggcttgagtttggctctctttgctattactcacatttccccccagaagccctacatgcactcctctctctctgtctttgacaaattacttttgaaagatcattgatccctggcgtaaatggtgttaagagtaagatggactcgggtagggatgctcaggaatccagtcctgtacagtcatgagcttggccatctggaagtctcctcttgctcaatgaaatggagtaaacattgtccattatgaaatccaccacacaggctgccagggacgaatgggatcccacccaaagccaatcgctgctctgacagggaaattggctagcactgcctgagactactccagcctcccccgtccctgatgtcacaattcagaggctgctgcctgcttaggaggttgtagaaagctctgtaggttctctctgtgtgtcctacaggagtcttcaggccagctccctgtcggatggcttttatgaaaaaatatctcctccccattctggggctcttcatggcctactactactattctgcaaacgaggaattcagaccaggtaagtacccatgcgtctcattttggaggaataggtttaaaaaacacaggggtgcttgagtgttcctgaggaccaagatgtgttcttgatcctcaaagttggtgaaaatgagggaaccctgagttaagatggtatttttgtgtcctccagctacaggctgtggacaggggggactgtgtaggaagggtaatcgtgtagccaaaatctagccaaataggccatgctttatttggcacccttaatggaaagcagtttcaaatcttctacaaaaatgagagtaatacccaaattcacaactcagcagctaattgggctctatgaagagactgataagtgggaggcaaaaaaaaaaaaaaaaaaaactggagatgatgactacatagaagtgagggaaaatccctggaatttctatgaacacatgtgttttgattccttgttaaatgtactttcaattgagcaaaattgaaagagtccagaaatgtctggaactccagcattttagctgaaccatgacttttctggcttcatcctatgatctctttccatggaggtttttagaaatgacagtagggaggctgtcagcccaaacctcccacttcagagcatgtttatgaaagacctggcctgttcccacagtgatttacggagtttgtgacaaactgatctgggctcataacctttaagttacaaattgcgataagcatgcctatatccagagagggagaaggaattttgctgccaacttgggtatggtcctcacttccttttggggttccccagagatgctccaaggaaagaaagtgattgtcacaggggccagcaaagggatcggaagagagatggcttatcatctggcgaagatgggagcccatgtggtggtgacagcgaggtcaaaagaaactctacagaaggtgagggttctatgctcgcagatatgtgtaccgtcacatgctcagatgtgttcttatatatgctcacatatacacagaagctagcatatcgcagatctatatacagaggcacatgcacacacacagacacttaattttgcactctcatatatagattcaaacaccaaaaaacccacaggaatataaaagtatgcatttaagcattcattcatgtgtgtgtgtgtaatatattctgcaacagagtccttgagttatatatgctcacagacatgcctagtcacacacatttacacatggaactacagatacatacggatgttttcaaaaactgaaatcccagtacctgcttatgaatacatatcctcatacccatgcagactcccagacacatgccctctcatggactcacaaacccaaggatgtacaaacattcacaaacctagagctacccacatagtaaccagcatctacactcataatgccctcagaaatgcctattcacagaagccatgagcataaatcatgaacttaaaccccagcactgggatgatttatccatttgaaccccaccaagttccagaaaatatttcagacagaggacgatgatcatgagggttatattaggcaacacacacacaaacatacttaccatttcttacctaaacagggctgtgagcaatctctcatttaagccccccgttacttcagagactaccccccaaaaatctgcagctaagactgatgccatttctgctgtatcactgcaggtggtatcccactgcctggagcttggagcagcctcagcacactacattgctggcaccatggaagacatgaccttcgcagagcaatttgttgcccaagcaggaaagctcatgggtgaggctgtttctcttacctcctcctctgaactttgcccttggggtcaccaagagcttttgggaggagaatgggaaaggtatcaaccccagatgatttcttaatatagccatctcttgcaggaggactagacatgctcattctcaaccacatcaccaacacttctttgaatctttttcatgatgatattcaccatgtgcgcaaaagcatggaagtcaacttcctcagttacgtggtcctgactgtagctgccttgcccatgctgaagcagagcaatggaagcattgttgtcgtctcctctctggctggtaagtgggacagggacatatgtggaaggtagaagaaaaaaaaaaatgccagggatgatgccaggctctgaagtagacataaatttttatcagtttccatgcagagaagtaatgagggattggtcaaggtaagtgggctacaaaattcttttaagtaacagagaaaaagcagtagctctgagtgctcattggaagactgaattgttttctacaaagtaaggtcaaagggacttgaggggctgctggaggtacagcctgtcctggtcctaagggagagacctagttacaatattaacttgaagttgaaatgttcatagtaatattaaacaaaagctgattaacagcttactcatatgcatgaatgggcagatgtactgataagagacttgtaggggggtgatttgtggactcaatgagaggcacgcatcctgagtaaaggagacactgttacaaactagtgacaccataaaaaatgaaggattggtcaaggtagatgggctacaaaattcttttaagtagcagagaaaaagcagtagttcagagtgcctattggaagcctgaattgttttctacaaaggaaggttgaagggacttgagaggctgctggaggtacagcttgtcctggtcctaagtgagagacctagtcacaatggataaaaaggactttgcttcctccatgaccaaaaggttggtgaagttatgtaaatgtgaaggtacaactgagaagttaactgttttaacaacacacaggtgtctgataagtgggctaagctaaagctaaataaaatgaacaacaagaaaaaaaaaaaagatgaacagacctgcctatagtgggtgtattctctaaaatttgaacatgttaacatgaaaagatcaatttaaacaaccagctgggtagggaggaaatgtgtccagagaaatggtcatgaaaagatatctgtgggatcaagagaggtccctggtgttctggatggtggtagcatcagaagccatcaccagtaaaaaaccagtgagttcccagcttgggacatttctaggcccatttttatcatagatccaggagacaagttccacacatctttgttgattagtcagttagaaggatgtggctggaaagtgcaaacaccaggatcaaaatccgccatctaaatgttgttcctggcaaaataaaaacaaataacctagaggactctgtaaactgttaagcacttcacaaacattcttattgaaactaatagcaccatctgtatcgtaaagagttctcctttctggcccagggacggcctgcatagtgattggataaaggggcagtgtgtctgtgctacccgccaaacagtgtgattgatatgcatcccggtgcttcccagacaacacacactccccacccctccccagacacagactctctctgggctggaagaaagggagagcttccagatgcatactgagtgggagggtgctgggcacatccccaatccatcccagggcattggacaaaatcctcacatcagtcatgatgtaggtggctttaatgatttcagctgattaaataatacattcactctaggcaaaggatgtatttcacctttgacgaatgtaactttctagaatgtacccatgatctaaatgtgctcagaaggactaagaattactgttgagcccaaggacgtgatgaaattctgataatctctgtttccccatatctcctacacttattgaatgacacttggtaatttccatgaactctgggaggtaggaaatctagctggatgagtatctttggtgtttattgcttgtgtagccaaaagattccagcttttttgccttgaaacctgtctatgaacttgcaaagtacagacacattgctgtcttgccgcaactgaagaatattctctgctttatgatgtattcttttaatcagtcagtaaacatgttcattaatccttcctctttaaaatctaaactctataaatatgggatgctaaacatcaagttgatcttaaggtcagccaaacagtactgggatggagttttaatcatttcttctagggaataccttaagttgtttattgagtttcagtgataaagaattgttttttctccacaatgcatttctgggtattgcattacatgggaatactatacttctaatatgttccttaaaggcttggttacctctgtagcattaacagagacaatactgctgcttctgggaacctccttgtagtccacatctatccactattcaccaccttttcttggcacctattgagcaagtttcttgtatgtgtaacatcccgttacattgattagcctcctctccttccaccacttgctagttaggatgtaagttcagctactgtaacgaagacccgaatttacaatggcttaagcaaatctaaatttatttatctcacacaaaacaccctggaaaggcagtccagggctgatatggtagttctgtcctatgaggctgtccaggaggccttctatctcagaaccaccattcctagagtgcttgtttacacctgcatgtccaagatggctcattggcatgtctgaattctaactcaagaaaatgaaaaaagaaggataccacctggaaggtgtacacttttcttctgccacagctggctgcaattgttatctttattcaaagggaacatgtgtccaactaaaaatcagaagttctatttgtgtaaaagacactgatattgataaacaactagcaatctctcccacatcacccatgctaaaaaacacataagactagaaaaaagtataccctccaggccatcccacatgtgaaacacacacacacacacacacacacacacacacacacaaaagactcattccctctcacattcaaggtccatcacaaaaaacaaagtccttccatccggcagtgcgtgcaggggacagtggggtaggagaaagaatggaaagagaatacctaaatagcatttgtgaaacaaaccaaagtagaaatattaatacttgaatatgactaaaaaaaatcactggagtgggcagagaacatttgaaaacatctggaaaaaagtttatctgacattagtcaaaataggtcatcttaggttcaatattagaaaagtaaagttggtttcattttcgggctcctgggcttggtgaatcccatcactgtggtgtgtgtcatcagttgcacacatggcagctagaactgagcatctaaggccatttctccacctgctttatgcccctgagaggaatcacggacaaaccctgtcttcctctgctcctttctcctctcaaaatctacttagccccctacctcctatgaagtctttttcagaactcaccagagccatttcaatgtttcttctttgtctttatctactatattttggtaagttaactttagaaatccaacttcctcatcatttctcttttttgggtttattggtaatccaaatactactaatactactcataactactaataacacaaatgttaaacatactcggcaagcatacgtgtagggatagtaatccttctggatcaaggaaaatgcaaggtatattttgaagtgaaactggacatcacaaaagactcagttgctttaaatattcaaaatgaaaatagatcagaaggaataaaagaaccttgtcaataacctttgaatcagacttctcttgagaagctccataagtgtctccagttaactattcacttttctccaagtaaatcttcttaaaaaatcaactttccctatatatagatagtcttattcaaatgtattcctttcctgttttactcattcgcagcattgtttcatactgttttttaatgtacgtgtgcagtctttcaggcactttgagttgagttgactagccgggggcaaacattcataagacagtgctctgtgggaaaactcaaaccaacagatgaagtcacttgctggatcttaacctatttgtcagtggaggtctgcctgtgtggtctaaatctatttcaaaaattcaacattatgaagtggggggagaaaaacaggtttttcaactacacatatcaactaacaggacttggaagacctataatgatgttttgcatagacaaggatatacagatgttaatgtcatccctgccttcagttctggcatacccactccttcctgaaaggtgggccaatgtttcaatgtatagctgtgcctcaggttattgggggtggggggatcccaaactccagattatgaacgggcctcagaaccagagtggaaaggggcaatttatcccttgccacagttgttctcatttttctaagaaaaaatgccgctttacccttaaatccaattacctcagaaataatcttcaggaaccaggatttctgaggtgagtggaagtgtttatccatgtgaacgtaagcatttacatgagggatggggagtggcgatggctgcacagggttgagctgtgtgttggggggatgggtagaagtacgcagaggtgaggtatgtgtttgtgtagacgtgtcatccatagggcctataagaatgccaagaaggagatcagagtaaaatcagcaacctgggcataaaaattccagaaaatttattctataaaatataatcattgttgtctaaatttaagagatcgtgtttgggcaacactgtgaggattgagacagaatctgctagatttatctaggaattcagttctgcatcagccccaaaaagaaaggagtgggggagatttgaaagggaggaagactctttgatgaagacagtgacaatttagtgcaggttgagaataatataatgctacccgtaatcattgttgcttcatgttcttttctggaaaggctcggctgaacttaggtagttgaggttacttatccctgctagaccacaggtttcattcaagtgcacttgtggatggaaatagcaaggttctaccatcatttgtatctttacgtttccttaccaaggagtttgagaaggcttacaacaaatacattctatttggaaaaacacaaatagaaaactaggtcttaagaaaaggagaatataaatgtgcccaaattagactcagtatagatcctgtgcttaagcttcaatattggcacttgaatttcttaacaataagaaaaagaaaagaaaaaggacaagatcagtgtacagccagcactctgcatgcctgggttctacatctgtggattcaaccaaatgtggatcaaaaaaaaatggggggaaataaattaacagagttctaataagcaaaacttgaatttgctacatgctgggtactatgttgaattcacagaaatgatataaggcataggcaccaaattaggtattataagtaatctaaagatgatttaaagtacacaggaggatgtgcataggtaatatgcaaatactacatcattttatatatgagggacttgagtatctatggatttgggtatccacagaagatcctggaaccaatccccctttgaatactgagagatgactgtactcagagtaggaaaaatgcatgattcttatattcatttaattgtttatttttgtgtattttttaaagtctaggtctttatttgtcattttgtctaaggtaatttggaaatatgtaccagaagccttaagaatgtttcctttggccaggcgcagtggtttacgcctgtaatcccagcactttgggaggccaaggcagacggatcacgaggtcaggcatttgagaccagcctggccaagatggcaaaagcccgtctctaccaaaaatacaaaaattagccgggcgaggtggtgggtgcctgtagtcccagctacttgggaggctgaggcaggagaatcgcttgaacctgggaggtggaggttgcagtgagccgagatcgcaccactgcactccagactggggcaatatagtgaaactccatctcaaaaaaaaagaatgtttcctttatttcacccagtctaagtgcaagaatatatcaaggaaatagctattaaattagtcacagatttaggtacaaaaacatttgttgtaggattttttaaattgcaaaacattggaagtaacctaaatgtctggcagtaggaaaataactagttgtactatatatttatatttatatctgtatctgtatccatagctgtatctatatctctggaaggacattttccaaaatattagcatgattatatctaaattacagaacaatgaatgatttttgtttttagcttcatatttttcttcattttccaaattttcattgtgtgtgtatgcatgcatgtgtaacttttataatcatagaaacatttcaataagttgttgggtgtgttgttttttccattgctttgtgcctcttttcataaccttttatgagaaattcatttcagaaattatttgcttcttgctgtgcttccttcttttaaatataatcatatacacacaccctcaatttcttcaatggattggttccaggacctcccacagataccaaaatccatggatgctcaagtcccttgtatgaaatggcatagtatctgcatataacttaggcacatcctcctggatactttaaatcctctctagatgacttataatacctaatacaatgtaaatgctatgtaaatagctgttatattgtattatttaaggaataatgacaagattttaaaagtgtgtatgtgttcaatacagacacaaaattatttcctgaatatttttaacccatggttgcttaaatccaaagacgcaaaatccatggatacagagggctgcctatattgatttccataagtagaaatttgcttaagtacttcaagaggaatggtcagggagagagagcataacttcatgtctgagaagtttattctataaacaaacttgaacaagtgcttcccaaatatactcattcattcattcattcaaaaaatatgcatgaaggtcaactctgagtcaggcactatgccagatgccaaggctatggcagggagcaagaaggccaaggcaagatacctgttgtgcacccacattctagtgtaagccaagttgttactgtattgtttatagttgtaaaaacaaacaaacaaacaaaaactagaaacaacctaagtagcaacaaacataaaacaaacactctaagggataaaaatcatgttacagatctattggaagggtttttatttcttggtatacaaaatagtagtatgttttacaactgcttgcctctgaaagctgttgaaatacagcattttactcacagtgattaggctgtgctctccttaaaggcaggcacattgttcattcatctctgattccctggagctaacaaattttgcaaataatcaacacattcttcttgaatgaacaaatgataaaatagcttgctagtacctggatttctggcttcatgtctttccttaaactgtgttggagactcacagtcatattttccctccatatttcctttctgtttctaggccttcgtgtcagggcttcttaataaggatactattggcctttggtgagggacaattcttcattgtgtgggactgtctgatgcattgtcgagcattttttagcatccttggctctgaataattcaatctaaaagccactcatagaggccaagcaagataggcatcttcaccggggaggaaggtggcagcacagattgaaaaacttgagcaggatgggacaggtttgtgtcacagagcaggtttgggacatcagagactgagtgagatgaggatggcatcctcacatggggcagcagtggtggcctagtgtgaagtttcagagcctaagtgggccaaggaggctcttcatgtggcacctggcacagggcatcagaactaaggggagtgatgagagcatctgcaagagggcctgccatgggcagcccgacatagggtaaagaaggcattcaccaggcattcatgtagcctggcactggggtgtcagaacctaggtgggatgaagaggccaaatgaagaatgatcacatacaggagcattaatcacataagtaatacatattgcagatcttggaagccccaggttctcactatcaatgttacaaatatgaaaaggaagaaaatgagaatgaatcctctagtgttggattgcaattggaagtgtgggtatgaattaatagttgtttaatacacaaggacagatatataaatatagatgtgtgtctacatatacatgcatgtattcactcactctgtccactgacaggacctgggagcacacttggtgcccagatcttgttttctaaatatcattctccactaaaaaaaaaaacaacaacaacaaaccaccaaggcttcttagagaaatgactgattccagggcagtggcaagaaaggtacaagataagcctgaaaatcttgttctgccagtaagtacagaactgctcaaaggataataggcacacattaccaggacacagaggccaactttaaagggatcccactagccaaacctagaaccattgaggcatcaaaacaaatagtagtaacagattatcacccattgcaacaataggaaataagtccatgaagtcataaataaatgcatgaataaataaatcaagagaggggaaggatttttcatgaagtggaaagccaactgatatgaaatgatgaacttagaaaatcaccatttggtaaccataattgtaataattcagccaggaagcaacaaaggatgctaaaagtagtgggtaaaagttaaacaaggaagacggtatttacatagtctcaaagtactaccctgtgcaacaacaaccaaaaacaccacaaatgacctgattcaaaaatgggcaaaggatatatgacagacccacagctaacatcatactgaatggggaaaaactggaaacctttcctctaataattggaactaaacaaggatgcccactttcaccactcttattcaacacagtacgagaagtcctagccagggcaatcaggcaagagaaagaaataaaagacatccaaactagaaaacaggaagtcaaattttcactcattcacatgacatgattttataatcagaaaagcctaaacgctccacaaaaaaactcttataactgataaacaagttcagtaaagttgcagtatacaaaatcaacatacaaaaatcaacagtgtccccatatgctaacagcgatcaatctgaaaaaaagaaaaaccatttacaatagctacagaaaaaaaaaaaccacctaggaataaatttaaccgaggaggtgaaagacctctacaggaaaaactataaaacacccattaaagaaatggaaaaggacacaaacaaatggaaatatatcccatgctcatggattagaataattaatgttgttaacatgaccataataccaagagcaatctatagattcagtgcaattcctatcaaaataccaatgacatttttcatagaaatagaaaaaaaaaacctaaaatttgtagggacgaaatagccaaagcaatcctaagcaaaaagaacaaaactgcaagtaatacattacctgacttgaaaatatattaaaggctatagtaaccaaaacagcatggtattggtaggaaaatagacaaaacaatggacaagaatagagaacccagaaataaaccgatgtattcacagccaagtgattttcaacaaaggcaccaagaacatgcattggggaaaggacagtctcttcaataaatggtgctggaaaaactgaatattcatatgcagaagaatgaaactagatctctatctctcaccatatacaaaaattgatgcccaacagattaaagacttaaatgtaagacctgaaactatgaaaccagaagaaaatgtagggagaacattccatgacattggtctaggcaaatattttatgactaagaccccaaaagcacaggcaaaaacaaaaatagacaaagaggactatattaaactaaaaaccttcagcatagaaaaggaaacaatcaacagagtgaaaagaccacctgtttaacgggagaaaatatttgcaaaatattcatgcgacaaggactaatatccagaatatacaaggtactcaaataactcaataggaaaaaaaactatctgattttaaaaatgggcaaaagacctgaacagacatctctcaaaaaaagacatagaacatataaatggttaacaagtatatgaaaaatgctcagcatcactaatcattaagaaaatgcaaattaaaactactatgagatatcatcttatcaaattgctattatcagaaagacaaaacatagcagatactattgtggatgcagagaaaagggaactcttatatactgttagtgggaatgtaaattattacagtcactatagaaaatagtttggagatttctcaaaaaactaaaaatagaactatcatatgatccagcaatcctgttattgggtatttatcaaagagaaagaaaattggccaggtgaaatggatcatgcctctaatcccagcactttgggaggccaaggtggacagatcacttgaggtcaggagttaaagaccagcctggccaacatggtgaaaccccacctctactaaaaatacaaaaattagccaggcttggtggcctatgcctgtaatcccagctacttgggattatagctacttgggaggctgagacaggagaatcacttgaacccaggaggcagaggttgcagtgagccaagatagcaccactgcactccagcctgggagacagggttagactccatctcaaaaaaaaaaaaaaaaaaaaaaggaaatcaatatatcaaagagatatatgcaactccagtcatttgcagtaatgtggatggaactgaaagtcattatgctaaatgaaataagtcagacacagaaaaacaaacactgcatgtactcactcatatgagggaactaaaaaggtttatctcatgaaggtagagagtagaatgatagtttacagagactgggaagaatgtcagcgtgttggcaggagggtgaagaggggttggctactgattacaaatatgcagttagaaggaataatttctaatgttcgatagtagagtgactatagttagtaactatgtattgtacatttcaaaataagtgaggacttgaaatgttctcaacacagaaataataaatgcttgtgatgatggatatcctaaatacccttacttgatcattacatattctatggatgtaacagaatatcacatactacccataactatatacaaatattacgtatcaacttaaatttttaaaaaaatttaatgggcaaaggacttgaataaacattttaccaaagaagacaaacaagtggccagtgagcacatgaagagatgctaaacatcattaatcattagggaaatgcaaattgaaactacaatgagataccacctcacagcactaggatggctactatcccccacacccccaaaaaacagaaatagcaagtattggtgagaatgtggggaaattggaatgctgtgtactgttgatgggaatgtaaaatggtacagtcactatgaaaaacagtatggcagtacctcagaaaatttaaaatagaattatcatgtgatccagccattctatttctgggtatatacacagaagaattgaaagcaggaggccgggtgtggtggctcatgcctgtaatcccaaggtgggcagattacctgaggtcaggagtttgagaccagcctggccaatatggtgaaaccctgtctctactaaaaatacaaaaattagctgggcatggtggcaggtgcctgtaatcccagcttctcaggaggctgagacaggagaatcacttgaacccgggaggcggaggttgcagtgagccaagatcatgccactgcactccaggctgggtgacacagtgagactccatctcaaaaaaaaaaaaaaaaaggaaagaaaagaaaagaaagcagggtctcaaagagctacttgtatatccatgttcacaggaacagtatttgtaatagcaaaaacactgtatgtttcactgttagcaacccaagtgtctatcagtagatgaatggataagcaaaatgtagtacgtatatacaatggaatattattcaatctttaaaaggaaagaaattctgacacatgctacaacatggctggaccttgaggacatcatgcaaagggaaataagccagccacagaaagagaatgaaccctctggtattggtttgcaattggaggaaactgtatgattccacttacgtgaagttcttagagtggtgaaagttatacaaagttgaaagtagaagggtggttgccaggggctgggaaaggagagaatgtggagttattgtttaatgggtgtagttagttttgctacatgaaaagagttctggagatggatggtggtgatggttgcacagtaatatgaatgtactgaatgcccccgaactgtccgcttaaaaatggttaagataggccccggcgtgtgatgttcctctcccagtgtccatgtactctcattgttcaactcccacttatgagtgagaacgcgcaatgtttgagtccttgtgatggtttgctgagaatgatggtttccagcttcatccaagtccctgcaaaggacatgaactcatccttttttatggcttcatagtattccatggtgtatatgtgccacatttgcttaatccactctatcattgatggacatttgaattggttccaagtctttcctattgtgaatagtgccacaataaacatatgtgtgcatgtgtctttatagcatgatttataatcctttgggtatatacccagtaatgggattgctgggtcaaatggtatttctagttctagattggctgggggaaggacagcatcaggagaaatacctaatgtaaatgatgagttaatggatgcagcaaaccaacatggcacatgtgtacctatgtaacaaacctgcatgtcatgcacacgtaccccagaacttaaagtataatttaaaaaatggttaagatagttttttttaagtaccacccgaaaaacaaacttactgattatgacagggaaaagagtaattttacagaagagaaacctgatagacggcacctgattcaaatgatcatggtttattaacatcaccagtaatggaataaattgaaaacatgtatcatttgatggggtgcaacgtgaagaacaaaagttacttttgtgaacctgccaaaatgcataacctgaatcaaatcatgaggaaacaccggataaatccaaactgagggacatccatcaatagcgcgctggtaaatgtttaacaacaagctatccagaaaggaagaatcaaaagccctgatttgtagcctttccatgtaatcaacactcccatgatgaccatatccacatgacattctcttgcttgcaaaatttataaacatttaaccaccagctctcacaatctagtatgagccagcttcggcatatcagcttgtacaaaataactggctgtactctccaacagtgccaaggtcatgaaaataaaggaaagactgcagaatcattgcagagcaaaggcaactgaagagtcatgacaactaaatgccaactcatgatcctcaattggatccttttgctataaaggatattattggcacacatgacaaaatttgaatagggtctgtggattagataacatggatatgtcagtattactgtactgggttgaatagtggccccaaaaaagatatatctacatcctacctgcctgaacctgtgaatgcaaccttatttggacaaagggtccttgcagatgtagttaagttaaggatcttgtgatgagatcatcctggattagccaagtgggctcttaatccactgccaaatgtccttatagagtcaggggaagagaagacacagacagagagaagaaaaagccatgtaaagatggaaagtagagattgtgatgtagccacaaggaatgccggcagccactagaagctggaagaggcaaggaagcactctccctcagagtctttggggggaatgcggccctgccaacacattgatttcagacttcttgactccagcactgtgagagaataaatttctgttgtcttaagccacccagtttgtggtaatttgttatgacagccctaggaaactaataaattccctcattttgatgactgtattgtgattatgtaggacagtgtccctctgtgtaagaaatgaacactaagtatttgggggagatgggacatgaggtcagcaatgacctcaattacagctattaccctcaaatggctcagcagaaaaaaaaaataggttgtgtgtactattcttgcaacttttctttaagtttgaaattatttcaaaagcaaaaaaaaaaaaaaaaaatccccatcctgggagtctagtgacttggaggacatatgaaagtgaattctgtggggctttttctgggttcttcagagatcccctgcaggagacaccactgctgccgcccattccccctgcagttccctttgtgtgagcaatgccttctctagctcattattttcagttcagctttcttctcagttcctaggcttcaatcagcccagcccacttggcccagtctacccaaccatccctgggcaggtgactcctgggcagcccccatccacaggatccacactgggcctctgggaagccaatccttggactacatggttgatcccacaatgcactcagctttgttctcaagcaagggcacttccagccctccctgttgcctttagactttagatgtgagtcaaattccagtccctgaactccaggggacatattaaaagttctccaaataatgctattgaggcccctctcatatggcttaagtggaaagggatgaaactgccctgagcgtcggtggatatagacacaggacattgagaactatctcttatccaagggtgatttaggctaggcacgggtgattaggcaatgcaggcagaaccggtttgggcccacccttcaactgtggatgttcttcaaatctattcttttattcttgccttagaagatgtgctgatactctgagactttaggaagaactccatttcatatcctgtcaacaggccccatacctgcatagaaatattcttgccaaagtcaccttgtgaaatttagtaaaagttttatcttatttatctctgttacatttttgtgctgtttcaacaccaaacgctctttcctagtgatcagccaaaactttgccctgggttttctctggccaccttaactctcccctctcagtctcttaggtttcttggcaattctccaaccttaattgttggtttcctgaggatttttctatcctgaaccctcttctcttttcactcaacacactttccctggataaatccattcattccatttcttcaagaatcactggattgtgggatgtctcaatacttatgatgacacctcaggtcttctggggtatggagaagataggtggatttatcttgagagcccaactcaatccaaacaactaaagagtttagaccatgagggtctcaactgaggaaggatttttaggaagagctgggaaaaatggggggcaggatcccagatgactctctggccttgaagccatttaggcctgatgcacctcaaatttgggctcattcatttgcctggggttgctctaaaagtgtgaaggcaggcaggaatgaagtttttcaatccttgtgcactcccctctgagcaatcaattaaagcagtctaaaatccatctttgaattggtaatcatttcaaaatctcagcaaggcagttagggatggagggtagagaggggatgaacgaaagcatgtaggcctccttttgacctcttctactcagctaataagcctcagtgcatggcttctttgccagttctctggctcttgctgtttctacagtggctgagtccccgcatttctgggacagagctaattacaaacattctgtcccacctatcatcatgtctgccttcatccttctaagactctgtgtcccatattttgcttcagaaaatatagtcaccatagctctgtttctttgtgttctaaaacttcccagaaagctagctgccatctttctcttctgctatcatggacccaccctcccacataagccaaaacttaaccttgggtagaaacactcaggcttccgaccccctcaattccacgactgcttcatgcatattagaacagtatatttatttacttactaattttgttgagcacatacactggcacattttttaaaaaaaactggcagtctaacaagtggatctcatagggtgcaatcagaaaacaagttgattctttcctccccctgcctgttcaaacctgttctgtgcgcaggtcctccctgagcctggacatgagctagggcagatggcaacacttttctggttactccaggttaataaaaaatcctatggctgcctctagtccacagaacagtctcatttccaaataggtaagatgtctagtcatgtgcaatttaacttttaccaaagcttctccccttgctaagctggaacctgctgttggtaggaaatgtgtttgttctttcctctctttccccacctcctccccactccctgaccccctctagcctgtcttgggttaaaggaaaagggacaatgcagggaagaggataaggagtaggaaaggtcttatttggctggcacccagctaatatattggtcttctcttgacattcagaactcatgctctctgaccatttggtggatgatcaaatctgactcttgcattgcatgcttttgtggattctttggaggccctttctggaatactagttattcttcttgtggtttgggcagcagttgcttatgttatttcctttgggccctgggaatacagtgggaatacaagagaatacactcaccacttcaggctgtccttttgggcagaattggaaatggctccagaagagaagggatgagtcctgggacaaggcccacagggtggtgagcagagtgtgggctggatttcaggtccacctacaagggagagtttccataggtgtgacacaatttgggctatgcaatggctttgcccatagccatggcctctcagattgagtcagaccccagtcctccttgttgctcatcaaactctttgggacgagctctctgaggtctctttgaagtcactctcacaaagactgacgtgaggaaaatcccccaccccttctttttggaagatcaatgagacattgctaatttcttctccctaactcctatcttctctggcctcccagtgtcagcccctttatttccttgggatgtttgtttgtgtttccatgttccctgtaagtgcacaggtggtctggaacctcccttcagaacgtggaagcctttgccaattactgtgatgttctcagcctttgaacctcagctgaaatgaaagcagaaaaagtcaaattttaacatcctgttacatgttgtttactccactttgaccaggccttttgactcatggaatcttttttaaaaaataaaaatctagatttttagagggattttgcccttttcagctttctgaaacttctaaatatggtttacatagagcagaacataggggtttcctcacacaagctaattagcattatgtggaaaaatgtttaagaacacacttgtgaatagaaataggctttaattaaatgcaccaatgttgtttgagaatggaagatttttctctcttctcttcattttttttctgctttttaatttttaatatatgttccagctttcctttagtgggcctagactggttcacaatccttatctgcaattccaaaatccaaaaagctatgggaaaaaaatggaaacaataataaaactccaaaaactaaggattttcttttcataattaaatctacctaatgaatttaacctgaactgaagtgaggctacttaaatcctttctttatctcagtatgaactttccaatattttagtgcagaaataatacatgctgtcttacaggctgcctcctccaaccctactggagatgcgatgtaatacctattaatgcccataccaccatcaaaaatccaaaaacaaattaaaattccataatacatctggctctaagagttttggataagtgtttttaagtctgtacttttgtaaaagaaaaaatacaataaactttgctattattttccttgtctgactagcttctcactgcctatctaactcctgcctctaatttttgtacaagccattcttccacctccctggtccttcatgtacttcctttcatcaagcagaatttacaacctacctcctccaggtggagtttcctgatagtccaatatcattctttacctaaacatccagtttggatttgaaatacatgttttccttagtcatgccagtttgggttttaaagagacttaattcataattcagtgactgctcacccagctgtcattgtgggactttagcctcttccaaagacctctccccatttctttcaggagttcctagatgatgttcaacaagcttaggccaccatgcctttcctaccccacactcattctcaaaacccactatgaatatcatttatggataaagccactctttcctactgaacagtttagcacagtcctctactccataaacagactagaagaatggggggcagagctcaaatctgcaggttaatggtccttatttgcacatggtccttacgtgcattgaatttgagtactggcttaaacatttacagatcaatagcaggtcacaaaatctgagagatgtcaacaacagctgtagccatatgttattatgttacagtgcacctcatgcatagtcttcacaataaaggctaatcgtttttcagtagtctttgtccaaccttatatgcttgcataatagttcatttttttcaccaattaaaagcaggcggatcacgaggtcaagagatcaagaccatcctggccaacacagtaaagccccatctctactaaaaacacaaaaattagccaggcatagtggcacatgcctgtagtcccagctactcaggaggctgaggcaggagaatcacttgaacccgggaggcgtaggttgcagtgagccaagatcgcgccactgcactccaacctggcaacagaatgagactccgtaaaaaaaaaaaaaaaaaaaaaaaaaaaaccaaaaatattttttaggcttggcacagtggctcatgcctataatcccagtattttgggaggccaaggcaggaggatcacttgatgccagggattttaggccagcctgtgcaacatagtaagacgttgtctctacaaaaaattaaaaataaattagccaagcacagtggcatgcatctgtaatcccagcaactcaggaggctggggtgggaggatgagctatgatctcaacactgtgctttagcacttcagcctgcgtgggtgacagagtgagaccctgtttctaacaacaacaaaaaaaaaacttttttaaaccatacaagcatccatgtcatgaatttttcaggtggtcttctgacatgtctggctccttcactacttctctcctttcttctgctttcactttctctcttctcttacctccttctcctacaaaaccatttaggattcttctatgtaccttgagcataacctgaggcataactaaggataggcaatgtgatgcatgagctccataagtggtataaaaataactgctctaggaattcagactatggcttcgcaggatatcttgcttctgtatctctgttgccacctagacaaacacattaaatgtcatagtcaatatctttattgtcatctaggggtgtgtagtgggctgaatggtggtcctcccccaaaagatatatccacctagatcctgtgaacgtgaccttaagtggacacatagaaagtccttgaggatgtaactaagatctcaagatgaaatcattcccgattatctgagaggccctgaatccaatgacaagtaaccttatatgaagagtaaaagacacagacagaagagaagaaagtgatgtgaagatggaggcagagactggagttgccagcacaactcagctccaactgccagcagacattagaagctagaagagaaaaaagaaggattccctgctataggttttggggggagcatggctgtgctgataacttggttttggacttctggattccagttctgtaagagaacacatttctgtagtcttacgctaccaagtttgtggtaatttgttatggcagcccagggaaatgaatacaaagggactaggagtgactagccctgtttatttatgggtatcctcatctgtcagcttagaagtgaaaataatactgctattcataaattttgcctattttggactcgactatcaaaagagagagaatcctcaccaatgcagaaagaactggatttaacacatggctcctggaaaacactcatataaagaacagtgccttctgtagaggaagtaccacctagtgttcaagagtgtgggccactagagtcaaatttgaatcctggtttgaatcctgcttctcccactcattaaccttgaaactttgagcatttatcctttagattctacactggcacataagagctaaataaatgttagttcctatttagctcaatttcagaggttattgtgtttgctccatatgcttgcttatttttgcagaatacttgtctccgcttacttatccctctccatggctgaaatggctaccccagtcccaaccttacatgaccttttcattcaaaatccaacagcagcaatcagaatcttttggtcacttatttcaatttattgaaagagagaccacgatgtgtgttcaagccagtgtgcatattcgtgataactgggccaaccttccatggctagaaagataaaggctctttgaaggggatgagggcaggaagtccatggcaagcatttctagtacactgtagcttttcacattttatatattccaacctatttatgtcttccttcatagtatatgcctccaatttcatgctttaaaaagtatctctaactttgagattagaaattcaccaatagcttattttagttttttactttccacatatactctgtgatctaatttgaatttgtttattagaatggcacttttttctccaagtaactagctatttgtcccaacatgattttttgaatagctcatacttttctcaccaatttgaatactaatactgctaacaataatagcattttctgaatgctttctatgtgccagagtttgtgctaagtatattacatgggttacttcagcttggttatattattatccacatattacagctaagaattggcatacttgggattcacacctgggtcatctgactctagagctcatacttttaattattatgctattctgataagtaatgtggatctatttttgtctcaaacaataaggaaaattattgacataactggaagtccagatgtagggcaggcttcacagttgacttggctgaagctcagtgtccccgtgattctcttggctctgctctcttccatgtgtggcttcatcctcaggctgacaatgagatagctgcagcaattccagcccccatatcaatgcacaaaaaatgtgttggaagaaaaagaggattgctactctcagaaactcttccagaaaaacaataactttttgagacactccaacaaaattttcttcaaatctcattggtccaaaatgagccacatggccattcctgtatcaatcatgagtaagaagaatgggataaaatagattacataagctcatacctgcagttaggaatgatgtcagctttcttttggcacatgggctgcatagaagtgaggataactatcaataagaagtaagtccagctctcagatacagaaaacctaaaataatagtggattcaataagttagcatttaggccaggcatagtggctcatgcctgtaatcccaatactttgggaggccgaggcaggtggatcacttgagatcaggagttcaagaccagcctggccaacatggtgaaaccctgtttctactaaaaatacaaaaattagccaggtttggtagctcaaacctgtaatcccagctactcgggaggttgaggcagaagaatcactagaacttgggaggcaaaagttgcagtgagccgagatcatgccattgcactccagcctgggcaacagagcaagactctgcctcggaaaacacacacacacacacacacacacacacacaagtaagttaaaatttaaatcaggtctgaaggtaggcagtatagggccagtatagtatggcagctccatggtcacccaggttccttccttctatctaaactatctaaatgttttgccatcctcaacacgtggcttctacctcatggtccaagataggtctggagccatagccattacatccaccttcagacaccaagaaggacaaaggattgggaaggagagactggcttctccttttaaggatgtgtcccaacattgaaaccaaaactaaagatacaacaaaaaagagaaaaccacaggccaatatccctgatgaacacagatgcaaaaatcctcaacaaaatactagcaaacagagctcaacaacattttaaaggatcattcattatgatcaagtaggattcatcttcaagatgcaaggatggttcaacataagcaaatcaataaatgtgatacatcacatcaacagaatcaaaggcaaaaatatataatcatttcagtagatgatgaaaaagcatttggtaaaatgcaatatcccttcataataaaaaccctcaacaaattgggtatagaagggatatacctcaacatcataaaggccatacatgacaaacctatagctaatatcttactgaactggacaaaattgaaagcctttccaccaagatttggaccaagacaatgatgccaacttccaccacttttattcaacgtagtactggaagttctagccagagcaattagacaagagaaagaaataaagggtatcccagttgaaaagaaagaagtcaaaaacctcactgcaacttaacaaagagagattccttcttctcaggtaatagtttagggctgcttttggtggacttacatgacgtcttcaagaatccaaggtcattccacatttctgttccactataattaacattagcttttcctaaagttcacaaactgactgctacaattctagccatcatatctgaggttccttaggaggaaaggagaagggcaaaatgtaaaagttgcatgccacctgaatccatctaatttattggaaatcaatatctttcctagaaacctcatctgttagatttctcattgaccagaactattacgttgcatggcctattacggcaagaaaatctcagggagatgagcattttaaaatgattacgttgctgtcctgaacaaaatcagactctattattaaagaaggaggaatggatattgggtagataacactatttactatcattttccatctagaatattttttgctatatgacataaaacaaagagttaattttttccaataagttaaccacctttctcagcatctttattaaataacccatcctttcttcattggtttgacatacaacatattatatttgaaacatatagaaattccaattccgataactgcaagagtggcacccgaaagaccatccttccccagattacaactataagcttttgacaaaatatcgacgacaaccattgaaagcactggagattaaccaagagcagatagaaaatggagggttattgacacttggaagaaggaaatgacagtaggcgagtttctcaattgtatagctttaggcctaagggcaaccccaatcagtgccatatctgggatagaaacctgccatcttgccaacatgaatagctagaaggaagaggttggggttaccgtaatagctggaatgcaaaggggttatgctggaaaggagagtcacagtggagaaacactgaatcctatacataagctctgtccaaatctctagttgttctctgaacaatgcatgggcaatgcagaaaccaagcagccaagttaagattcaaataattgaacagagattgcagctgatacttattacaagagacagagtttcacccaagttaactggccacttaaaaaaaaaaatcaacactctttggaggaatgtgacagaatccaggtaccctgcaatgtatcattcacgatatccaggatacaatacaaaattaacacccatacaagaatagtaaatatgacccatacttaggaggaaaggaaatcaataaagatcaatcttaaaattacccaaattctggaattagcagacaatggattttaaagtagttgctataacaatgctcggtaaagactatagggtctcaggtcacttctactctcccctcctaaaaagggtattaataatagtttatcctattaggcatatgtccacatatcctccaaacaacttgagtgagaattaaccagtctggtgaacattttttttaaaaagcggctttgggtagaaaagcaaagacaggattctgttttttgtttttttgagatggagtctctctctgtcacccaagctgcagtgcggtggcgcgatctcagctcactgcaacttccgcctcccaaattcaagcgattcacctgcctcagcctcccgagtagctaggactacaggcatgtgcccagctaatgtttgtatttttagtagagatggggtttcatcatgttagtcaggctggtctcgaactcctgacttcaagtgatctgcccacctcggcctcccaaagtgctgagattataggtgtgagccaccacacctggccaggacaggcagttttttaatacctttgtaaggaaagtaaaacataccctttccattgccaacaggtcaccaagttggcagagataactagtcaaactcttggatccccagcacttggttcagagatgcaagagttagcagctgtggaattacatggctcttttgtagcccagcttgtttatcacccttactaaaagcttaaacagtccctcttcaatgaaggctgtcctgcagcccaatcccaccctatgccttcgataccttaatgttttcaaaattcaacacagcagtataacttccatggggaatatagagaaactaagactcaaaggggtaaaaggacaccataggagttacaaagcctactacagctctgtaagaaggtgaaatgggcagccttattaacccatttctttaatctgtcatttagggaaagtggcttatccaatggttgctgcctattctgcaagcaagtttgctttggatgggttcttctcctccatcagaaaggaatattcagtgtccagggtcaatgtatcaatcactctctgtgttcttggcctcatagacacaggtaaggtcaatactttgtgtttttttttaattattatactttaagttctagggtacatgtgcagaacatgcaggtttgttacatatgtatgcatgtgccatgttggtgtgctgcacccattaactcgtcacttacattaggtatatctcctaatgctatccctcccccttccccccacccaacaggcccagtgtgtgatgtcccccttcctgtgtccaagtgttctcattgttcaattcccacctatgagtgagaacatgcgatgtttggttttttaatactctgaataatgacctgcagatgaactgtctgccttaccattgtggataaacaagggtgctgaactccctgacctcatgtgtaatgcactaaaaacaaaccagtgcagaaagcactagctctctcatttaaaggcatttctgtcactagtggaggctctggctactctttgactctcctttccattttgattaccaaggtggctgagtctcaccacattcatcacttaaccctttgctgaacaccttatgtcctcatggacactcaatggccattacgtttctatatgagacttatcaaaatacaagtttgtgtttcttaaaagcagcaccagtaataagacacactggtatcatgaactctttgatgtgatgttctgagaagaacacaacatcattttggtggtgttcttgccaaaatacatgaccccactccaatcataagagaacaatgaacaaaaccaaatcaaggaacattttataaaacatttggtcagtattcttcaaaagtgtcaaggccatcagagacaaggaaaggctgaagaactgtcacagattggaagaaaaatgggaagaaattactactaagtggaatcctggataagatccaggaacataaaaagaacattagtgaaaaaataaggtctgtagtttagttaatatattgtatcaattctattattatacctgtcctaaatcattgcacaatggttatatatggtgttgcaaccagggggagcaggtgtggaatataagggggtacggcctacaatttttacaacttttctgttaagtccaaatacaagtttatctaaaacatgtggcagatattaaaagaaaatgctctttgaagagtaattgagcaacagttagagaaatagagagagagaccgagacccagggggaaacaagaaaggaatggagagagagagagaagttgtgcaagatggacatgaaaacttggaaggggagagaagtgaaagtggtgacaagggagcaaaagcctgtattcttgtgtatctcttccttttacaagacagtaagtcattatcatacagcactctggtttttcccactggcacttcccattagctactgagtcattatgagacttctatcctcattctgctcccccatattacttctccgcctccaaccaaaatacccaagagagaagcatgattcagatctcccaagtaatcacctctaactgctcccaccaatctccatccaggaaggcaaggcccctattaacactaaggcctctctttgcccaacagactctaacatacccagtctctccatgtattccctatagtgcctgtgaggcttgcagagcaaacactgccaaaagcccctgacagctaagtggttgatgtctccaggccttccatcatgtagactgtcctagtcagataaccctactcttcccttgtcattctatagaaacagccatgaaggcagtttctgggatagtccatatgcaagcagctccaaaggaggaatgtgccctggagatcatcaaagggggagctctgcgccaagaagaagtgtattatgacagctcactctggaccactcttctgatcagaaatccatgcaggaagatcctggaatttctctactcaacgagctataatatggacagattcataaacaagtaggaactccctgagggctgggcatgctgagggattttgggactgttctgtctcatgtttatctgagctcttatctatgaagacatcttcccagagtgtccccagagacatgcaagtcatgggtcacacctgacaaatggaaggagttcctctaacatttgcaaaatggaaatgtaataataatgaatgtcatgcaccgctgcagccagcagttgtaaaattgttagtaaacataggtataattaccagatagttatattaaatttatatcttatatataataatatgtgatgattaatacaatattaattataataaaggtcacataaactttataaattcataactggtagctataacttgagcttattcaggatggtttctttaaaaccataaactgtacaaatgaaatttttcaatatttgtttctta

SEQ ID NO: 36751 - DNA, 507300 bp, Homo sapiens
ctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctggtgagcgacccccgcccgattcctgcgtggccttggcaggagcccctgaccgcgccgcgccgcgccgcgccgctggccgggacccggggactgcagcggtcggctggtgggtggtgccgatctcgggtgggatccatcagcaggcacctgggcgggggttgcgcgtacaggattaggacgaccgtcagtccgggggcgcccacagttgagctagtgcacgggctggaagtttgtgtacccgcctgtgccgaggtctgagcatggagaggtaaggagccggagtgtcgcggtgggcgagacgggacccctgcccaacacccggaaaggtgcgcacactggtctgtgcccgcccccggcgcgcctccaggctcgcactgccgcgagccgggggcaggggacacggaggtcgggacttggcggttcgggagcggccacctcgcagccccaccggcttgggcaggttttcctgctttccttacaggggaaccgggaggcaatgggacttgggctcaactccgccaagcgccttggttaatgaaagacactaaggcgggggatgcagaggcctggggaaccaccagccaggtgcgctgcagctaggcgagcccctttcaccaggcatccctccgctgctccacggattttgcacaccgcggctcagggtttcagaccccagggtttcgggcagatcgggctccagagggaatggtttctcccaagatgtgcgtgggaacggtcgtggaggagtgattcccccggctcgctccccgcggcggccggtgcctggcttggagcggtcacatccctgttcccctggctttggcgggaagcgcgttcacctcctcgccctttgcttgctttgtaccaggatgccgcggccggagttgggatttaactttcctgcgcctgcggcgtcctcgggattcccggcagggggcgctgcgagcgagcgctcggaggacgaggcgccacaggcagttgctgggtcctgggcgagtgggcgggagtcccaggcaacaaacagcagaaccaggcagatcttgcaataatttcattttgggggccgggggttgggggagctgatctggtggctatagagagctgtcagccttgctaggagaggggacaggaaaggtggtggccagacataaatgctctaactagaaaggtctcttccagagaaaaagatcgctgtaaagtcttccttgtctgggcatctgccttccttgtgactgttacatttactcagaaagaaatcgaaattgagggaagataacgtgagctttgtttaataccgttctgctttttaggggtactttagttaacacatcaggagtcacaaatgattgttctggtttgttttgaagaaagacaagttttacgtctagcttaccgagaagagctctgtcataatggctgagtttggaatcagcagatatgttattaattatagaggtagtctgttcataaggagacagaaacacaaaaccaggctttaataagaaagatttttcaatacctaattaggattgctgaatttgttgctaattaatgccagtttcattattttagagagtgtaatgtttatcatgaccactttacacaacttcagttcaagcagataataccattaagttatgtataactgaaataattttcttgtctgtgcctgtatttacaccaaaagaaacatggatttttttttcccctccaaaagatttctttttctatgtttttttttttttttcatgaaaaatacagccctaagtgtaattgtttggttcacttgaaacacagatgttttttcccttgagtttctttcttgtaaaaactttggagatagaagcttgctcatccacgttgctccatgcagtcacactaagcatctgtatactcattgaagtgtggggttgacaaactgacatctatttctatgtgcttttagccaatatgtacttttattaacagggagaagacagatgatgctaatcattttatgtcttttgtgaattgcactaactcatttggttgttataatgtcaaacagctgcgagatccctgctgcgagtaaagctttggcctcctgggtggtaaagcttgtctctgtccagaggaaatttttgagacgttcagaatttggtaaaaataaacctgcgttcttcactgccgtttccctttaaaatgatttcatcacgtgtcttgggagaatgaaacgtagaaacttacagctcagaggctgttaaaacttattgaccacgagaccgaaataaatacaagcacatttatacaaacttctgcataaattttagagtcatgggccttctgaagccccgtccatggatttgcagtaagaaatttagttccagagtcatgttagcctcttgctgaaggacaaatgttacaaccaacaagcctttctctgtaccgtgtgctagtggcccaaaataacagatgccagctctttggggacaatgtcagatgctcctgatgttagagagagctgcctatctgaatcgtgacacagttttacttaacttggtgattagttttaagagtttcaagtgattttatttttggtcataaagtcattgaaattgagcctttgcttttgatacaggaagatgtggaggaggagcagaaaacctttactaaatgtccagccaagagtataaaggcattgcattatgtagacaagtgatcatgaaccctagagttaactaatatcaaaaactcatcccaaggaagaggtttgagctacaaagcagatggtgtgcaagatagaacaaatgagtttataacatatcccagtcaaggaatccatttttatagtagtatatgtacaactatttgagtacagcagccgtacatcctgcaataaatcctccataattcttgattctaaaattataccaattttgtatttaaaaatgtttctgcaattgttgctatagttacccagacaaattgcttggggtataattataccaaggtgacaagtttttatgtgttaaataatgtttaaaatgtaaattatggtgtctaacaaattgagttacaactaagtacaaagtgtctaaagtgaagcattgtacatttctgctcacctgcatctacttgcaaatttataccaagaaagttaactgttttcttgaatcataaaatgagcgtctataagtactttcagttgtcttgagtacagttgacaacatagataatttcacatatgttctcagcaaccttttaaaattgagatgcagaagtttggttgaaaattaggtttttatcactctgctaccctgcagaaatgatagggggcaatctcctgtttccaattcctgtatagattgggagcaacttggggataaattcagcaggtgagatgtggctgctgggaagcactttggagaaacagatatgggtacgcttggtaaatatatagcatatttttcagatgaattttttaagaattggttatccagatatacaaaatcaatttctgatagggagaaaagaagaaaaagcaaaattaaagtaagctagaatatacataaacttttcaatataaatgaacctgctcaaaacttgcttcgattcaaaattgaagcaaaatagaacaaaacaaatgaaaacttgacccaagagaaggtattggataataggtaatttatttcaacatactagtattgacagtctttgccatctaaaaggttgtatagctaaggaaaccaggctgtccatttcacagagtattttgaagccaggcaacttcaaagacaagtcatatttcaccttgtgcatgaaatttaaagtaggagtgacacaacagtggatcaagaaaacagaaaaatttcccaaaggaattgctgttgtcatcttctttcttcttttttggtccaagattaatggttgtttgacaagagcaaagacaagcacactttatttccctttcctacattttaaaatgtagtgacatagtattgctgcatttggaaaaaagaaaatcattctgtttttaaactctttttttccttattggtttcctagaattggtttcctgattaacacttggggaaaaaaaactattttaaaagagaataatttttttagaggatgaaattcttttattattgaaaggtcatgagcccactaatcttttatcttcccatctttcactcattatttgtcactgtatttctgtagaattggctaaactagggttcatgtagaataatgaggaagtatacactggaaaaatgttattttatgttacatttttatgtacaattgagagtaaattacactactgcaataggtaattcaattacagatatgtatgataaataaccagtagagtgattctatcagaagccaactctgtgggtgaaataatactatatttgttgagacgtgaaattaagtaagttataggcgagtgacaatcaggataacacaaggacaaatcgttcacagaaaatcgagcctctttcaatcagttcaaatccacccaatgtttggcaaggatgtatgatgtactcatggaaagaaaaacagagtcaaggaaagcaactaagaaaaaatttgctaagcagtttcctgtgatctgtctgcaaaatcataaaaccgaaacttctattctcctgaatcacagcagagatggcattcctcacaaagtgacttcaaataaaattccacacaaagagcttttctttctgtaaaaacaaaacaaaacaaaaccggagatgtgacacgtcttgcagagggcccccaaagctgttctgagccagctaccaaggcagctgactcctgccagtgcccccaaacctgctgtggaaagagaacgcttcggaggccagggacatttatggttgggcatcctgtaaacaaatggattttagaatcacaactggcttccgtgactccttttacaggactgagatttaggtttgttgtaaaactactgattttcttttctttttttcttatttttgagacagagtcttgctctgtcaccctggctggggtgcagtggcgcgatcttggctcactgcaacctctgcctcctaggtttaagcaattcttatgcctcatcctcctgagcagctgggactacaggtgtccgccacatgcccagctaatttttttttttttttgaatttttagtagagacggggtttcaccatgttagcctggatggtctcgatctcctgacctcgtgatccacccgcctcggcctcccaaagtgctgggattacaggcgtgagccaccgcgcccggccttctctccatatcattttgcagaactccacgcactgcctttatttcttaaagtctttcactgatacagaatgtcagcttaggagaccaatgagactgttttgttcgcagctgtgttgcccacgctgcctagaacagtgcctggcacgcaggaggctctcgggccatcttgggtaagtgaccgaatcaaaaaatgcccttagagactatgtatatagtatagactgcaatagagtatactgagagaaaggactaaggcttaagcaagacttttgggggctaaccatggactctaaaactacttatattctttatttagagaaaaatgttccaaatgcctccaaactgattttttagcacagtcttaaaatacaaatgtctttgtaaactggcaggtggagggttgggagagggactgcatatttcctagttcctaatacacaacaatttgcacagtaagtcagtgcttgttaaatgaattgacgaccttgcatgacttggagattagcataaatataatttctgtgtacagattgaatattcctaatcaaaaaatcccaattccacaatgcttcaaaatctgaaactttctgagcaccgacatgaccctaaaaatgctaatatatataatacaaatattccaaaatctgagaaaatcccaaatctgaaatacttctggtcccaagcattttgggtaagggatacttaatctgtattaaaacacagaaaaattgaaattcagggatgttctcatttaaaacagcaccctctcctccaagcacacaaattccagggaacatattgtgtctttattacatatgtttacacattacagagattttagacatcctagaatattttaaaaatatggcaggctttttcttatatttccaagatcagactaataagcctagtcatgtagttggatttatagatttaataagttgaaacagaagaataggtaaacaaaatgtggcctatccctacaatgggctactattcagcaataaaacaaatgaactcttgatatatgctgcaatatgtatgaacctcaaaaccttgtgccaagtgaaggaagccagtcactgaagaccacacaccatgtatttccatttatagagatgcccagaaaaggcaaacccataaagatggcaggcaggtgagtggttgcctcgggctagcagtgggaactggacatgactgcagatgggcagcctaggccttttgggggtgatggaaatggtaagaaactgaattgtggagattgtcatacaactctgtacatgtactaaaaatcattaaattgtacacttacaaagagtacattttatggcatgtaacatatacctcaataaaacttttttaaaaagaaaattctggacatcatctctaaaattagagtaaattaaacagccagtggcctaaatacgagtcctgctgcgtctactgggaaatgttttctgtgtttacattacttgtacaaagcttagcgccagggccagtgggtgctaggatgagcacatttctttgatactgaaacactttcttcctgggaagtctatctgagctgtgatctctgttatgaaaacaagcaaacttaggttgtttccggatgcgacaacataaccagattaaatcagttaaactcatcagccagcctcgccgctgaatgttgggtacaccccaattcccagtcattgcttagagtatgcttctctgccaattttattgttttatgggcatagctcagggggaacatctttgacaacacagaatcttgtggtctcattagagctgcagagtctggaactcctagcatcattctgctcaacaaatgaggttgctgtcctttgatgggggagaagttcatgatgcctgcttctgtgtccttgtacactttcttagcaaggccttcgcttcagctggagtggcaggtaacttctaacagccagacccagtggcagaatgcagagttttaaatgcccagagcctgagtatttaaaggggagtgtttcccaccccgcgcacctccccccgccccgctcttagagaagaatcaaagaattgcttctagctctttccattctgctttggcacattttgcagttaaaatgtaatgctgaatataggttttgggtagagatacatacgaattgcctctcatttccttgctcttccactgttttctctgggtagaagtgagtgtctttagctctcccaccttgtttactgcaccttccatctgtttagtgtattaaaatcctctctgcctcctgccacaggcttcctcagctctcttgtgggcaccttgctttcctcacaccagttggtttccacatagtggctttccatgggagtgtttactttggcacaggtggtccatggtccagatacactcagcatggctttggggatgtggtccaggctagctggcctttagcactcatatgcatttctccactggtaatagagtatttttttatccagccctgtgatgcttcaggcaagcattttcatagtgcctaatttcttcagtatttctagttacttgttcacaaaaatggagatcaacagcgttttaagtcctagtgcaatagctttattgaccttttgccagggtcatttctgaccagctcactttgaacttgcctctttccaaacatgaagcctagcttacaagcaaattaagagtaacatttacagaacgaccatgtttttctattaccaatcctaaattatcacccttcatgagtggtaaggagttatttatgaggatacactaatatttccttctgctgattagatggcagtggggtgggtgacatttttatctttcataccacttttgatggtttcagttagtcaataaaatactgtttaggtaggtactttttgtggtttggttttctttcattttcaacaagctaatgttctctagatttcaaggataactaattagccattcagttaaacagactggctggttacaagattggaaaaatgtctgtgttaccagggcaggtatttagttttgaaacagaaggattaagaaagcaaggtaattttcccttattttaaaatctcctttaatcatagatttgtattggttccggtagcttcagttgatcataattaaagcagctcatagtgttatgtatagaattatgtgaaggcattgtcctaagtggataaaatgtattagaccattttttttaatgatttctactttttctaaccattttcttttttgaaaagcatccaaatgttagcctctaatattgattttggacactctaagatgtatgggattttaaccttattctgacaggttagaagctagggaagggcctcgaatgttcacttcacagcctggcagggtgcccatgtccaatgccttgtgtctgcggcacctcctgtcctcctgtcactgttctgaagtttaaaatcagaatatctttgccagtgtcagtgaagagaaacttcattgaagcttgagcctaggagttaaagatagacattttatttaagtttaatatttccaggctgtaaatagaaaagaaaaatggtgttttacagagcaggggtccattgtccagatattattgagcctttgcccaggacagggtgtctgggtgatctaaactggaaagggaaatcctagactgcagtttcctgtctttttttttttttcttttttgagacggagtcttgttctgttctccaggctggagtgcagtggtgcgatctcggctcactgtaacctctgcctcccgggttcaagtgattctcctgcctcagcctcccaagtagctgggaatacaagcatgcaccatcatgcccagctaatttttgtatttttagtagagacagggtttcaccatgttggtcaggctggtctcgaactcctgagctgaagtgatccacccaccttggcctcccgaaatgctgggattataggcatcagccactgtgcctggcctcctgtctttttgcatagggctgctcttcagataccctttagtgacttttcccccatctatcagaggaattttccttttccccctccttatgattgtcgtcctctggttaatttctctgctaaaccaaaataattttaattattatgctctttgttcaccagaaagttttgagccaaaccgtcctcccccaaacccatgtaaaagtgggtgcaccaagttttgtgctctgtgtctgatattatcaggtgtctgtaagcatctggccactttgctgtgggattcaagctgctgctgctatgacaggagcaggagcacgtgtcctttttctcctagtcttgttcctgggtggtttcatgttggcgcctatagacaggaccacatctaagtcagttctgagtatgacaggcacgtatggctattcagttacatcccgacgtctgcatcacactggacggtgctcttgagcttgggaagatccagcatctgcccgtggggtaactctctcctggcttgccgcagggcagtagagattccctcccttcttcattcctggttcctggtgggaaaaatctggagtttccaggctatgcttcttaaaggcccccctcttttccatctttgaatcactctcacttccttcgcctccttactcctcaaaggtggtgctgagcaagtgggaagacctgaacccaacccaggtggttgagttgaaagtattcccactctgccgatccactcctccctgcattttttttttaaacaacacatactttaaactagtatttttttctaaagctttcttcacctaagaatgtcacactgaatgtcaattgtgtagcggtcgtgggtgggttgggagagtggaggtgagagttgggaaggaggggccccatatagagagagcatctcagcgtgtccaggcagcccatcttggctgttgcagctttccacgctgactccgaaagtcaggcctggagccaaatttactttccgtctgccagcagtgatggaattcctaggttctatcaccagcttgcgaaaagaaatcattcaggaaactgcaagctggcaagtaagaatcgcaaagattcattcacttgaaagcttacgcctgcgaatgttacttaactttgaacagtttttccaggcccacctgcggagtttccagctccctgaggtttgtcttgctgcataggaaagcccttaaggattcacagcgaggatcttcaggatgaagctgggaggtgggaagagcagaagggctttcccggggctcacacctcattcagccctgacccgactttgcagtcaggtcgctctctacaacttcaaggagtcaatgtaggtgcttggactttaggtcctgaagtcttacacaagtcaggacaagagtcaggcttcactgtggttatgtgccctgtccattgaaatcctgaaaggcatttttaaagagagtatctattgaggaattgtctattgaggtaggctgaaggaaatcaatgttttgaacttggactatggctagaggagaagactgacttgcccaatgtaaaccccaaataaaattctaaacaacccccgccccatgctgcccgtgccactgccactgctgtgcctgtggagtagccattcttttatttctttgcttttaataaacttgctttcactttatggactcgccttgaattctttcttgcacgaggtgcaagaactctctcttggggtctggatcgggaccgctttctggtaccatgatgttccatggggatgcaacactggctggcttgcccctcagagtgggctccatcatggcccttaataagtcctggctacaagatcacacccaatgatctgtaatcaagagtccttttaattagtggtggtaacacatggactttagtgcagttttggatttgttgctaagtgtttttcaatgagcttttaatttgttgttgtttaattaaaagtgtatgttctctgcagaacaggcttttgggcccacacttcctgccttgaggtttttggagctggccctaagtggggagaataagcatcttgactgggggtgtggcagcgtcatcattaagagtcgggggacaaagggcgcaattagtgaattgctcatagtggggcctcatgtgggaggccctcagggcccagtggcctttgtggattctttaattgcacttttaagtgagacagagttggctactgggtttaattaagccttcagggctaaacctatgaacactaatcaaaagcaggttagggaaagctgctttcttgaaagtttatagggtcactcgcttttatctttgttcctcttcaggtgagtgctggtgtatctttttcaacacagcttttggggttgactttgacttctgctggtttgcggttttgcttgataattgcagtggcccaaatatgttgcagtttatgtcagatgttttaaaaacccatgaggaagggggccacgggttccagctcactcgatcttttgtgtctttcctatgtgtgggaagaaaaagtttttgtagatatatttatagaaaagaatttggccttagacttctcagaattggtagaaagctaaaggaatttgtataaagacataattagaggcacataggaaacttgtaaagtctgcatgtttgaaatgctttgcttctctgagccattgggagtttattagctgtttccttttcccacattaactttcacatgattaattggattcacttaattaaatgctctatatttaagtagagtggaggcacagggagtattctgaaaatagtatcaattgtttcatactgaatattttagatgaatattttatacctaaaatatacaatatggtctgttcatacttggagaaaagacattaaattctatatttacaatcttttactatgtatgtaaccttttacactaaagtgaaaggtctattttaaaaatcttatggacaaactcgaaaattccgtatcatgaaatttgactcctttcctgcattccagaggagcaagccaatgttgtaactaggagcatgtctctgttgatgccacagtaagttgaaatgttcagaggggtagctgggctatttttaacaagttcaaatgtatcctgtggtggaatatttccaatgatccaaaattagtgatggtatcttggacaccacagtatcatgggctcagacgaattggcgtgttcaacatctttcaattgtcaacctaaatctaacactaggattgatggctttggtcaaaggatgcttcattctttggagaaaacaaaagaataacctctatttgtaagcatgggggttggaggctttggaattaggtgcttgacaaagtgaacactgcatgaaattgggagcagttgcaggctattagaagatgacagtcttttggtggtaaggaccattaatacctaccaaggacatgtttattgtattggcagggagcataaaggagaacagctgagatttttcccctcactcttctctttggtttacatgaaaaaagtgtcaaaggagaagcctggtggagaaagggcttggctatcatggcaacctttatctgtggaaaataaaaggaagatacagttgccctctgtgaaaagatctgtgataacactcgtccccaatcatcggagagacaaatgaccatttctctttgaaagaattatatttacatttccccatgtctagagaaatgccttcttattaaatacacatgcaggtcgggcacagtggctcatgcctgtaatcccagcactttgggaggccgaggtgggtggaccacctgaggtcaggagttcgagaccaggctggccaacatggcaaaaccccgtctctactaaaaatacaaaaaaaaaaaaaaaaaaagaaaaaaattaactgggcatggtggcaggcacctgtaatcccagctacttgggaggctgaggcaggagaaatgcttgaacccaggaagcggaggttgcagtgagccgagatcacaccattgtactccagcctgggcgatagagcgagactctgtctcaaaaaaaaaaaaaagttcattgattactgtttttccccaaggttttttgttcacctgtaaagtaatatgtagttgataagaggatgggggggatatttaagatctttattctgacaaacactttctgttgtcctaaactgatgtggcagataggatagatttgagtcaaagaaagggatatggatttggtgaattattgtgccttattcattgaatattgactgccttcaggttgataaaaacattccatagatttctagaacctggaagacacaactgaggttttccaatttatctctttgtccacaggtaggtctttttctaaacttcatagagagatggtcatctattatcttcttagagaggggcttatgatggggtcccattataacttggatcacttgtttgcttttagtgtgtcttgctccagcaaagatactagggtaaatggtagtatttggtctatgaagcaggatatttactagaaactttctctgggacagaccctaggctctgccctgggaagacagtgtgtagaggctagagatggtttttcctctctcggtatctgttttccagttgggtgtcccttgtcctggcatggataccattttttgccagcgtgcctcaaggacctgaaccaatgttgcaggttcaattcaatcaaaccctgaggctttcctaggaacctcagggcagaattgcagtgacagcaggagagaggaagagtggggtgtgggacagtgaatgacagaaagagtcctgtgtgtctgcatgccctgagggagcttcctcacttgctggggctgaaggaagcttcaaaggtacatgcccatctggcacagatacactgttggtacttgcccagggctctgagaggaccctccagctcagggtacacagccacatctgtcaaaccacacaaagccaggatatggtgtctgcagatatagttccctacgaatgtaggtggcctgaagaccagaaatggtctcaagagtgccaaagaaaagatagaactatttacagtcttccttttcaggatcatagagaagtttggagctggtcacctctctaggaccttgttctgggggctgtttctggtcagagtgcttgatgcagagaccttgatatctgatgtgctcgaggtctcacaaggactcccacgcaagatgcttcctggagttttttagggacaaaacccacattattcatcttcattgcaagatgaccttttccagtgttgaaaacactttgcagtcaggataaggaagaggaggctgacctttctgggaatggaaaagcctcaagatgtgaagagggtacttggagctagagcagtcaggtaatgaagctgcttataactcacttctaaggaggcttccctgctgactggcggcacattctcgcctctctccctccgattttgtagctccttagcataggagttggggtttcctggaaagctccttttccaggtgattccattgtgcaagtcaagattccttgattagcctctgagctctggagaaggatctctcctcgcttctactgcccactatagatgcatcctgagtgcagctgaggtctgagttgagtggtcagaataccaaagactatttgcatttctcaagatgtgggcaaatgcaattaattaatcatttctccttacataagggcttgtgaaccagaataattaacttctattctgttttcttccttttgtccttttatgtaaacctgaaagagaagcacctggtttggggatacattttggcaaataactttaaaataaaaaaaaagaacattttattatttatttggtcagtgtgttggttgagactggaagagtttataaatttgcatgtagtttctttttggatgtttaatttggataaatgtatttatgctgtaattatccatcaaattctgtgcaatctcaaaagactacatataaaaatgtgaatatcatacaagatggaaatctctgaactcagctgtcatcacaagcaaccatgtgtaagcacatttttttttctttttaacacatgatctgtccctccatggtataactcaacacagcaaacagttgctggctttgcttgtggaacgtatctgtggaaatggtcgcatctaacatggccagaggaggcagagagtcagagcggcaagagttatgcacaaatgtccatcctaacgcggcccgcacacctccctggggcttcccagcctctgccttgcctttgcctgctcttcagagcctgtgctggctgctgagccttgtcgaacaccaggtattgaggctatttccacgtgacacctttcggatctgatggtacttgggtttcagggaactatgcctagggctacaggtccaatgatacaagggaagatgaaagaagggaggatctgagtcttctaagactggagagaaaatgtggtaatagctcaggttgccaaaaaggatttttattccacacttcctacccccaccctcttcttgaggagcttcacgtagaatgaatgaacaataggaagctaagttcatatttactttcatatacccatggattttataagggtttaaatactaggaggagtccggtatttgaaagcatgttactagtttataatgtgaaggaaaaaaaattctggccccagtttagtagatgtcttaatactgttggctggcagaggcctataggtcaatgtctgaaatattcctggaatatgaagattacatgttttattttattttaattgaaatatattagtagtaatttcagctctgtagctcagcatgacataaaggccacagtcccatacccggaagctactgggaggagctgtgcagctggtgggtgtccaggcagggcaggtcacgctcttggcttcccacaggggcaggctgcccacgagggctggccaagtaggatcctgacctctaggaaaggtgccgagaagcctggcagctggggaggaggctgtggggacttctgcttcagccatgcagggcggaaatggtgagaggcaaagctggcaggtgcaggtgggtagccctttcaccagaggcttggccaccatccctagagcacacggccacagttgggtggcagttcctcagaccttgatggagctgacagctggttgtgctttcaaaactggaaggagtgacttgtggtcataaccagaaccatctggatacagtgctaccatgggttcagaatagaaaaggcagctcttctgcctagctctttggatttcttgtaagtacaaagtcctacaaataaaatcaccatgacctaagaaccagctatccctaaagccctgcctggtctctggagccaggttctcctgaaatctagagactcgtggctcccaggtgaaactgttctacctgggaatgtgagcaaacaatgtagttctcttatctttttccctcttcccaaaataaaatgcattaaataggtaaactcatttgttctggagatctattggtatacagaaaattttcccataatttagtgacttaaacctgcaatttgttattatgtttcacaattccttgggtggactgggctcagctgagtggttctccttgggcctcatgcagtagcagtcacctggtatcctgccacatggcctctctgtccttatgggaaggcatgggcttcgatactggaagtggacgtttctaggccctttaaaggctgtgccaaggacaggcataggaccacttccactgtattctactggtcaaagcagtcctagggctcagattcatggggttggagagagtgcccatggacaggcaagtggcaaagcacactgcagaagaatttgtgggtggggagactgtgctgaggccataatggaaaatgccatctcccaccccatttctcatgtttagtgaataggaacccagaaaaataaatgtgtaatcagggacctgaacttgtagcctgaagccaggctgccctaggacttcttggggaccttcggttgctgatggcttgagggttcgttgctaaaaagaccatgggaagaaattgctatagtgtaactgagggctgacaccattttctttagaaaattgggatgaactgtgttctaggtcagtctcactaagtagatattcatattttgcaagctgaagtctttggtaggcagtgggaacttacctaagttgatcatattctatttcatttctataaagacaatgtttggaaactgacacatggacacataaggaaatgctacgtgcaaatgtcatatttacaaattacaaaataggtgattgtttcataaaaatagatatttttattctatgaagaagattagttgcaggatgtctttaaatatcaagatcttctaggccttttcactgtaattttgaggcagtataaaggtagtggttagatgagcagattttggatccaggttgcaggctttgaagctcagtcctgccccttggtagctgtgaggacctgaggaacatgctcaatctctccatgccccactttgtccaattctaaaatgatagcaatagttcctacctcataggggttttgccaacattagaaattgttaatgcatgtaaattgcctgttccatagtgagcactccataatgttagcaagtattactttgtgatgattcaagaaatagaaattcttgttacaagctgaagtgtggtttaatgtctttgttcacttgaaagcactttgcaaaatgcagttgaatcgccacctctgtttggtcacctgcacaggaacacccacacagagagcgagaaggaagatgagaggaaaaattggaatttgctaaaaataaaaccagggcttggaattgttgcttgactttgcataagagcaaacatctcttgatggtaggaaaaaagaaagagaagtatgctgggcatcttctgcttatccttccagatcctctggagcctcctccaggctctggactgcattgaagtcttgctagccctctgcttctggttggctttttcccttgggggccatggagaagatgagaggtagaagggcttgtgctctgaggggtctcctaggtctggctgcatccttccacccaaggcctcagcacactcgggacctggtaagtgctcactcctcccactctgtcaggattcaaggtgatagctgagcccactgtgactagccctgtcgctgcactatcccttgtgtttccctggcctccatccacactttccgtcttacactccccttaccatacccaggtggagtttgccatacaacccttctgagaccctgggaaatgtctgtcaccaagataatgaccattaacatcaattttcagttggttttgtgattgcaaaggggaacagcttgagaagttaaaaactccagcatcttttactgagtatgtcaagagctatgtagatgcattgtcttatgaagtcactgacagcccagtagggtgggtagctttcccagttcttgagttgtcacctaaagcccacagtgctaaggcaatttccagcatcctgaccctctgagcattgcctgcaggccctgtctcactggccaccagcaaaatgtgaactaggggacgtgaatgtacagctgaagccaagctgctccggggcttctccggaccttcagttgctgatggctcaagggctcatagctaacaagttcatgagaagaaattgctgcagtgtaacaccatttcctttaaaaaattgggagcaactgtgttctaggtcagtctctctaagtagataattcttactttgcaagctgaagtctttaccaggcagtgaacagctggtttacataattaaaggtacctgtgaattagttttgaaaaaatcaatgaactgtatgaccctgtgacagctcttatatatgtggtttaagatacatttaatgtcaggttgataaacatgcacatatctatttagctattaatttacttacaacacatcccacttggctttctagtttaatgttaaacttaaatgtttttaatatgcttttggataattgaagtaaatggaaaagaggagaactttcctcactcaagcaaattcttctctacctttcaatatttataaatccctgggaagcatttggtagtaagactttgcagctcgatgtacaatgcaagctttatagcaggttatgttttggctgtaatgtgtggcctattaatgaagcagaaaaggctccttttgattacttttctatttgataataaccccaaagggattcccaactctagaactctctataaatctttaaagtgtaattactgcaatcattggagtaattatcctttatcatacaaccctaaaaagggccacaggaatagatattctgaataatatagtttttgctctagactcaattatttcacatctatcagaaattaattttcctaatataactcttctatcatgctgtttacatatccttctattgattcatgcgtaaagaaaaaaagatacaatttctcagtctggtgttcaaagaattttgatctctgaaaccttatcaaagttttctcattctagttctacttcatgtgaggattttagcagggacaggacctggaaccaaatgggggcattttgaggtgtcccagtgattgaagttctggaggccagaagtctgaaatcaaggtgttagcagattggttgaaaaggctccgagagacaagtgctcctggtatttggggccaaaggccagtacagccattatcatcctcgccatcccctgggtccttgtcccttctgtccttagcttgaactgttgcattgagagccttttttcttcattagaattcagcttctttctcaagtcccagtttatgtctggagtctcagatggacacactagtaaggattccttttacattgatcttggcttcttctgaaatcctggtgcctttactgttgctgccagtcattttaggttaaatcagggatcagcaaagttttcttgtaaaaggtgaaataataagtatgttgggcttctagggttatatggtctctgtcatgactactcagttctgctgttgtagcgtgaaaacaaccattgagactatgcaaacatatgacatgactgtgttccaatgaaactttatttacataaagaagcagtgggccagatttggcttatggccatagtgttcaacctttggcctaaaccatatgaaatagctatttttgtagttcaagaaaggtcaactattggcaatttcatatgattcaaacaacaggttgtaaactttgttgtaaatattagtatcctctgaaatctcttttttcctctctctcttttttattagcttgattttagcctgccatggtatctaagccaaagtgtcaaattttgggcattcaatagatatatggttagtatatgactgtgaggcaggaccctcactcaaatcccttcatgggaagaaaactaatagttcattaaatatttgtcaagtcacccaaaaaaagtgtttatgtatatatttattttgcattaataatggttgaaaattagctaaggactgatattgtgaccaaggggactttcatcattatttttgtggtcattgttaccatctgtatttgcttcttagggctactataacaaatcagcacacactcggtggcttaaagcaagagaagttattctcttgaagttctggaggccagaagtctgaaatcaagttgttagcagattggttcaaagggctccgagagacagtatattccaggtctatcttcagcttcctgtaattgctggcagttcatggcatttcttggcttgtagaagcatcattccagtgtggagtgtctatgtcagtagtcacgtggagtgctccctgtgtgtctctgccttcatgtggccgttttatgaagaccccagtcattgcattagggctcactctaatccagtatgatcttgtattagtccgttctcacattgctttaaataactgcctgagactgggtaattcatgaagaaaagatgtttagttgactcatagttccgcatggctggggaggcctcaggaaacttacagtcatggcagaaggtgaaggagaagcaagcactcttttccacatagaggcaggagagacaactcaaagggagaagaactatacttttcaacaaccagatttcgtgagaactccatcacaacactgcactagggggatggtgctaaaccattagaaaccaccccatgatccaatcacctcccaccaggcctctccttcaacatgtggggattatgatttgacatgagatttgggtggggacacagaacctaaagcatattagacctcatcttaatttaactctatttgcaaaagctctataacatagtgataacataacactgaggttctaagtggacgtgaacttttaggggacagacactaattgaccctgtacaccatctgtaagggagcggagcacagaggatgacctggaggtggcaccttgttgacagagttgttttctgctcctgaggatcatcccaacttatttgcactggaccttgtccagagaattcagtttttgcatgcttttaagaacttgctgatttttgtatgcctgtatgcctcctcctccagaccaactgttgacaaagagagttcacccaggagggtgattattttgccatgattgatgactcactgctgagactctgagtcatgtcaccttccctttgtccctcgttatagatttgtatggcaattgagagacacttagaatatgtttaattgtttggctttttgaatttttgtaaacaattttacacaatatggagtggttgcaattatagctaagatatgagacatcctaggaaggattttcactttaaatgtttacaattcctgcatttttatgggattcatgaacctaagtaagataatcactttagatactgaaaccacacccttcaaagagagaccaggagcttacatctctaacagggctgtgataggataaggctctggaaaaggaggcaacgatgcacacattccgccattgcccgggtgctgtgttctgctggaatcccattgttctctgcggagctgagtttggcaattattacagttctcttgtgtacgtttcatttgttgatttcattttcctcttgactggatgagttaattcccattttacataaataaggaaaagatttcttcagctgatattaggttttaaacactcttattagctgtgtacatgaaaccacctttattacttactacttgctttatcttgttaaaaaaagagaccacagaaactcaaaatatgtatgtgcgtcatcatttagagaagtaaaaatggccctagagaaactgtttaataacattatgaagagctatgagaagggaagccacgtctatctcagtgcataaaaggctgtgtgcattcaatttcagttgaagaccagttctctcatgaactgaaatgttccatgtcaacaggagatgcagaatcatacttgtcattggagaccaaatttggtaaatttcaaattcctttaaatattgttagttccatagttatggtgggcctcaaatgtttggtttaactttccaggttaaaatcattcattttggagggcgtggagttaaacacatacaggagagtaaagagacatactctttacccctcctttttatttatttattttttttgagatggagttttgctcttgttgcccaggctggagtgcaatggcgcaatctcggctcaccacaacctctgcctcctaagcgattctcctgcctcagcctcctgagtagctgagattagaggcacgcagcaccatgcccagcaaatgtttgtatttttagtagagacagggtttcaccatgttggccaggctgttctcggactcctgacctcaggtgatctgcccatcttagcctcccaaagtgctgggattacaggtgtgagccaccgttcccctcctacttctcctcttatttgcaattacgccctttgtctctgcctcattttctctgtctcgtacgtgcaggctgactgcttccaaggtatgagattatttattacattagcccgatcttgcctttctacatggaagttgtcaacatcctttcttgagtcatgtgtgggtgtcaccatggtgtcaggctgtggaggtaacagaggagggaagaagaaagggctgctaagttcaatccatgcaggcgaaggctatgcgacggggaggctgtctgagaccctgttttggaacccaggacggtcttggacctcagaaatcaggtggagcctctcagtggcaccctggacccctaaagagagggagggaggatcctgaggacaggtgtgacaggcagcctgaactgagcaggtgctgtcctctctgcccctcctccctgtaaggtgtctaggtcacctccttggagtcagaccaggcatgatttgtggggtgaagggaggctcagaacacggctgcagggagcgcgtgctttattaggaaagctctctctgaggacttgaggcactgctgacaggaaaggaggttttccttgtagtgtgtggccctggaagaaagagctgggaccaatagggaaaaacataatcattcagagtttcaaataaatggaatggccagctgtgagggctccagcagatttcataaaccgctcagcaggaatagaccgagcggtgttaaatcctgactcattcacctgtacagttgtttcacatccaccttttttgtttgttgcagtttttattctggaatcattatttctagatagagagcatttgcatctttttttaacaagataaacttttaaagacatttcattttatttttattatttttatttttttaagacagtatctcactctgttgcccaggctggaatgcagtggcgtgatctccgctcactgcggcctccacctcctgggttcaagtgattctcctacctcagcctcccgagcagctggggttgcaggcgtgcgccaccacgcccggctaattttttaaattttagtagagatggggtttcgccatgttggccaggctggtctcgaactcctgacctcaaatgatctgcctgcctcagcctcccaaagtgctgggattacaggtgtgagccaccaggcctagcctaaaaaatgttctagaatagtcttagatgcccagaaaagttgtaaagtcagtttggagagttcctatgcactctgtgcccaggttcccctattgctaacgccttgcacttgtgtgtacattggccacagctaatgtgcgacactgatgcatcattactcactgaaggccacgctctattctgacttcctcactttttccctcatgtccattgtctgtgccaggatcctgtgcaggaccctccattgcagttagctgcctgtctccttaggcttctcttggctgtgacagtttctcagactttccttgttttggatgaccttgatggttttcaggaggactgatcaggtagtttgtcaaatgtcctcagtttggctgtgtctgaggtttttctcatgacttgcctggagctaggattttctggagggaaacagaaataaagcgccatcatcatgatatcaaggatgagtgctatggacaggacttaccagtgatgccactgactttgatctcctggctgggagagtataaaatatggaataacagaccaatcccagaccaatccctatcttcaataggcccagatgctggtgagcagtgcctgctctcccacctccctgctctgagctcctgtcctccccctacccaccctcaccttctaagcccctctgactccgccccagtgccctgtccttcaagaggctcacgttcccctcactccatttcagcgactccctccctgccctattcccagcacgccattcctctgttctcttctccatcatcctccataggtttactcatgtatttggtggtttacctcctcccgtggagtgtgggtcccacgaggcagagcctttgcttccttcactgtatgtccagtcctgacaacagtgcctggcctggagtaggtgcttaggaaatgttggactgatgaatgatttgtaggaggaaaggtcacagcacttggagaatggttctgtacctctgaggttacaatttgggggtgggaatggctgctgctaggccaggtgaggggccttcctgaggtgccatggctggaaactatatcacttggctctctttggcttttcccataaacttgtatttcgagaattgtgggattcaatgacactccatttttcactttgctttacacaggtctaaacttttggttattgtatgtgttgtgacaatgtttcagaagcacattgtctaggagtattaaaatggttttcaatcagagaaatatgtcagagttcattgaaaacataccactacagcaaaaggaaaaaggaaggctgatgaggtaagagaaagcactggaccgcgatccaatttacagacttgaaagggcaggctgggttggtctgagctgggtctcagagtggttttggcccttgctggtttcagcacttaattgtgtggatttcgtaatacttcacagttacggttttctagttcttggcttcagcacatgcatggtgatgggaaacatatctaaggaatttttccttctattaagacatggagggctcagtggcaagctgtaaaagactttcttcagcattaattatgtggttagagaaaataaatgagcaaattagagaattagcaccaaattaaaacgaagctggattggacacagcagctagttcagattgtttttgcattttggtgataaaaagatttttcttgcttgtcaacccagcattgaacaatgaaaagtttagggacatacttcgctgttgatgccatctgaagaaaacagtattaaacttaagattttttgttttttaatttggtcaatccatcaacaatgtgttatgagtgccaacatttaattgggaaaaaggttttagaattctttttctaggttttagttgaaagtgggatactcacctaaaaaaaagtcacaaccaggatggctctgcaaatgatattggcatttatttccacactccgtcagtatacaataacagactgatgccttagcagctccatgttttacagagaaaggaagaaaactcaccacaaacacacaaaatgagacaaaaactcacataaatatgctgggaagagtggagctcaaaattatatttatggctttataatatgccatagttattaatttaaccctgatagtgataattcaggtagcaggtatccccaaatgagtctttgcttatcaagcttaaaaaaaaattttctgctcttgcttggagtgaaaaaaaaaataggtgaaagataaacatgtcattctgggctataaaagtatcactgagattcatatttttaaggaagttctttactctcttctgttttgagtcagcatctcctctgttttttaaaataaagtggtcattttctccttatggggttccattaagatcaagcagtgcacaagctcgtctgaaaaggaagtaacatctgatctgaaagtgggggagggatacaggaacatcaaacagataaatgggagaacacacagagaagttgcttatggcagtggaattggatggaaatttctgggcagtgagtaggttggcataattgggtgaagttttcctgctttattttctctccataaatcatgtgtacatttatttcaacctttaaataggatatccagaggaccaacttagtaaacagataatagctggaaattttgagatcattcattcagcttccttaggtgtaaattaagtgttttagacaaaatatgcatttcttaaatctctaacattggtgataggccacctactgaccttccaaagttaatttactgccaaaagaatatgccttttacctgaggaattagctggctcagctaagggcccattttatcatcaggacacataaaattgtagatttaaatggagtcacagctaaataaccgatttgtaaaaacataatttaacaattctgtagcaaatcaaacaatttatgatggtgcatgagcaaagcactcacattatgtcttctgcagatccagctcttcttggggaaggtttcggtggattttttcatcgttaatttttttgttttttggtgggtgaaatagagttgttctgctctttgtgaattgcaagtcattttcaacgtttttgtctggtttccatagttactacttacgcttttggaagagaaagcaaatgtttcttttaatgtgatgaggcaaatcgttgcttctgttggcctttttcacctgttgctaccataaaccgtgaccagaagggagaacaatcctctatgttagttttctgtgttttttctttctaagtctagaaattgagtcactatgattacaggaaagcagactggagagggtcggctcattggtaaggcacagcccttagatgcttttgtgacattattttcttcataaccagctaggaaaataatctttataaacttcataggtttagtgatgcacaaaaactgatcattttgcagattaattacattaaaacccttctcttagtcaagggattccaaatcatcactagcttcattaattataaaaattaatttcagtcaattatttgaaaaagtgaactacaacaggtaacttctttgatcttgtttgcactcctggtgtttattccactgattctccaacctaaaggcacagaggacctggggattctgtggagatgcagaagctggtccaggggttctgaggtggaacctgagagtctgcatttctgtttccagataatactgatgccacaggtcctgggaccccacttagagaagtgagtattgatgccacatgcactttcagagcaactgcaatccttggagccaattcccttttccttctgcaaagacatttagtgaacagaccacatgaatttaaacttaatttatggttctttagaaaaaatgtggcattccccataggcttcacagaattggtttctctgttggagttttggtagttcagtagtggccacaaggtgggcttgctcccacccactccggactggacatgttttagtttgaaaagaacagatcgtacttccttgacatggatgttccagtgttaatgtcactgagaagaaagtaaacactcagggattgatatgatagtcatgaagtgcactgtgttcacattgacaaccttctatacttttgaagaagcccatgtgagaataacaggatttggtagaatgtagagatccttttcagctcagtggtattattttgccaccattgggataggatgtaaataatgggtgtgttctttaagtaagaatgaccatggatccctggttcctaaatgcctctcagtgcttcccctgtgtcccagaagacgctgcccccatgtggctccaggatggcccgtggtcactgcttttctgattctcattggtcttccagttgcatggggaggggagccaggcttcttgcacacagatgcggtttgatactcttccctcttctggggttccaggatgctttgatgaagcaacgtcttaggaaatggctctctccttgtaaatggtcaacccctttctccacacaaactgtcgtgtctcttcacactggttccctggggtgggatgacaaaggattctcttgttcatactaaagtgaagacagttttctacattttaaaattttgtccagtgggcgttataaccttcacagctgactatacgggtagttcactgtgagagagtgtagaaatggtaaataagagaaatctctttttctagagattctaagtgctgcttccaacggtgctatgaaatccttgccatgtgtacgttccctgttctccatgtgatgggcaaaactcctgctcttcatggacagcaggtgtgtgtgtggtgtgtgtgtatacgtgtgtatttatgtgttgcgtggtgtttgcgtatctgtgtctgtgtgtggtgtatacgtgtgcagaggtatgtatgtcatgtgagtgtgtctgtgtatgtgtgtgtgcatgtctgcacacctctgtaaaggcagggttcacattggactcagcagtgccttgcacagtgctttatataccgtaggtgttcagtaaatttgttcagttaaattgaattaagcacatggtacctgggctatgtttcgttcaataaaaagagattgtttttgcactgatttcacaaatgtcgtaactatattcagatatgagaaaatgatttaataagagaaaagtgtccctgtcccactttcatttatgaggtgctacgtgggtggcagttgatggagaagtgagatgtcctatgggtctccaccttgactagggaacacagtttggttcttagcatactattttttgggaaggttaacaaattaaaatcccatgattaagtgaatttcagattttacactgacattaagctgttttcttcttcatctttttcttatcagttgctcttaaggagctggatctgacatgtagcagcaccttcctgacagctgctattcccggggactatcaggttagctgcattaccctttggactggccggggtgtgacagaacatatctgtcatttgttagcagctgcaagctcttctgtttgtgtcattcttatggggtctaaaattaattgggaacattgcacgttctcccaagttctttgccaactcccctattgccataaccatattacacatgcatttttcacacttatttcaaggttctcaatgaaaatttcttaacgtcaaattaagctgccctatgttaacttttaaaggcatttttaagtttccgttgcatgacgaactagagatggtccctgccttcagatggttggacttacagtttttgacttcatgatggtgctaacatgatatacattcagtaggagctgtactttaaattttgaattttgatcttctctcagcctagtgatatatggtggacactctcttaccatgctgggcagtggccatcagtcacagctccgtcagccacttgatcacaagggtaaatgtccaatactctacagtggactgagttgccaaatgatttttgcaactgtaggctcatgggaatgttttgagcatgcttagaataggctaggctaggctatgatgtagtttagtatattaaatgctgttatgaaaatacgatttaagtgtaggagaaaaacattttgaggaacatggctttaaactttttagtattctctgttgacagaacgagagaattgcaggatcccaccccacaattttttatccataaggttaatgatgcatggagctgaggattaagtttgagtggaatctacactaaccaaaactctttttaagaatgatctttttgaaggaaccttagcaagcatattttcatttgcaaggtgatttaaaagtaacagttgactctccatatccatgggttccaagtctatggattcagccacctgtggatcaaatatatttgggaataaaagggtggttctatctgtactgaacatgtacagactttttcttgttatttcctaagcaatacagtataacaactatttacttagcatttatattgtattagggattgtaagtaatctagagataatttaaagtacatgggaggatatgcataggttatatggaaatgctacactattacatatcagggacatgagcatctgtggattttggtatggggaagggtcttggaaccaatccctcaggtatactgaaggatgactgtagttctaaatgattgacattaagaggttaacctctgctgctgtggagggtgtgatagtccactccaaagacgtccctgtcctaatccctggaagttgtgaatgttacctgacatggcaaaaggaatgatgcagatgtgattaagttacgggtcttgaggtgagagattattctgcattgtccatgtgggtcttaaatgtaatcgtgagagtccttataagagggagcagaggaagatttgctgcagatagagaggaaaaggcgatgtgaagatggagcagagagagaattggagatgccctgctcctcccttgtagatggaagggaagccctagcccagggaggcaagcagctctagaagctggaaaaggcaaggaaggaaacagattctcctctatagcctccagagggagcagggcctcgctgaggtcttgattttgtcccaaggaaactcgttttagatttcttacctccagaaatgcaagagaataaatatgagttgttttaaggcactaagtttatgggaatttgttacagtggtcatttgttacataggaaactaacgttccactccactatctcactagtgagcttttgacctaagagtattgagttttaaaacataaaattaatgtttaaatgtataatgagcctgtatgaagctataattgctatagtaattcaaataaggggataattaaaacgtaaaaatattctgaagtcgactctggggcatagattgttaggaaaggcttcagaagtagatggaatcagtgaatctttagttgcttggcattttaagacacagctctgtattgtaccatctgttttgtgtgaggagctgccgccgccacaatatcatacaatcactggttgtaaattttgttgaagccattatgatctctttcttcccaacctttcctctcttttccctctgtcttcccctaaacacaaacatgtgttccaagtggttgaagttttctggagaaccactgtataagctgtgcacatttttgatttaatgaaaacttctaagacatcctgaaaagaaaaagtgtttttccttttaaagaaatttgatggaatctagaggatttgatgcctttttgggtgaaatccaatgataggattctttgctagattattactttttcactctgtaaagttttctggtttaatactattatcggaatgaattattaacatccctaaatttaccaagacacacatttaattcatgtgattgtgtgattctttttaaaaaaacatatcttgagatgggatatttattttcttgaaaaattttagtatgaaaattcacatcaacatattatatttactctagtcctcagcttgcatatatatatatatatattatatatatatatttgcatctcatttcagcaaaataaggcagagcattttttgcaacttggatttggcttccttttattcttcgttttcattaatgcgttccttgctttggcacagaactctatttggtttgcaacactctaggaaaaatgcttaattactgaaaaactttgaaattcaggaagaacatgcaggggagcgtatttgttcaggtcacgtttatgtgactttcaagaacagataaaaataatctgtagctaaaccaaattggtgctttcgttgaaaggatttggttgtcagtgggacagaaagaaatggtggtgtctaaggcttcctttaatttaaaatgccttaaaaggaaaagcaggatgcataacagagcctctgctggcatgggatcaggctcttcttgagatctttccagaatactcaacaccgtgcagcagaattgaacattaatgttgacttttaaaaccactccatgtgcactgagagactgctcagttactatgaacatctgatcttaaaaaaagaaaaaaaaagatagaaaggaaaataacaccggattatgagttagaagaccagaacttcagcttttggattcaccacttcctacccacatcactttagacaagtccctgctatgcactgagctctggcttcttcatttgaaaagtaacgatacctattttgcttcccattcagagggcttaggaggatctaagggttaggtatatggaaacacatagtaaaatatgatgttatatataataaaaaggaaatgcaaaattatgaagttattttgattgttgctaaagtcatacaaaagtaaatgtttagcacgcttttttatgtatggatgaggttgagaataatcagttatgctcttatgctttgagacaagggaggtggagctggggctatgtcagctcctctcttttctagaagccacaattttgacttcctttgactttcattgccaggaacataagactgatgaatacttctctgccttcattcatccccaaactgtgaaggatgtttccaagacttttcttcttttgtctctggtcaaaagagaacaagatatctgtgtaaagaagaagacaaatcatattttgtcaggataatgttgtctgccttagtgttacatactattatttatcataacttgccctcaaattgtttgttttctagttgttaacaggaattcatcttcattattatttaatttatttttaattgacaaaagttatatatatttatagtgttcaacatgctgttttgatacatgtacatcttgtggaatgattaaatccagctaattaacatatgtattaccttatttacttatctttcttttttttgtggtgagatcacttaaaacctagtcttaatttaattttaaaatatacaataagtttgtttagtcaccatgtggtagaatgttaactttgcttttagattatacctggggcacaaattacactacaatatttcaggttacagaggtcttctgaaagagctaagtggtctcaggctctttaatcaagactgctgtctccaggatatcagagacttttccttggattctgagtagcatgaaatgatactgcccaaataattaccactcgagatagttttcaccgttggaattaccttctgaattagccagatgaaaacataaggctctgttgtaaaaagaatgtatctctttaacttaagggagtgtgaactgggaacaggatatattccaattccatatcaaaatgagtaacagagataagaggaacatcacattatgacatcacaaaatctcttgaatgtgatgtgcatttgacaagctgtagaaggactatgtagcactgttgtaaatatacctataaaattcatcactccaagagttaaagaatatattataatgattcattgtaaatgaattccatagggtttgaatgagtatatgaattaaagagccattaatgactactggaaaattcagaaaatttctggtacactagatatcaggaaacacagtgtgtgatactcacggccacagatgcaaacgaaaatttgaatggcctaagacaacaatgacttctcgggtatcttctggaatgggcatggcaggccgaatggaccatggttcagttggtgacaattcgtatgtccaatagttgtcaccaaaaatatgctccaaacttgtttaactcagttccttgaattatctgaaattatattttaaaacatttctctattgagaaattacaaaggtagccttaggctgaaattctaattgggaggtaaatgaagggaattgtgatatataccaatacatgcaaaattttctaaatttgcattaacttgggagaaggattagaaatataatatgttttaagaaaatgcaatttcatttgtttcaactattagctgtaaatggaataaggttgacaaatagttccttaaaggaacttatatagttccttaaaaagtttgctataacccgtttataaaactcctttgcaactaaaagtacaatgtaaaatatcttttacaatgctatgtaaaagagttcttacaaagaacttgaaaaatcaagtttccaaaatgcgttatttacttcccaatagtttgtgcttaccaatctagaaataaatagcatctatgaattacatgaagttgccatttgtatgtcaaaatctgtcaaatactggaggttttaatgtgttcaaatacacactaattctcccaataaagcaataaacgtttgttgtattattactgtctaacacagtgcttggtgtgctgtgaatcctcactgaccctttgtagaaggaatgaatgaggtcgtaaatgaacagaagattgaatgagtgaataggtgagacttctgggctgggcgttgtgccagatgccacgggagttaaaatggcatggctttcaatcttaaggctatttcttttaatgttctttccagattccctggaattaatttttccaccgtcgtggccccttggaggttgcctcaccagagagtccttccctagacattctatccccatgtaaaatctgttgctttttcctctgcgtttagttcctttctccctcctattacttgaaataatattctttctagtttatatactttttgttttctctcttctccaatagcgttcatgattggaggcaccttgtcttgttcagtaatgtctccccatttcctagaagagggggtggcatatggtaggttctcaatacatgtttcttgaattaatgaatgagtggtttggagaaaaactatctagtgagagcagctgatttgccagtggtctaactcagaaactcaactttaagatgaaattctgaggcttcttacagagtttagagtattacaatgataaactttgggtacatatggatagtctaatactgtggtattgcaggggctctgaggctgtagaacctatatccactcattaaataattttatgttggggccgggcatggtggctcatgcctgtaatcccagcactttgggaggccaaggtgggtggatcacctgaggtcaggggttcgagaccagcctgaccaatatgatgaaaacctgtctctactaaaaatacaaaaattagccgggcgtggtggtgtgcgcctgtaatcccagctactcgggaggctgagacaggcgaatcacttgaacccggtaggtggaggttgcagtgagccgagatcatgccattgcactccagcctgggcaacaagagcaaaactctgtctcaaaataataataataataataataataataattttatgttggatgcctactaagtgtcaggcaatgggtacttagcggaccatagaagaaatgtaaaagtgaactttccaaattcctcctctcatcctgctcttttcttcacccctgtggacacctgccttccccttgtagtgatgctgtcctggtgagtagtagaaagcaccaccttgtacccacccataccctctgcttggccagaattgctcagtgcttgcagattatgtaaactcccttctctttttaagtcattgatttatcatgcctgccattttcactgttgaatctgcagagttctgataagcatccttggggttgcctcattgtaaatttgtccctagttgtagatccactttttcttcatcctatgtttttaagcatttactctataataggtactgagaatacagtgacggagaagacagacatggctgtgaaacctgtcagaacttccttcgtgccaaagaagatgggtagttgcaacatgactacagtgaagtggcaggagggctgtggaagggaaaatagagaaggatctggagcacagagcaggacggtggtaagcaggggacttcaaggaagaccttacaaaggaggaccattctctggacacccgcagaagggagaaggcctaggtagacagaggggaaggctattccaggcagagggagctgcatgttgaaaggagtgtgatttaagaaagtttgcagcagccaaaggactgaaaatgctggatctggctaatgtccattccacagtcactggtatgcattgatgggaattttacaaactatcccttctgcaacgtggagaatggattgcagcaaggagcgatcagacgcaaggagaccactacagtggcgacatttacagtggtgataggggagtgggagggaaataggtccacttaaaagatatttaggaggcttgatgtacacgattcggtgactactggatgcggtggtggtgggggcttcatgaggaagagggagatgacactccctggcatcttgctcaatccatagaacaggtgctctagtgaccaaaatgagaaacagtggagaaagcatatgctgtggttgtttgtggaatgcagggtgataaattcgaagctttgtatcttcagactcaacctcctcacagtgactcatctttccctagttgctaggattctatgatcacgttctggaaatgcttccccaagccagctttctgaagttttttctttttttcttttcttttttttttttttgagacagagtcttgctctctcgcccaggctggaatgcagtggcgcaatcttggcttactgcaagctatgcctcctgggttcatgtcattctcctgcctcagcctcccgagtagctgggactacaggcgcccgccaccatgcccggctaattttttgtatttttagaagagacggggtttcaccatgttagccaggatggtctcgatctcctgacctcgtgatccgcccgcctcggcctcccaaagtgctgggattacaggcgagagacaccgcacccgtccctgaagttttacctcatgctagaaaagcagccttccacggtgggtgcctctagggtagagcacgagttctgcctgggtcaccattcagcacttgcaggtgcctgtttccttctctcttacactgactgagactttatctcaaagactttacaggagattgcgtcaaatatggaagccaagaaataaggaaagacctcaggagtacaacctgtaaagggcaataagcatttagagctgtactgtgtagaaaccatggaaaagcatatatgacaagagagtcaatttattcctgaagaaggtgattaaggcatgtgtgggaaaaacaaaatgatgacatttagataaactgttaccgggaagtcgtactgcaccagatggcatattctttaagactgctcacatcccctctctctgaggaactagttaacatgtaaatctgcaccaaatactctgggatggttttaacctgaaagtgacttgaagataatggagatacacacccactattttagggcaatggtgaaaactcaatcacgccttccatgtcgactcaggtgcttctttattacagtgagaaaacatgattaaacctaattgcaatgaaacacacccatgtcatttattacaattattttatttctagtaaaataatacctatgttatcttactaatggcacctcctttctaacaagagtaaacattgctctacaaggaattgatgcccatttgatttttgtattggttgtagcaaacttaaaagaaaccagctttcaataaatactcagtaagtattcaattttaaaagttatctcagcacaagctcatgagtctgggaggttacaggaaagagctccctgtaggaaacacagtgatcctcggatagcacatagagggggaggcatgatttcagcatgaaagtgaacccatgggaattggtgttgattgtgttctgtgacctgatgactggaggtgctgctctggaagctccctattggccttggctttcaaataatttgttttgataaatttcatcaccttcttaacatgtccatttgcaatttttgcccacaatttgtaagggatgcattgaagccatactgagattttggaccccataagccatcttagaccttattttgagcatacaagagacctaggaccttccctttcaaccctaccccatggggccatatttcgttgttcattaagcatggcctccgctttaaatgggatctcttgtcggcagtctctctaagcactgaaccttgtaagactgtctggatagttacttgcagcccaaaatgaaaggtttctaatatgacccattatattaatttttcaaaaataatttgggagtcaccctgaacattagagctgtttaatatcttattagatcttcatgtattaatacattgcatagcagctaaatgcagatataaacaaactaagaaatcgggcaactttagcaactcctcaccaatggcttgaatttaaagcaatttacatagcctgctaaaagagtgtccccattatagctaaaataaaattaaaacttttgcaactaaattggcctttgtctattgctcagtcttctaatgattctaaaaagaagcctaaattatctaatcctttctattcttttatcaataatgtaaattattctggtggatgtgttactttaattatacttgaaagtttcacatgaggttgaggaccaccagtagtccagtgccatttctcttgatatctcaactcattctttatggttttagtttctgcatttttcatctggctctgttttgcagcttgcatgacagttaatctaccaggacaaatttctgattgctcactttgagactattcctattgatcacagaaattgtaagccagaaagtcaaagacaacaaagaaaagtcatggtacttatccataaccctgcacgatacctcctagcagcagttagaaataaatcattgacttagcttcggccatttggccttcctcttgggaaaagctgccagcagaggtgttttgggagccacctgcaaggttctccttcaccagagtcctggggtgactatgtttgggttctggcattctggctgctctcctttctggaagagagagactaagtaactctcctgcaagcgcttcaggggagtcaaatgaaccagtctggtttgacaacttgtagcattcaatcaagaagccttccaaggggaatatgaggctacaatctagcagactatttcctgttttccaaaacatccaggctgtatctgagatcacccactgttaattattgaaaataactgatggagtgtgggggtggtttgaaagtttgagtcataggcatgtgaagtttaatttttaaaaaattatactaaatggatttcctcaggaaaaaccaagcccaaatgagctctctactgaaagcgaaatgcttttgccttttgccttctagaaataagtgctagattcagggcagggaaagggaactgggactcacatccttggtccccttgatatgaaatcagcttatcattgtaggaatactaaatatttctagattttttttttttgttttagaatttgtcttttctgctcaaatgcaggataaatagtaaaactaaattagaatttcaattcttcagtgttctgaactttgttggaatttttgatcaggagaaattatgtactaagtaacaagtatttatttcagttaaaaatgagttacaaggctgctatgatgatcggatactatctattacaccaagcacaggggtgaggaaaacagagaggaaaatggaagcctttggagaaggtgatagattgaaaaatgaggatataacataaaaggaacccgatgctttggcccttgccattgattggacatcagggtataatccgctggcagtgttgctgtcaatgtggtatctctgctcgggacctgtggtgacccagctcccatgatttggctcccagctccttctttgccctcattcactgattcctcccttgcacctgtccttcagcctcatgtactcacttttctttaggaagggttctgtgctgatgcctcctcttcaggggcagctctactgaccactctgtgtaagtcctacgaagcattccccttgcgcctcaccatgctctgcccttcacagcacttgtgcttacctgctgttgcatttgagaccccggtacttattggtttattacctgtctcctgatgtgaatccacgttctgcaagaaaggggactttgccctgcttacttctgcatctctagagcttgcagaagtttctggaaaacaacagaagctgaatatttcctaaatacattaatgaaaagaggttttttgagttttgtggaaactgtatttgtaaaaataaactttttttcttggttttataatattagcaagaagattgcaatgtataatatgatgctagtgaaatgtatttcttttcttttcttttgtttttttttttttttctttttttttttgagacggagtcttgctctgtcccaggctggagtggagtggcgtgaccttggctcactgcagcctccgcctcctgggtttaagcgattctcctgcctcagccttcccagtagctgggattacaggcatgagccaccatgcctggctaatttttgtatttttattagagacagggtttcaccatgttggccaggctagtctcaaatccctgaccttgtgatctgcccgcctcggcctcccaaagtgctgggattacaggcatgagccaccgcgcccagccgtgaaatgtatttcgttataattagagggaatggtgaatgccagatgccatttatttagcactttgtctgttccaggcattactctggacatttattgacttaaatgatgccaaatctttgggttttaaataaatctatgacttaaaattaatttttgtttcatcctaagaagttgttttataatattcccagtgtggcgggcaatgaactcctctatccttaaagagagatggcattgtaagagcagtgctgttatgcagatcttcatccatgagaaggtgtccaacatttgaagtgtttatttttaaaattttaaatgcaactttaggatgctacataaaatacacagagatgattccatgtgaagttgaaaccattcaaggttggctccagcgtgtggatgaatctgctcagtagcacatggtaatggagtgaacatggatgttgtgagcccaggctcttgtgtttggctctgaaattaactcactgggagcttttcatggaaatagatagtctctaggacaccacctcctagatacagacaggctttccccagcaacctgctatgagcatccaagatgttacctgtgcctggagccctcggggctcttttagcttcctcttccctgctgaacctcacagttctgccttaggtcatggtctgtgttcctaaggaagaaagtcagacaagtctcttcctcctggggggtgaagaagtgcccctcttatgcgtacctagtcctgcaaatggatgagtggtttcacaatgtattttgaattcattcattctgtctctctctctctctctcttttatgctattttcaatactggagaagccagaggctctgtttcctttcactgacagctttatcccagttattcatgtattccctgtgctatcattatttggacacagtgcaaaatgatcaagaaaatgccttcactgaaataaaacttgtagctctggttgagtccaggtttaatgtgctaccatccctttgggaaaatatccaggaaatcaaagaatggaacaaaatctgttgacccctgacacttttcttcttgtctttgctttcctttccttcttccttctccgtcactctgtccttcccccaattagaaccctttgggaaagggtatttagttgtagagtggcccctgttttctcaggcatcttgtctctggtggatttcaaaggcttgctcctctccttgaagttgaggactgcagtgctaaaggcctcccactatgactgcgctctctggtttctctgcgagcctgccaagtaccaagtgacaagctcagcacatgtttccttgggcaggactaggctggctgacacttgaggaagcccatgcaactctgtaagctcaagacacaggatgtttagagatacccacagctgaaagcgactccaggccagctctctgctatctctggcctaagtttttgctgggatactgtcagtcttgtcatgaatgtctcagctacttcaaatcacatgtgcttaaagtatggttggctcagcctggcattctcaccctgggccaaatggtgcctctgatattcatatatatctgtggataattccttaaatatatagggaacttcatcatgttgcaaatagttggctgcttctgcttttatttaaattccaactatgcgtgttacacccatcctctgtcttaactgctacagagaaataaaccctaccctcaaggagaaataaccatgctgaacacaggaatgtgttgtgtttcctcagttcttaacctggatctttcagtgacttcctcaatattgttgttttttatttaaaaaaatatttagggacaaagagtaagagccaattcagaatgctcatgattaaatatttgtccatttaggtttctgtggtagccttcatcagtttgaatatagtctctaggccacaaaaaaatatagatacctcaattccatcttatgcttagtaattacagtagaacaatctagaaactgagcaagttatgttttctacgggtggatgaatggaaagttttgggttttccattttgtaacaggaaaatgagtagctgcacctatgggaaaacccaattggtggcacattagccaaccaagacctgtgtttttgtcatgtaacagctatgtgtcctgagtccttgggtgctcttggggtgacgattggaacccaggcttttttctcttttgctcagtcatctttggcgagtagtttttgtcttcatgtcagtacttaaagggtgtaaacagctgctgcccctgcagcccagagcccggattccagcaggaggagggaagggagctggtcgttccttctcttgagtaggggaagggatatggctaacatcagcatctacttcatgtttctgaactcctccattgctgacattgcttttggatgctttcctttgcccacttaatgctctttctgtattctctacataggaaaaaactcagaaggatgtgtgtgtatgtttttatatgtatacttaatacagtatttcatgcacacacacaaatacacacacacgtagacacatatgtatatgttgacacttatctttagagtaaaggtaattcattggcaatttagtttctcttatctcagccttctacattttaagaatgcaagtaagcatagactttagttttctgtgttataggaaatttcaaatagaggtcagagattaaattgtgttagcaaccattttgacacaattgcatgaaactgctgtggtgttttgttatccaagtatattttaattggataaaagccattttattcagaatattgttgattcttcccatagtctttgtattaaatcatcataaatatcaagaaaatcagtgtaagaaattctagcctcacacagggaccattatattagtatctagatttttttcataaaggcagggatggttaattcttccactaggatattaacttagcttgatatttaattaacagtttaacttctgaagatattgatgaaagattctcatacagtcaacgccagattagaagaggtgtgttggcaagctccaggaaggcagggaaagcctcaggagggagcaagtgtgcttggaattgtagcataaacatattcctctcctaaaacacatataatgtggaccgcagccaggcacagaccacaacctgaaactctgcatgtggggttgccagaattagcaaatttttcagtataagtataccctatatactgcatgtgatatagttatattaagatgttattcataatttatcttaaatgcaaattgaactgggtgtcctgtattttatccagtgccctatcctcagcaaacctcagtgtgggccattgtgtgacatcagcatggatcagctcagtgggttccctgaggatggagtgggatgatgtctggatcagttaggagaaaatgagtgtcttgctggtactacaagacgcactttcattacaaatgcacatgtcaaaagctaacatgatgaaaaccgttggaaggtttgctgttttgccagatatttcttaacatgtgtcttatgagcagaagctctcttgtcatttggaaagaatatcacttcagaggccccatggggatgacatccgccccaccatcaggatcaatatgtagtgaatttatgaaggagcaagttcaagccatgcgctgcatttaataatgcattataataacataaaatgagctgaggattaatcaaaactttataaactggtgctaaattgacttagtaatttacatctggctctgtgtggttggcccattgacaataacttatctccaaaaagttgcatagccatttcttcttaattgcatatgttgcgctgtagggtgatatagaagatattaaaatatgagtaacagatggatactggctaatggagcttcagatctcatatattttcttattgttttctatttatttatgaacctattgctgtaaaataaaaccttttttttttcagggcagaaccagcttcagacttttttccccaagccttcttatttcggtttcttcttgctatattactctatgatggaagcacttctgtgctctgtgctccatgtgatgtttggtttttgttattagtggatgaaagttaatgatacacaaccagactgggacactttgaaggtaacagcaatatctgtgtatagatggggttgtggttttgttatttatctgctattgctgtagtatcctttgtcttgagcgataaaagagaagtaaaatactaaagaactgaactgtccatttctggaccatgagtaaagatgctgcctgtcaaacttcctgttcatacattagtttatttatagagtgtactctctatgtaaggtattgactgataatgttactttgacttcagatagcttgcagtttaatggaggaagaagacaaacatgcaaataactaggtcaatgaggcatcctttgtgttccattggaagctaggctgctttgtaaccttgttaatttctgtggttttggagtgcattcattagcaaatacaccccttgttcttatccattctctgcttttttctttatttggcatttgatgacattttttcatgtggggaaattgagtcaggtgaggtggaaagaaaataaggacacgacactaaattctttgatgtttttccttaaaaaattgtttttcaagtgctccataaaggtttgtgaagttttaagagcataggacttggattattgtgaagagtgtctctaggggccagttaaccatttcaggactctcttctctcatctcccttgttccaccaggtggcaccacaaaagcacaagcctccttctcatggaaggtaggaggaggacctttcgctgcctatgtttacatccactgctttgcgtttacacacatagttgcggcattgtcataattgcagcattcatacattttcattacgttccttatagcttgccataactaatatatctgtttgatagagtgaattctgtaattgttaatcatatacacagaacatgtcaaataaatacagacgaaaacacaggctaacaattccacacctaacccagcccaaatcatgctaaacatgccatatatattcacagtttaagtttgattccaggtatgcagtcttgagtcataatggccccaggcatgacaaggttactgggtcatagttggttatcgtagtacttagacaacgtgctcatgggaaacaaacgactccagggtgtgtgccgccgatttgcaatatgaggctgatctactgttcccactgttttattccctgctgctatatctcggctgggaaatgtacgctgtggaccccgcatcttcataatgatggtccctcaatgatcaaccaccttccacgtagcatccatacagtagtctgagcaagctgaaggataacaagcttaaatttatcttttaaaaatgtcagaacttccagaaatttgtattaaaatttctaaattgtatttctgaaccgaaataaagtattacaaagtttgtaattatctccaaagaattcgatggatggtgaatgaaagtccttttcccctcgtggtgacattgctgtatttagacacctcagattatgataatgatatacttccaaatatattatcataaatgtggtgcctggccccaggatggttatgacagaggagtagtgcctcctggggccatatggcccaaacagaggaggtgtggctctgcatcagttagttttcatatcaaaggtaagctccaggttgggcccatggccatctttaagaactgactagcccagggaggggcagtctcttcccagccagaaggcttttttaaactatcaaaacatcgtagtatacagaaaatttaaaaatatttacaatatacccacttacatacaggatcagatagactgttagggttaacttgggatggtgtcttggcatacatctctgtatacagctttgcctgtgtcatgtccccaaggagttgcacataatttactaagttagaaaataatagaatgaatcttcctctaagcagtagccaagagtcaaacgacagaccaaaagagggactaacgggaaatgtgcagttttaggaagaaattaatgaaggcaaatcaacctagtggttaacagcaatagcttcatggctgagccactgttccatcacttacttgctgtgtgaccttgaggaagatattgacatccctgtgtctctttttcctcatctgtaaaatgaggacaatgataatacttccacatagggttttttgaagattaactgtcaccatctgggacgtgcttagatgcctggtatcttgaagtgcaggctaagtatttgcaaacacagtctttatcaagtgcctgcgccagagtatgccgtgccactcgacgtcaagtctcacatattgtgaggtgtacccaattattgagatgtcctggaaaacaaatatctgaagctctggctagtttctccattatcggcactatagccgtctctatccccagtccattgtgtctgaaccgtatggactgtatatttgaaaatatcttagaaaagcagcagtcataaaatgtcagggcttttttaaaaataaaaagatacttgtgcatacattttgcagcaagatgaacaatggtgatgcttttcctgagaaaccagtgatgctgactatatagaggctggttactcttgggagctcatcattgatcatcagctgattatctccttagctttgtggcttcactagctcccaagtgtttctgagagaaataccatgtccctataagtatctaatgtgctcaactaaaggggagagaaaaatgctaccatgtgatactctctttaataaggcattgcatttgtaagactgtaccagattaactagtttaaaagacaaatattgaattcatatgcaaggctatttcaaggcctgttctctctatgcatattaaaacacaaatgaatggtgattatctcaaatgctccactcggagctttgtcactcctggtagctggtagcaggttgtgtgtgtggttttatgggctttaaaaagatcctcatagacttatctgtaaattgtggaaatgtatatctaaaaattctgtagaagtgaaaaatcgaggcagtccctttggagacccagccttcctcaggtaattgaatactccaggatggtcatttttttcttgactacttggcaggcaggctggtgaccgagcagacagagtttataccttaagttccaacaactctgaatttcaaattttgaccctgccacatcccagctgggttgaattagacatattttctgatctgaaaaaaacatggtaatatttcttttggctatattcactgtaattctaatgttagtgatagctgcttcattacagttcagtggcctctgtggactgtctaggtggaagtttctagtgcttccttataaaataaacttctattagtatattacacttaagcttcatctgaaatgcattttaacagattatacaattatacattcttcattagttgacattattccaatgttcacttaagaaatattgaggctgggcatggtggctcttgcctataatcccagcactttgggaggccgaggtggacagatcatctgaggtcaggagtttgagaccagtctggccaacatggtgaaaccccatctctactaaaaacacaaaagttagccgggtgcggtggcacacgcttgtaattccagacacttgagaggctgaggcaggagaactgcttgaacccaggaggcagaggttacagtgagccgagatcatgccactgcactccatcctgggtgacagacagtgagattcctctcaaaataatagtaataataatgaaataaaagaaatattgagttcccactatgtacccagcatgctggggatacaacagtgacaaaaatctgggtcctcatgaagtttccattctagtgtgtgtggatgggagaggggagcagaggggtaatgagtaaaccaatgagtattcagtcgatcaggtaaaaacaaatactatgaagaaaaattaagcaggctgaattaagagtttaagtaaataagagggacaaattgctaaactggaagaattaaggataaactacaaatagtctgatttattatttacccattactgtctactttcaaatgtaaagaaaatgggtttgctctgtcaagaactagtgggagccggaggccccgccagttttctcttcatcctcctgtggacgcatcctgctgagtgtacgcttgtctcactatagtcttgttgaggggctggttattcaatgatgtaaactcccttacagtggggctcagtcttgttccttcatattcgagggcttgctacagggcctggcactagtagggattcaataaatatatatttaatgatggagcacagattctatttctaaacatggtccttgtgcaaacagagaaccaagctgtcttgcttgggtgggtaaaagctaagggcaagagaactcctgtaacaatcagcttctcccctccagtttcaactcatttacttgcttgctttcccttgagtgggcttcacggtagctcttgaatttgctcttgtgtgacgttgttattcagaaactcctattgtggacacagcctgcctgctgactcctagtattggtggtttaatcactgcctgggtaattactcacagggacgccaggtatccctgaagatatcgaagtcctatggcttagaaggaacacagatttttgttttacctaaaataatggcagcctcaaaggggaaagaaaaatagaatttaaacactttggaatatcctacaattactttggttttgaagttggtttgtgcacataggtacaaatattcttttactgaaatttctagttgtaatttcagaataaatattttaatatatatggacagttaaaaatttttaaaagaaatatgtcaaaggttgcatttgttatttcttaggaagaaccttgaacacttgaaccagatactttggaaagcataattttttgtacgtgatttgatgccactgatatatgctagtctaaagcacaaaatacttgttttggaaacatctcttgcctaatatctaaatttaacccatggtatttattattcactgactgaaaacaggaacacgttatacaatctgtgttttttcatctaaaagatggcaacaatgattttgcacagaattaaaaaattaggaggataagggacattgtggaaattctaaagtgctgtacaaatgttagtttggttcaggggggcattgaagggggggatttggcagaagctgactcatccatgacctactaagtgagaagatcagggcctgggggctaggagcagtgtcaattaggaagcatctgccctcctgatgagcagccgcgttggggagccactgacctcgataattatcaatatgtgtcctgaatagactctgttctgattaaggtctcatttgtggaaattcatctggaaagcaaagagattatattcagaaggaaaaggagatctatgtccatcaccatatacctactcaatttttgaatggatattgtactgccttgatgttctatttctatgattgtcttgagtttgagagctaaaagataattaactttgatgtgtcctgtttgtctctcctatagcccccagagataggcaccttgaggccaagatcttaaattacatcttaaattttatttattattatgcccacaataccaattgcacaagggagaagagctctgtggatagttgctgatttaatttggtttgattaaacaggaatttttatgctcagcctttatgaagaacattttgaagtacaggtccagataagaatttatataaaatatattttttaaaatttaccaaaaataggtacaatatttagcacatgctggaaatagatgctgcttgttaaagttatggtaaccttacattctttgcattgaacctgagcatattaagaaacaaattcaaacagatactttgttacttgctgctagaaaatattctttcaaaagtttccatttctgtaaagctcggttctgagaggctgctggtgtgtgtcacttcatgttttgctgacatcttcctgatagtgcatcaaagaaatcatatttattttctgtgagttacaaacattatagcatgggaaaagttgcttgcaggggcataccacacatttctaagaagagaaaacacaacactattgacttcacatattagtagttgggaggaaaataactttaatcctattatcaaaggctgtcaggccctaattagatttttctcttcttagttccattgccccatggctttcaattctgttttataaacagaaatactgtactgatgttctccccatagaaataaataagttaataattaataattaattttaccgggcatcattcttgaggagtctcacagtgatcaaactaggcaagtgtgggaaagatagaggccattttcaaaaaaatgtataagtgtaggattgtacaaccttttgaataaacattaatatgagatgacagtatgcttatatatatataatgttttatatatatagatagatagatagatgctgctacatacatatttacaggtatatatatttatatatttatgaactaataggcctatattatatatatttatatatttatgaactgttaggctttatttttagagcagttttaggttaacagcaaaattgggcaacaagtatagagtgttctcctatcccacctccctcttacattcacagcctcctccattgttgacattccccactagagtggtctatttgttgcaatcgatcaacctacattggcacatcatcatcacccagagttcatagtttacattagggttcactcttggtgttgtatattctacagatttggacaaatgtgtaatgacatgcatccaccaacagaacgtcatgcagaccagtctcatgccctaaaaatcccctgtgctctcctgttcatccctccctcccctcagcccctggcaaccaccaatctttttactgtctccatggtctgaccctttctagaatgtcatatatttggaatcacatagtatgtagcctttttagattggcttctttcacgtagtaatatgcattaaaggttcctctatttcttttcattgcttgctagctcatttctttttagcacaggctaatattccatggtatgctattttcttctaaataaagatttatgtaaaaatggaaagtaaatagaattgcatgttgcaaacattagggagatgataatgaggagcttgggtctcagggaggtaaatggatgttgggttgtctggtgtccaggatcaatgtgttaacttcttgctcagagtgcagcatgcatagagcctggtttcctccattcagataactaatggggtctatttttggattgcttaagggtctaattgtgaaatgactagaaaaactccctctgatgtgacatggaatccctgcattagctttcccatttgtgtgaatttcagcaaggttcttaatctttctgaacgttagttttcttttctggaaaaaggtgcaataacactttattggtaatttgtgtttttctggcacagaagaagtcatcaacaagtgattatagtattttatggaacctaccactttccaactcataacatttacttttgaatgctgttggttgtctttcctacctcatccaaatacgagctccattgcttatctgatttgtttgttgatgggtccgcagttccaagaagaatgtgtcatacacagcaggcatttaataaatagcttttgggtgaaggaatgaactttccaaatgaactgatagactttataaaagctgttgtgtgtcttctatctgtaatccaggaagattggtcatagatttgccaaggaagagagagaatagtggcaagttgtgtttgtctgtaagttgaggaccactgctggcaagtcagttgattttatctgtggttccttcttacaatgcatatattgaataagaatatccactcatgattgtaggactaccaggtttaccttcaaggcattagggcatcatgccccttttgaatgggtaaaatgttagtggtaatacaacatcttttcttaattattattaaagaattgttatttttgtgttgtttttctttttactttaatattattttggcagtggtaatttaaaggtgatctgatgaaagacaacactgaagttgatgatagaaatctaaacctgactttaatcaggaaatttgccaatatttattgcctgttataaactgttacctccttattgttttgcctgcatttgcatccattcaagtcttcaggttgtgtatgcaatctaagtatataaatatagaataacttcaaagtgctgatgtgggttgtgtggctggtgggggtggggcaatcgatcaacctacattggcacatcattatcacccagagttcatagtttacattagggttcactcttggtattgtatattctatggatttggacaaatgtgtaatgacatgcatccaccaatagaacatcatgcagaccagtctcgtgccccgaaaatcccctgtgctctcctgttcatccctccctcccctcagcccctggcaaccaccaatctttttactgtctcctagtgggggaaactgaggcaaatgggtgtgtgtcatataagtatgaccgtttctgtccaaaactgaacttgaggacatcgcgaacaatgtgctggccacattctatagacatctgaggagaataacttgtccctgtctctgtgggtggagactcctggcttccattttatctgtttttgcccatgggtttggacaactctgtggcataagagccactccatgaggctgacaaaaagcaataggtgcagtacctgctgtaactgctttgtatatctagaagaagacacagtggaaaggcaggccacatgtgacagtggggacagcctgagcattggccaattgccacttaccagctctgagataatttgaataaaagaagccagatttaagtcttgcctaagtgtgaggtcattgtccaggacactcttcccctgggcaggcttccttagacctctctaagtaggtttgccccaaggagtcacagggggcatccccgggaagagggccacatactcaggacaagatatgggattaggcattagtgttggagctttgcagaccatttattttaagagctgcacgtgacccttcacaccagcctgcttgagtacagcaactggatattgccctgaaagaggaatacatttatttatttattatacatctgctttagtggatgattttgatatctcatgaaataaaatattgatagccaaagcataattttagtgtaataattattaaaatttttttttcaaatacggagaaaaataatggatcctatgaaagaagaaaatgatcttctattttcttctttctcagtcctaaacatctgatttacagtctccaaaaactacaatgtaaccataggttgtgtcaaaacaaagcttgtgtcagtttaaataagatatattatgtttgcctttggttttctcctctgctgtgttaggcctttagtgaattcatattgggcctgttttagtattctcaaattgtatccattgctatttttttaaatttttagtcaaatgagcagaagaaagttgacaatcttatttgttaaatgcttttattttgatgaaatttgctcagacattttatgtattttttattatcttacctgcatagcctcaccaaggaattcagtatgtttggggagtagataagaatcattttcttctctaattatgagtttctggagtattcatttcagctagcctgccaacttccatgtcttctgcaaaatcacatagcaagaagaaaacatcaacagcagcatggagctagaggcatgtgagatcatttagtagcaaagaaagtttgacatcacatagccaaagattagaaattttgagtggtacttgaagtcagtgtacttaaagcagatactcacttgagtaacttactagatagaaatttgcactgttattggaatggatgatgttagaaataatctatccactgacaatttatatcagctattcccatttagagccactcgtagcctccaagccctttttcaaaaacacttttgtttcttaagtgttaaatacctacttcacttaaaaatattctatttgaatcattttgatcatgctatttgaagagtggttttctcaaaatttcttatacttaaagtgaatattatagatcagacatattggccgtgtaacccacaacatctggcacaatccatttacttgtggcaaaatacatttaccgccatccctgtgggtgccctggccctccttcccaccttacatttctagccagacacagggcctgtttcctaagagagattccaaaggtatgcgttttatggaaaggctgacattttgttcccttttgcataattttaattagatggaaggaaacccttataccccaagcctaacaccgcacctgccatttagtaagcattctgagagcaggtatatatatatatatatgctaacatttggttctttgttgagcaattttcattagaagtaaaggaactcattgttagctcaattctgtttcttttatttgggccaaagctgctgaaggatgctttttggatgtaatggttgtatgtgtcaacctgcctgactgagtattgggaaagcccttgagaaaatggtacatgagccctgcccaagatttcacgttattcagaggcctgatactcatgaaaatgttaagtgatttctctctggaggtaaccacaaagtaaatagccagaaatgaaaccaatcaaaccaaccaaccattgaacatgtcaaaagatgcttttgagaagaagatggtgttgacttaaaatgcaaaagaacacaggaaaatagtccatattaaaatatgctcgattcagaaagaacttcatacatagatttctaacattcttctttccaaaatctttgaaccttatggtggatttgtcctagacctaatgcccttttgttttcagaaaagactccaaatgggaaaattttattctagaatataacaagtaaatgttgtaaataaatacgtgtcatctgggaacacacaagggctgcgtgagagagcataggccgcatcagtgtaggaattgattaacttgaggacaaagtcttatgtcagacatatgacccatgcagctatcaatgttcaatagatacagagttgagattagtcattgattttcctgacctgagggccataatgaataacatgctttcaggctgataataggacagaatgatggtagaatatgatagttcaaaattaatgtccagagttctttcacaagaagcttacatgtgaaaggcagcatattttgcatctggagtcatcttataagtgtctcttaaacatcacgcaagatgtaaaatgtccagtggtgagatctaggagtgtggttcctctgagacttcatctgggttcatgtgtaggtggacatgccaatctagaccaattttacatgtccaaggaaggaggaaagagccagtaattcagcctgaaactcgagaagccaaagtggggactgaatagcctcacaggcaagcgtttagtagaatgttcaacagctccttcagtacctatagacacagaacataaactaccctatggggtaaccagcttcttccccttaaaggtggtgaaatgatgaggtcagctatccccgtatgatttaatgctttagggaagttctatgcaatacagctggataaaaaaggatagaaaaattttgcatgttgaagtggaaaatataaaattagtccacatttttggccccccaaacacaagatgaccaattataagtattagaaaaataagagttcagtaggggtatgagttacacaataaatgtgcgaaagttaattttctatttactaacaattgctcattcatatataacaacataatgtgatccattcacaatgacaggaaaaatacagaatacctaaaaattaaaagaatatgtggcaaccatatggacaagacataaaattctactaagcaatataaaaaaagactggagtgagtggaggggtgtcctatcattttggaaattgtatgttctatttctgtgttagagatcacacttaacactttcacttaactctttaaagtagagtgaactatatcctcttcctccacatatggaattattatggaattctaaccaacaatcaaacaagaaccttcctctccccatttcactgctttccatctttcccccaaacctccacccttcagccttgacgcctgagcttatgggttgcctggagtctctggagccgattcccatggttggtgtcctgctcaaacccatcccttcctacctctgtgacctttggccaaggttttaactccctggccttcagtttccaaatctataaaatgataatagtagtaaatgctttttagggttattgtgaagattaagtgagctaacacacaaaaagagtttagaataatgcctgctgccacgtaagaccataattaatgtgaacttcttattttccaggggttttagttccagattgttattaattttttgatttccaattaacagttacttaggcttaaatgaaagttttattggttcttgtacttaccagtgtatctttcttactttatagtgtatgttacttttcttcccataacttgtgatagtgttttgttttgtttgtatgcattttctactagtttttttttttcagagacaatctatggttggcaaactatgaatttttgcatatctagaaatctcccagctgaacacaagtttgtggagtagagggtgctaatttcaaaatcacaacaatttttcttttgaaaatttgaaaagatgactctattgtcttttagcattcagtgtggccattcagaactgtgaggagaagcagattatcataggtaaagttttctacctctggccccctttttagacagcttttcagattttctcatcatctgttacagaatttcatcactttatatgtaaggtttcttcttgcattctgtcttattatagtctgaggagtccatttttttccatgcatttctatttctgtttcttctttttttttatgtgagtatttcctcccatcgatgatctttgttcttcccctctagaactttcattcagtgggttctggagcttacacatctctcttgactgtctccttgtctcaatgccatcttccagttaattgatttgatgtttagctgtgttaactttgcaatttaacccagggagttgtatttatctatttatttgtttatttatttttgattttactttaggttccaggatgcatgtgcagaacgtgcaggttcgttacataggtatacatgtgccatggcagtttgctgcacctatcaacccatcatctaggttttaagctccacatgcattagctatttctcctgacactctccctccccctcacaatccaccccactcaacaggtgcctgtgtgtgttgttccccctccctgtgtccatgtgttctcattgttcacctcccacttatgagtaagaacatgtggtgttgcgttttctgttcctgtgtttgtttgttgaggatgatggctttcaatttcatccatgtccctgaagacgacatgatctcattcctttttatggctgcatagtattccatggtgtagatgtaccacattttctttatctagtctgcattgatggacatttgggttggtccccaaggagttttatatttttgaaattacaaataatcctattttttatttctaaaatatgctttccccattgcagcctgttctttttcatttatattagatgatatcttaaatatttaaagatattaattacactacttttaaagcctaatagttgctactttaaccctgtttctgcatgtgtctgctcttcaatgcctctttattttgatgttggtttttctaataattttggtcatcttgagagtctgtgatctcctatctgtggattccattttgctttccatataattggagatcattgaggatgttggtgtatagcaggttctcattttctggtgcacccaattatcaacagtcattcggggcacctctctgcctctatagcccaagcggtcaccctggtggctctatctagacagactatgctcctgctgcttgacacagggtggagcagcaggcactctttgttcagcacttctgaacatgctcccccaattaatctctatagcttctgtttcgtttgctcattgcatttgttgtctctgagctcggggcatccctagacatactacaacattttccagcaacctttttagttcatttctgaggctgcaatttcctctgttaagatgagccaggtttctttctgtctttcaggaatttctcaaggtttctgacccacatgacaccttctccttgtcttctgtcagttttgtgaaatttctcgttaaacacatctattttttttttttaatttccagggcctgggggtgggagaaggacaggtacatatgctcagatggccatcatggtcccacctagaggcagatctctagaccataaaaggctccacacatgtttcccctgggtagagttgccagataaaatacagggcgcttagttaaatttaaacttcagataaacaatgaataattacattagtctaagtctgaactgtagctttactaacaaattatatatcttctgtttatcttaaatttgtatttaatctaacaaaaatactcgatgtttctctgaaattcaaattcaggtccacatccagtatctttatttgttatatatgcagccccactcatgggtgtctgttggatagatactacgctgactctggggcacttgtgtaatggagggtgtggaggaggagagaaggacccgaacttttgggatgttgatgcaagaacctccatagaaccccagtgctgtggatccattcaataccatccaccctgaggactacattcaatgaaatcctagttcaactgagaccgactcgcctggtatcaatcaggccatttcttaattacaccttcaatgttaagcatatgaacaatccaaataacatttaactgtgatggcatttataatgattaataaaccgatatataatgattagcaacacttcaatcgtgctaccataaactctacagagttatttctggtacttttcttgaaatgtaaaagacttcagtagcattattaaaacatgctcattaatggcacttctagtgtttccatttagtgtcattgacttcaaaggggttgatgttgactgtgacagccagccagcgatttgcctacagcctcctgatgatacactaaataacaaccggtgtgttaaaataaagagatcatggaaggaatttctttttattattctgactgtgggaggccaaggaaatcatgttggtggctaattcttgttgatgtatttgtcaaatgactgtaagaactgggaacacagccttcagtttcagttagcagaggaacacagagcacgtactttgccctaatccttgaaattcaagctttttaaaaagttgtctaaaatgtaatggtttcaagttgaaaatctgttcttttttcctctgaaaaatctgtggctatcaagaattcattttatcctttccttgttattgtgaagtggcaggatttgatttagtacttcctgggaccctgccttcccgaatatgattctgtgaatatagaatgagctcccagcgcctgtctggtttggagttctgttacttcctgtctgttgatacatatgttggccacacagcctgtgtcaggcagaaagaaggaatcacctctggaatgatctgtgtctttagtgggctttttatttgtctattcccttcaaagctgtttttttctcctccccccaaggctttgcgtatttattttttaaaactgcactcattttgtaacataagctgtttcaatgtttacatctaaattacttttttcttctgtatcttttgatatataaaaatgtttaaatcaaaggctcggttggcaggtaccagggtaaggggaaccagagaagaaaagggaagtaaaactcaggatccgtattgtgggattttcagccagctttaagtggtcagtagtttactccacgtctgtatgttcttttttgtcatgttgtacttgtttatggtacataatctcaagtgaagtccatatgcctaatgcatagtacctctttatgcatgcagagcttgttcaggcttttgttatgcctggtatttttcagtgcttcccttagtttacctcttcctgttgtctctacattctggtatgtcattcttttaagcatgattagcaaacagagactggaattgtcagacacattatgcagataggacgagaaatctttcccttactgagaagttgagagaagagtgagggagagggggtaaggggaaagaagttgagaaagagatatatagagatacttggaaagataaatgggaaagggttggagacagccccaaagacagaacattatgggagagaaaatgagagagagggagtggtagaaggagaatgaagagagatagggaatgagaaggtgaaaatctttgtcactaaatgccatgaacagcaaatttcttcaaaactaaagtgcttctgaatctcaattattggcatggcaatttaatgcaatatttaccacaataaggtcacaacaggagaaaaaactgagcagtcctttgatgtttgaatttaagttactatgtgctcatcatgaatttttaaattcctaagaatttcacagagcagaattgggagtgacaaaggaaacaatctccattcagtttctgagactaaatgatcaggaaagtccagctgtgtcaagacagaagccccatacacacaaatcgcctgtcaaaagaagtgggcaccaggcccctgcccagcttcttttcagttccacttcctgtgccaggggtgctctgtgctggagctgttcctcctaccttgtgagagccaattgtgtgcgtgtctccctgtctctgtgttcagtgacattgtgatagtagcttaatgtaggctatggtgggagtgtttacaccatggaaattggcacacaccacaggtaagggcttcttccgatgggtggtcattaaacattggctggcacaccactgggcatccccagttcccttccagtgagtggtatccacatcacctgttattgtatgcctgagaggggctgtttttcctcccaccttccactcacccagaatcttggcctttaggtatgctcactctaggtaatgtcttgtgtttttcctttttcttcctgtctcaatcaaaatttatttgctctgagttccattcctgtaagctgctgctctacattacaaggcctccagttcctctgatctcagaccccataattgtgctgagttaataagatatttttcctttgtgccacatttggacacatgctatagatgtcctgaatcttctggagtaggaaaagtctataatttaaatgggtgaaatgtcaggtactgttcagctctcagctcctggcatattcacgggcatcccactctgtactcaactggacttggtgagcacaactgcgatcacattaaatgagaaaagaaagctatgtttgggttgacaaaagtaatttttgggtcagtgaaatttcatgaggcactgaaactctttatgttttgttgactgaaacatcagtttgattttagtgaaacaaaagtggtttggagatgtgatttccattttgtgctctcattggggatctgactgatcccaggtctccaaggcctgcgacagacagatgtgtgtgtgcataagaaatcttggtccccctgttagggatgtgctctttgtttagatatcgaggacaagtcaatggtcaggggcatcttcacattggaatcttgtcagtggcctttctgtgatttcctggtctaagtatctgactttttgtgaagcctcacagcttgccgccacctgtaattattagagaatctgggctctaaacaaataagtggaaccaaaaaagaaaaaggagagcaagaaagggaaaaggaagtaaaatatatggtagaaatggaagtgctaaggttataaatacccaaggaaaaagaaaatctctaacagcttatggagaaatctctagaatttctaatggtttgtcccagtgaacaggactatgttggtttatatattcttcttcctgatgattttaaaaaaataatccccattagctactgtagtctgtagggctttgagttgacctcctattgaccacaagagagtgatagggacaccttccacattgtgatctagaccaaaataagccaccaaaataggtccacttcagggacctccagcagttcctgcagcctaaattgtgagcaaagttaaaacaggaaagctcttggatttgcttcaccagacgtatatttaatactatgttttgggccgggcatggtggctcatgcctataatcccagcactttggaggccaaagtgggcagatcacttcaggtcaggagttcaagaccagcctggccaacatggtgaaactccatctctactaaaaatacaaaaattagctgggcgtggtagttatgcacctgtaatccccgctactcaggaggctgaggcaggagaatcgcttgaacttgggtggcagaggttgcagtgagccaagatcatgccactgcactccaacctgggcaacagaatgagactctatctcaaaaaaaccaaaaaaccaaaaaaacaaaaaaccatgttttctagtctcttagtggttaaagtaggattgtttatcactaacagtaataaactgagcatatctatgtgtccatggctctaaattttacctgatataattcatccctgtcttgctctggattagggctggaaagttagggcaggaacagtgaggactgatgctgacacctctaatttgcacacccccagtgcatggatctgttctgtgtgaggcacacgtgtaagtgatgaatgttcccagcctgtttccctcctctgaaggctccaggaccacttgaactgcacatcctccagctgaaaggcagtaagagcagatttgtgaggtacaattttcctggttaattgaagaatagacatggcgtattcatactcacaaaggcagggttgccaccaaaaacgaatctaattggctaaataaataactctagggtctcattgcctgcagcctttcctttattgaattattaatgctgtgtccccctccccacccccagaatagcagcagttaaggactgatttgccttaggcggttaatattctccagtcagttgtaaattgctctaaggacttgctatgctaagttatagctatattatttgctaagccttcaaaacagctttggattcagggacatagtaaaaagttaagttatttttagcctcaaaaatatatttttttgctttcctatagtctgaaccattggtttttactggaagtgattttgccctcaggggacatctggcaatgtctagagatggtttagttgtcacaacttgcccttgtgtgtgtgctattcgtgtcgaatgtgcagaggccaaggatgctggtgaatgtcctacagtgcacagggcagcccccagcaacagagaataatctggtcccaaaggtcagcaatgctgtggtggagtactcttggtttaaacgaggagaaaaaaaagaacatttatcagaggatttcttaggtgggcagttcattcattctttcaagaagtattttgtgagtgcctgttatactgatgaattacctccaccaccttagaggtgatgtgtgtgatcatcaacctcctctccctgtagccttctcttatcatcaccctctggtgatgctagtgagggagtggccatctccggagtacctgccagcccaaggtgcctctccagcgaacaggttgtatacatgattcttgatggggaaatagcaaagatttcccttgttctgaaatcctggtatgaagggagaattaatacccgaagaagattttattccttaccacaaatcttacccacatcatgttgccaataataaccacttccgtttctggattgtattaagtccagggcactgtacatacattctttctacccacacaacattcctacagggtagatgttacagatgaggaagctgacgctccgacactccagatggaacacttataagctgcagagcccacgtccaaggctttgctttgcccactatcccgccatcgcttattgtagaaaggttctgcttttttctttattaagtttttttttttttcatagacatggtcacactaggttacccaggctgaagtgccatagcacaatcatagctcactgacctcaaactcctaggctcaagtgatcctcctgcttcagcctcctgagtagctagactaatacagccatgtgtcaccatgtagattagtctgttttcatactgctattaaaaaaactatctgagactgggtaattgataaataaaagagatttacttggctcacagttctgaatggctggagggggactcaggaaatttacaatcatggtggaaggtgaaggggaagtgaggcacgtcgtacatgtaggtggcaggaaagagagacaaatgccacacttatgccatcagatcttgtgagaactcactatcatgagaatacaatgggggaaactaccccaatgattcaatccctctcaccaggttcctccctcaacatgtggggattacaattcgagatgagatttgggtggggacacagagccaagccatatcatcccaccctggcccctcctaaatctcatgtctttctcacttttcaaaacacaattatgcctctcctcaaagtcttaactcattccagtattaactcaaaagtataagtccaaagtctcatttgagacaagggaagtctcttccacctatgagcctgtaaaatcaaaagcaatttagttacttccaagatacaatgggagtacaggcatcgagtaaatgctcccattccaaaagggagaacttggccaaaaccaagggctacagggcccatgcaagtccaaaactgagaaggaaagccattaaatcttaaagctccaaaataatctcctttgactccatgtctcacatccagggcacactgatgcaaggggtggactctcaagcccttgggcagccttgaccctgtggttctgcagggtacagcccctgtagctgcattcaccagctgacattgagttcttgcagcttttccaggtgcacagtgcaagctgtcattggatctaccattctggggtctggagaatggtggccctcttctcacagctctactaggcaatgcccagcggggattctgtatggggcctccaaccccacactgcccctctgcattgcctgagtagaggttctccatgagggctctgcccctgcagctgacttatgcctcgacatccaggtgtttccatacatcctctgaaatacatgcggaggttctcaaagctcaactcttgttttctgtgcacctgaaggctgaacaccacgtggaagctgccaagtcttcttggcagaaggaagctaccttctgaagcaatagcccaagctgtaccttggcccctatagtcatgtctgtagctggagtggctgggatacagcgcatcatgtcccaaggctgcacagagcacagggaccctgggcccaggaaggtccctcatgggcctccaggcctgtgataggagggcctgccatgtagatctttgaaatgccttggagacgttttccccattgttgcttatgcaaatttctgcagctggcttgaatttctccctatgaaatgtttttttcttttctactgcatggtcagactgcaaattttccaatcttttatgttctgcttcccttttaaatataagttccaattttagatcatctctttgtgaacacatatgactatatgctgttaggagcacccaggtcacatcttgagtaatttgttgcttagaactttcttctgacagataccctaaatcatctctctcgagttcaaagttccccaggtccctagagcaggggcacaatgccaccagtctctttgctaaagcatagcaagagtgacctttgctccaattcctaataagttcctcatctccatctgagagcacctcagcctggacttgattatcaacatcactatcagcattttggtcaaaatcattcaacaagtctctaggaagttccaaactttcccccatcttcctgtcttctgagccctccagactattccaacctctgcccattacgcagttcaaaggttgcttccacatttttaggtacatttatagcaatgtcccacttctggtactgatttcctgtattacattacattcctgttttcactgctataaagaactatctgacatttggtaatttataaagaaaagagatttaatttactcacagttctgcatggctggtgaggcctcatgaaacttacagtcacagcagaagatgaaggggaaaagaggcacgtcttacatggtggtgagagagagagagagagagaatgagaaggagaaagaatcacacttttaaatcattatatcatgagaacagcatggggaaactgttcccaggatccaatcatctcctaccaggttcctccctcccttgatatatggggattaaacttcgagatgagatttgggcagggatacagagccaaatcatattaccatgcatggctatttttttttttttagttttgtaaagacatggtcttgctatgttgcctaggctagtctcaaattcctggccgcaggtgatgtgtcctcttaccttggcctcccaaactgctgggatgacagatatgagccaccaaatctggtacagttctgctgttttctaatggcaatgggtatttttattttgccttagtagatgttgtggtaaagatgatggaaaagtatgtcacctgaaatgaagaataggcatttaaaaaataataaggcatagtgtgcagaagtgtgggtaaggtgagagatgcgttaggcaattgggctggagattcagagcccagggtggtttgagctctgtgtggatgggaatcatgactccatccagcctgtcttcagagggttgttgctcttgccataaccctcctggtacctggcatggaggcatcagtctcctttagcttttatcaagaaaccaaaaaggcagctaacagtatgaaaagctgttcagcttcactcagaatgaaagaaatgtaaactatcaactatttttcacctattagcttggtaaagattaaaaaaaaaaagtaaacccccaacatgtgcaagggttgatgtaactataatagctgtttggtgctttaggaaatttctatcaacattaattgatctgatgcttccacttctggggatttatcttgtatttatgtccacctaattacacaattgtagatgttcattgctttttttatttttaatcgtggaaaaaaccttaaatgtccacagaagtgacctggttaaataaagcacagagtaatgtacggcctttacatagaatgatgtatctatttttgcaaacatggaaatatctattatatgtgaatgaagggtgaatgaagaaaggtgttaaacagcatgtatagcctaatatctccttgcataggtatttttgatcattaatgcatggatatgtttcgaagaatatacattgactttttctcattagctacctctgtaaaatgagttgaagtttgggaatggaagggagattttctttccacctgtgtcattctatagttttaaagataactgccatatgttagtttaaaacgtgaacacttttaatcaaaatcacattaatggagcacttattaattgccaggttctttgcttggcactgataatacaaatatgaatgagactcttttttcctgctatagagtagcttccagtcaaacttttaacaataccaactggctaaatcaactttatttttcattttggggtccttagttactttgttgctcaggacaattaggttataatatagataatgccactaggtattatgcagatgaatttttcttgcatatttgtaaaatcatttgaaaacttttatgaaatggaaaataaatgttactttaaaggctgccttttcattaaacattctgtgtttgtcctgctttgacctgctcaaaattagagaatgtattcacagagcctccactacttgacagacacccatgactaagaaggacacggtcctttctttggaaaatctaaccaaggcaatagacaacaaataagaaaacaaagactgtggtacataattaaacttgagatgagggtgatgggagaataggcatggtgaagattttgacacggtggaccacaaaggcctctgtgaggccatgacatttaaaagcagatgtagagcaggtgtggtggctcacacctgtaatcccagcactttgggaggccaaggcgggcagatcacctgaggtcaggagttcgagaccagcctggccaacatggcgaaactcagtctctcctaaaaatacgaaagtaggtggtgcatgtctataaccccagctagtcgggaggctgaggcaggacaatcacttgaacctggaaggtggaggttgcagtgagctgagatcgtgccactgcactccagcctgggtgacagtgaggctcggtttctaaataaataagtaaataaaagcaaacatgaagaataagaaggaaccaaaagtacaagaatggaggtgggttccaacacgtgaagtcccagaggcaggaaaaggctcacctgtttcagaaaccaatgtcccttgagggttggctggtgtaagctggtatggccagagtgtctcgggcgagggggtgaggcaggagaggtgggtagagctggatgacatggggccatgtaggtggcagtaagtttcactgagttaccaccatacagagtggaagcagccatttctactctgacaatggaaatgattctgcaatcacgggcacattcaattcactttgagctagaaaaagatgcatgccgctgtgccttgcacgtggtgggtgtttctcttgcaatttcttagtgaatggataaatctttaaaacatgtgtagactctttcagatgaaataccagaatgccctatttttttttttttaagcatgcttctcacatgtgcctatttactcttgcgtctttttcaagccagactcctgtttcctggtgggaaggctctgttctttgattcatgcctctcacagctggtttccccatgtgtgtctgagccctcccccagaatccctttaagccagcagatgttttgggttagccttggcttcaggcacacccccaccccacacatcacatttgcacctggcctcagctgggtgtacgggagtggccttctttgggatgctcggactccacgtaagatcctttctctcactgatcaatctgatcatcagctctgacggacggaattcttcaccttggagaggacttctttctgtcagcatccttgccttttattagcccctcctttattatactcttcaccgtctttctaatatttaaaaaaaactcatttgacatcgctttttgtgggtagacgtccatgatgtatcttacatgccccatatgttgtggagtgggcattccattcctatctgttgtatgatcttgcttctcaccagcatctttggactccatgtggtcaccctgtcttttgatcactgattcacagctctgctctttcagcatttggactgctgtgctgctcatctgctcccctccctccagctcatgagaacacatggcttctgcagcacttggatattcatgcctggtatcctcgtgctgatgcatgtgtgcccttctctgccagtttacagggctgagtttttccagaagcccttctgccagtccacccatggccatgcacaccacgttccctaagcccatatccctgagcctgtttctttctcttctcctttactcctccccagcccctcctcttcagctccttccctccttctttcctcctctctctccttccttattcctctccccagtgaatatattgagccctaggtttggcctgaattttggggtaaaatctacataccctgcctgctctctgccttcgtcttggtagcctgatccccggtggctgttcctggagagtcagaaccagggtcacagaaccagggtctacatgggcttattggttggttggtagtctttttttttttttttttttttaccactgattgccatatgcagccaataggttttattaattaaagaagtattagtcaccagtaaaattgttacaagtagagtttttaagtttgtttttgttattgtaaatcatttacttgactaggtgatttggtagttcttttccctgctgacttttatcattctttttttttttcttattttagctcctttatgtaaatcatatgcatatttatgacttagttcctttattttgtgggcattatatatatatatatatattttattttgttattattatactttaagttttagggtacatatgtaaataaacaaaatacagaaaaaagaatgaacaacttaaaatatggggcaaagaaatggccaccggtaaggaaatgatgaaatgaataatgctacgtacatgacatgaatattatgcagttgttaaaattctgcttttaaaggatttcactttatatgcagagaaatatatcctatacataacttattcaataaatactaattctatataagtatatgtattttatatatttttatatatacttctaataattttgaataaagattagaaagaaatgcatcaaaatgatagtgatgattatctgtagatactcagatagtgaatgcttttttccctttcttttattacatttttctaaaacttttacagtggacatatgcagcttgcacaatgaagaaaagtagatctatgaaaacattaggagactatctggaagtgaacaaaattattattatacagttttcttgactgcttcctcatcacctcccaacccccaagcctccttcaggatctgccattttagacaatttctttggcttttgccccagactgagctaaggattgtttctgtgtctatagaacaatacagggaaaaatactttctagcctcaataaaactaactctgtcctttcaacacaaggcaggaagttttcatttcaaaccttattctcacagcacagaattgatttccaaagtcaggtaatgctatcagagggtgccataaaagaacaagaatcaaaacaaagcatcttccagggcactagatgatgtctttcttatgctcaaaagtgtcatgaggcagatagaagaaaaaccaaaggcaaagcaaaacctcacactgccaagttttagagaagaggtggaggaaatatttcccagaggatgcatgctgtcagaaaacatgattggttgtgtgtatttgagagatagaagcaatgagtcaatagtcaatagcttttttctaatgttaaatgaagagttaatgggtgcagcacaccaacatggcacatgtatacatatgtaacaaacctgcacgttgtgcacatgtaccctaaaacttaaagtataataaaaaaatgtagccagattcttaataatttgcattatagatcttacactgtataaagcattcaatcatttttctaagaggagcaggttgttactttttctacttttctgcattcttccttcaagaaaaattgggaataaaagcataccacagagcatttaattttgagcaatgagtttgcatttaaatttgaacaatgagtttgcttgtatcgtttagctgtatcgtttagctaggtatttaatgaatcttgttaaaaggggtacatgcagacttattggttgcaaagattgttaatagcaacagttactcaacttaacaaacattgacttataaacttatttaggatgcatagtttggatatttaaaaactctctttgctactgtttctaacaaaccagtttctaatcggacgggttactttgctaaaaatgtttttttaattgtcgtaagttatttctagtcttaaatcaagcattcctatccttacttatgctggtactgaaaaacttccagtctttctggtggattatgtattggtaggaagggccacaccattctctctctaattaactcactcaattagagaattagaatacagaatacaattagaatacagaaacctctggaaggcaattttaggctatctctgggcagctttcctttgcctcgttcctcttcagatacccagttaggcagtatttcagggacactcccaagaagggtcctgtaggaactgagacatcagccccaacatgttgagaccccatcactcgttcatcctcaggacactcatattaccgttcttgtagacttaggtgtgtgatatacggatgtgaagggaattgggttctcctggttcctaaattagactctatgtcagtgagccctgaccttttccaaggcagaaagcagagtcagttctcagagggtcctgaatgagggtttcgtcttcaacattacattgtttttcttttcagctacctactctacttgagaaagccctccttatcataattattattaatgttttgataaaaaataactaggatcgctttttccagctctatggaatggactaataagctactcatattaaaatctgcatcagtttctatgggccaggttgctgtaaccaacaacccctaaatctctgcagcttcaaacaacaaatgttcatttctcatttgtgctccatgtgcatctgggcttgctggaggtgctctttgaagaggtctgtctttgggaggcaggctgatttctggggtggctgtcatcttgagagttgctggtcactgttagggaaataagagaacatggcatatggtccattgaccctgggaaggctttcatccagaggaggcatggtttccttctatttacatctcattggccagagaaatcctgggactatggccaactttgaagaggtgaagaagtgggaggaagactggacagcgctcatggatactgtaattcctgtatgagttttttgttttatgtgatagacattgttacccttacctttgcatatgtcatgttgtctcagtcacttctcacatgagctggaaattcaatgatctttattttacatatggagcttactgaaggtaaggactcaagaggcagtggtacttcctggacagagttggttgtggaatctaattttgtttatttccccagagccaaatctcagtcattgtacagtattgctgcataatttgtttgaagcacacactataggaacaaggaatttcccacttctgaaacttctttgtgcaacctggggacacaccctaacatcaagggaatagagtttccagcctgtggagttgagattaccttctctctccttgtaagtcaaaaacctatgctacctctttgtgaccttgtttgaaatagtggaaccccccctaacatgctcatcttaaaagctgccatttcttgaggacttaccatgtccagacgttggaattacccttctgcatgtactgtctcttttaattccccctctttttcatttcacaaatgaagattggattttccatttggggcctgctcaaagttgtacacatcctaaattgcagactcaggaataaaagccacatttgtctggctcagagcttgccctcttaaacatgtgttcctcaagatttaagtaaaagtactccaaatacccaaggttcttacaaaatgcttttaatgcaagcctgctgggggttcttgcatgctgaaggttgccttgaagctagcatcaaaaacatttctgccatttataatttggaagaagaagattaaaaaaaatcatgaacaaaaacattctcttgtctaccctgctcagggtctccagcacttttagtttccattgatatcccagtgggatggaacagatgccctagggccggtatcctggctccaaacctaggatcaatgacctggagcgagtgagtgaatctttttgagcctcatttttctcaaatgtgaaatggggacaccttgcttgcaaaaatcttgtacatgagttgtttttatggttgcttaatagaaggtggtggctattttggagatgggtaaacattacctttctctgttttctggtagccctctctcactaccccaattaaacattccgcataactaaaatctaggctttaagcatgaccttatgctaaattcactagctattaattaaaatccattgctggccgggtgtggtggctcatgcctgtaatcccagcactttgggaggccgaggcaggtggatcacaaggtcaggagttcaagaccagcctgaacaatacggtgaaaccccatctctactaaaaatacaaagattagccaggagtggtggcgggcgcctgtagtcccagctactcaggaggctgaggcaggagaatcgcttgaatctgggaggcggaggttgcagtgagccgagattgtgccactgctctccagtctgggcgacagagagagacttcatctcaaaaacaaaacaaaacaaaacaaaacaaaaaaatccattgctactcttaagcctcaccaacatagaaattttggaggctcagaaaaatgaacctcttacaacatacgaaagtggaaagtgatagaatattatggagaacaatgtgacggtaggtatgaaatgctttaaatatgtatgaatccatttactcagtggctcttcttctaaaattttgaaattaatagaaatattcatgaaaagggatgtttatctggtgttgtgatactagtaattcgaaaccccaaactatcatgtagctggagattggccgagtaaatggatgccaccatttgacgggttgctatgtagccatttaaatcagatttttggatggtattcaaggatttgaagaaatatagacagcctgaattttatatagtttaaatgtaggacacacccccaagtgttaccagaaatcacttatagtactaggaagagttcacatactaccattttctttttaccatttcatattttctaaaatttctttatttagaaacatattgtaatttattaaaagaaggattaaaacccccactaaggactgtttagttcgcaaacctacactttttaggttaacctggaaagccttagtatgtaggagtcaccattcaggaggagccctagggaagctggtcccactctgggtaagatttgtcaaaatcctacagtagacgttccagtaatgaaggcgtctgcctaacatctcaagtcagacatttctaattgggcaaaattactgtcatttactgttattaaagctgcaacaagaaaaaaaccaacaatgcctgcttctgtcacaagttctgttctgaatcatgagagtctctttcccgggccctccctgccgtttttgtggcagcatgagtcagtggagtaaggggcagcctgctgttctgagtctggacttggtagttaccaagatgtgagtaacgctgatcttcctgtagccctgagcaagtcctcttacagctctctgtgctccacataatagggataataatatttatttgcttacctagcccactggggtgttgtaaagattagttagactctgctagtcaaaggactttgaagttttagtgccccgaatggtgttattactaataaacctttaaaactttcatctgcagtgtttccttatttgtagcatttagtaattctgcacaaggaaccagcctcccgcaggcaggacgccagacccacgctgggccagggcgggcttaggcctgcctagaccttccacccaccccggctcccacctccaggcacagagctgctgctacctgcctcagcttgatcctggcttagaggctcctggtgcttgtttaccagattctgtccagttggaaagccacccatgcttacagtcctctagtctgtgccaggaaacaaagagctttttccaggtatacccacttggccagctgaggtgttcctcaacatggcatggacaaacagaagtttggagtcctccagtaaataccctgaagttctcacccatggaagtggaaggtgcctggagttctaatctgggaataagcaaaggctcatcaggcctcagaacagttcatgcagccgggcgcggtggctcacgtttgtaatcccagcactttgggaggctgaggcgggtggatcatgaggtcaacagttcaagacaagcctggccaagatggtgaaaccccgttccctactaaaaatacaaaaattagccaggcacagtggttgatgcctgtaatcccagctattcaggaggctgaggcaggagaattgcttgaacccaggaggtggaggttgtagtgagccaagatcacaccactgcactccagcctgggcaacagagcgagactccgtctcaaaaaaaaaaagaacaattcatgcatctcatctccctgttcttggcatctgattcttttagctcaaaagatgagaagggccaaaactttgtttctggggaaggctattggtttggacaatgatttatgaggatgcctttctgccttttgatgctcactaagaataacaaaactcttctctgcattgttactgccaaagctcattctccttttccctcacatctgcccactcttgtgataaatctgagacacaccaatccgaaaaggcaatctctcccttggcaatgactttgaagagtatttcagaaacactcattgggagtggatcccaattatttaatgctgagtgggaagaggaggaatgagaaaaatcagccaagtacacaagtgaaaccaagcccagataattagctctgaaatatttatgataaacatggaaaataataactttatagtaatgtaagagcagattgtattcatttaatgactttttggtaattggatttccttatctttgtctgtaaatacacgaatctagtttcccaaactagaaatctcagaatcattctaagttttacccttttgtttttcaaaccccctctctaatagccacaaaattctatctcataaataacttcactgctcagtagcccttcaatagcccttctttcccatcctcttcaaccatgttgatagtgtgaggcatgattccttcactgcctggggacttttcttttttttttttttttaaattttattattattatactttgagttttagggtacatgtgcacaacgtgcaggtttgttacatatgtatacatgtgccatgttggtgtgctgcacccagtaactcgtcatttagcattaggtatatctcctaatgctatccctcccccttcccctcaccccacaacagtccccggtgtgcctggggacttttcttattcctactgatttaatcctgtttcccagtgatctccacattggtacccaggtatctgtgtgcacagctactcagatacttgcacccccaactctcagaccttgctggcttgacattaccctcgagagaaagaaatgttaaggccttcttggtcaataattagcattggtttaacttgtaatttctctctgaattctccactgggtcctctgtggttagcaacactggacgtctctctgaagttctcttctcactctctcacttcagtgccatgcatgctcgtctttgtgtttggggaacctgttcagatatcaccttatcattctgggcatgacatgttgtttttcccaaggacccaaaacagtaaaaagtaatgaaataactacatggcagtcagcccagtggaatatagatggagaataaagtcatcctctgtatccatgggggattggttccaagaacctgtggataccaaactctgtggatgctcaagtctctgacagaaaatggtgtagtgttaccatataacctgtgagcatcttcccatatactttaaatgatctctggattacttgtagtatcctatgtaatgcctatacatcatttcatttgcttggattcaacatagtatttggcacacagtagattcaagttttgccttacagcacttgtggaatttctttatcccaattactttccatccctgattgttgaatccacagatatggaaccaatggatatggagggctgactgtattaatatatcttggcacacgataagtctttaaaatgctcctttttgatgcataaatttctcccaaccatttcaagattgagacatggagtctcttttgggaaaatctgcaagtttcagcccttgggaaagtcactatattttacataagattcttatttcaacttgaaaattacggaaactcttgaatactgacccacagataagcagaaagtttcacagggatcatctggtaacatgttaacaatgagactgtgttcccatacccagaggtcctgattcagcaagtcaggagcgggcctggggcccagcattttgacattttcttattgattctgttggggatccaggatccagaatccagaatgaaatgacctcatgttacacagttttacagctcgttccaggtgactgtagttggggctccttaaagaagcatttcaaggaagcatttttggggattactaggaaacacgagccacaggtccgcacacgcttgcagaccatcgtgctggacagaaaactcagacctcccttcatggtgcctgcagaccgctgtgagacttgccactggcatctgctccaaaagagacctgagtgctttaggactaaggatcttattccagagaacgatgaccacacagcgagcaatcctttgtgggcttttgtggcactttcttccattttattctgttttccactcaaaggaggctgtgatggtctacaagcttccatgccagggctggggctgctgccggcagatggcatccaagcctggggcccagctccctcaacgggggctttggaatttcaaatggattggaaaaccccattttaactctaatttgactgaaaatcaacacctattgctttctaaaaaatatattgaatgtgacttaaaaatatgttattaaaattatttaaaacatgattgaaaaggggtacgtgagtaaactgttcaaacagtaggaaagtgtaaacagttcactctccagaggcaagcactattaacatcttcttaacagttctttccagaaattttctaagccgatggaaacgtgtgtatgtatgcatactcttagtaagacatgggagtttagacattattctggctcctgtttttttcctgtaactatttatcttccaaatagggaagcaaatagatttaccctatacttttcaaggcctcatttgaaagttatactattaaatggatctaacacagtggcttttaatcaggggcaactttgtttcctaggggacatttggcaatgtctaatgatatttttggtgttgtcattcagggtggggagagctgctgctggtgtcttgtgggtagagaccaggaacgctgctcaggatctcaccatgcacagaccagctcccccatgacagaggattatctggccccagatgtcaacagtgtcgaggtttagaaaatctgaatacagcatcacagatttgaaaagactcctttggatttcgcctttagagtgtagcttatcaaccagtaacaacatagataatgttcccccaaagccacaacgcagacacagtgaaaacaccttcaggggggtgtggagtactttttcaacagagccagatgagaacacattccaggctaagtctgatggttacagctgttgatttgaaacaactttggtggtctagcatctactaccagaatattcaatacaccttgccatttctatgacttagattccttggaagacagtgagctgcttagggacagaggaaagccccacgttggcagcagaggtctcagtggcttggagcacctgctgaacctataattttgcagcaaaatgagagtatccatttttagcaccagagtttttttatggtttagattttggcttctttatttctatagcaacttcactatgtttactcaggctcagaataaaggccccttttctttagagaatgattgccactgacagtttagaaaaataaaaaaaaaactaacttgcctggaaaataatacttaattgttcatgatattgtcctgacctcctgcccttccctcgagaagactttaatatttaggagataccataagtgtatggagggttttgttttttctagatctaaaggaactctgtcaaatgcagtttatcacaaaacctccctctctccctttagttgtttcaatgatcttttatttagaattcgttgtcagaatccatacttcgcacttgagaacgctttcactgtttttcttcagactaggtggttccccaataagactttcttgctcaacataaattaagatggtttcccacaagatgagtcttttatcagagcttggatgcaagttgcatccttattgttcttttcttttttctttttttaagcatccacaaaaggcatttttattgttcatgtcccagggagttcttgaaaattctttttttttttttttaacttttattttaagttcagggatacatgtgcgggtttgttatataggtaaacttatgtcacgggggttcattgtacagattatttcattgcccaggtattaagcctagtactccttagttattttttcagatcccctgtctcctttccctctgcaccctctgataggccccagtatctgttattcttctctttgtgtccatgtgttctcactatttagctcccacttataagtgagaaaatgcggtatttggttttctattcctgtgttggtttgctaaggataatggcctccagctccatccatgttcctgcaaaggacatgatcttgatttttttaatggctgcatagtattccatgctatatatctaccacattttctttatccagtctaaaattgctgggcatttaggttgattccatgtctttgctattgtgaatagtgctgcaatgaacatacacacacgtgtgtctttatggtagaatgatatatattcctttgggtatgtgtatcaattaatgggattgctgagttgaatggtaattctgtttttagctatttggggaatcaccacactgctttccacaatggctgaactaatttacactcccaccaacagtgtctaagcattggttttctctgtaaccacgccagcatctgttattttttgactttttaataatagccattctgagtggtgtgaggtggtatctcattgtggttttggtttgcatttcttcaacgatcagtgatgttgagatctttctcatgtgctttttggctgcgtgtatgtcttcttttaaaaagtgtgctcatgtaagaggcaattttggggaagacttggtgaacattttgtttaggtttgggatagagatacttctagaactcgagtatgagaaagtcttgggattgaagtctttaagccaaggttgtagatagcagtgccaccatcctaacaatggatgtaggccaatgatcaagacatttgtgtttctgccttttatgttgccacagtttcagtgtctctttgatccctgattttttctggctagaaaggctaacttggagattataggacagagtggaagtcccctcctaggtaacagaatgataaatgccaagcatctgtggagtacgttcatacatatgtgcaaacacaccaaactatttagactatactcatagttttttaaataaaagaatcgttgcctgtctcttacttagttgtctctgcaggactatactattgctgtttcctccacatatgattgtgcagtgaagtatctctaattacaccgcttcttacagatgcatccttcagggaagagaggtagcaaggtgtgctggagtgatatcacggtggtgtttctgagcaggtgttcctgaccccacatttgattctactgtaaaaaatcagaagatgatgggcctctacttggaaaaatatcattctctatgccattctattgtcaggtcaaccagtacttggcagccaataattgatttttcagtttctaactaaggactttgccttacctgggccattagtaataacaggggcaagctgaggttttcaggcagctgactgctattgctgtaagcatttccatttggtgtcagctcttggtcattatatttgctttttcctaagttataatcttccatgcctttaagataccctggaagattcagtgagcattctctgtaagacaccttgaggagaacaaaaccaaatctgaaataatacctggtattcagcttttccatattcctgctttgccacaatagtttcctagctgatcttcacacatgagcttttaaccatcatttccatgctaggaaatctctatgctaagtgtatgtttgagaaaagccaacgaccaaggaaagaggcgtttccatgaatgatgtaaattacagtgagcctgtctatactcaagttttctcatccatctttggagttaagaccaagagaagtgatagagtacttgctaagcaaggtttagggaaatctaagatagcaaattgagggaaaaattgtcagcttactcttcataaaaataacaaaatagatacttgcttaactacatttaagtcttaaggtaataaataagctgaaaaatttcaaaacataatgacataggttatcataggtgcttcttagtaagggaatacatggctttaatatagcaaataatttcatttgattgtgtcatatactatcattaaaaggataattaattttagaagatagcaatcccttaatatctgggagttcaaaaatggaaattggaatgtttctttcagtttcaagttaataaacatttcaagactgaaaatcatttttctctgttttcccaaaaagtagagaagtaatcaaaatcgttttgcttcgagtgagtagattttgctacttgaacatctagcatattatattttattacttttttaatctttaatagtagacagattgaaataatatacttatactaattatgtttaaattaattcataaatatgattttaaaaatactttagtatctgcataggctgtttcatgttttgggtatatacttaatctgttgaaatagacttgcatcttttcttgaatattttctgttttgttaaaactgttttgttctacgtatttttaaagtctatatttatgacaatattaaatgtatttctgtgaactcactgacagttgttctaacccatgaactcctatcattacacaatttagtaatacagtactttactgatgcctggtcaacaatcagattcttcatttgtattattgataaaatcagaataaaaatctcctactgagtattctcagaggtgttttatatgagctaccaaaaatttgaaaacaaatcttgacagtagatgatgtggcactgtctaatcattgtaggtcaatttaaaagctgaactctccatggtaactaatgatcaaatgctgatattttgatgttattttatttctcttatttgattatgaccttgctttctttagaaccactgcagaattgtaaatggaaaaggaatcagttatctgcaatgcctgattttgtgctgtaattaaaaagaagcttaataaaatcaggcatttaaaatatacatttatattttattatagaccagttccattgaataaacaatcatatagatttattttaaataaaattatttatctttctctgtatttaacaacttgagatttaatgatctttatcagttatctactaatattaactcataaaaatattacaacaaacttagtgacttaaaagaacatacattatattatgtcatcatttctatggattgggagtctagatctggctttgttcagttttctccgaggctgcaatcaaggacagttgactggggcttggatctcatctgaatgctcagctggggaaggatctgcttcagggttcacttgggctgtaggcagaatttgtttccttgtggttgtaggactgagggcctcattttcttgctggaggctttttcagctctagaggctgcctgcacttccttgtcgtatggatttctccagcattgctgtttgaatccaaaagccagccagggagaaagggaagctgccaagatgggtgctgcaattttatataatataacgacctaatcatgcatatatattatctttgctgtgttctatttgtagaaacaagtcacaggtcccacctaccctcaagggatcatgcaggagtgtgaacaggaggaagcaggtatcagggtagctgccttaaaatctgtttaaattacgatccctcaaaggctttccaggaaacagttctaatttttaaagaaaatagtgtaattatgggactttttttaaaaagttgagatttgatattagctattaaccttatatactacgtatagcatattatgtacactatttattgccactggcattgataaaaatcattctggttcatattttcttgtgaaaatagatcaaattattggctgagtcttccaagactacttgaatcagttttcctacaacacagcttaccttattctaactgaagctgaaagttgtccctgggggcattaaaggatgcctttgatacaaatctgattgtaaaatgtgcacatcgttgggactccctgcctaggagcctctcaactacttgtatctgtcgtttgtcattgggttcctcccaaattgatgctcatacgtgttccgaggagctggcactgttattcatggcaattcagggttcctgtgctccattttacagcaaactcagctttgaacatggagccctggttttctgtagagtcttccctccctcacccttggagcttctgtgtttggctctctcccacagccccagagcagtttgccaccatcttgtgtggcttgctgggcaatctgaccaaaagctgccttggcgtgctgggtggcgtatgggcgagtgcctgctatctgaatcaccttaactgccttgttgctgatgtgcttatgaggaggagcagcttaaagtttgatgaaggagtgtcattggcaaatgttcatcttagtttagggtttatgggttctacattatttcaaaagcttgagaaagagcgaaagattcatcagatcaatttttaggaggtagcagacttgatgatttagaacaaaactgctatgactagggaacaaagaaggccctttgtcattagctctttgtgcctttacacaattgtgatacataatggctttgtctcatccttaaataaaaggagagatgctgggccaggcgcggtggctcacgcctgtaatcccagcactttgggaggccgaggcgggcggatcacgaggtcaggagatcgagaccatcctggctaaaacggtgagatcccgtctctactaaaaatacaaaaaattagctgggcgtgttggcgggtggctgtagtcccagctactggggaggctgaggcaggagaatggcatgaacccgggaggcggagcttgcagtgagccgagatggcgccactgcactccatcctgggtgacagagcgagactctgtctcaaaaaaaaaaaaaaaaaaaaaaaaaggagagatgctggtttttcaagaattatttttctttccttttgtacctcatatcaaaatcttatcctgtgaccctttcaaaacatgtagccccaaaaggcatcaaattaatgtatttaatttttctttttttgaaaagttgtttggaggaaaaaaaccttcctaatagcaataggatgaatccttacagttgtaaaatacagaggaagaattcaaattcccagacaactagacttgttagtcctcaaatgggccttaaagaaattaatctaacataccttattttttatattaagcaaggaggcacagatgggtaaagtcatggatgcaggctcgtagagtagaccattccaacactcttaaccatcagccctttggtgtcagaaatatttgtttgttatgatgataataatattgaagggttaagagcaattttgagtgaggaacttggtatgcatattgttggaacctcaacatttacttgcaacctggttgctgttacctctcttttacagaagaagaaactgagagaagttttacaaaacaaaaaacaacagaaatacatatccactctgcacaggtagaaattggtgacagggtttgaacttagatcatggtgcgatttctactcctctgaggagcttttgagaagtcctcttcaaggagagtttgcgtgttgtaggtttaccacgtttcctctttcttttaagtatcttaggaagttctaggccatagtttgcacattcagacattgaatttagaagcagcacgtggttagtacaaacagggagactagctattttcctaaaagctctgaaatagatacatatttgggctaatttgctaggctcgatctagaatgtgtagggggtataacagtatgaaaattccagatctttcaatgtcttagaggctttagttacgttcatgatggagaaagtattcctggagagatgaaaggcaagtttagttgctctgtagaaaagtgcgagcagggcagggtacttctgatctctctgtttgatcctgttctacttgggtaagacagcctctctgttgtcatttaaacacctcattgaatggcaatttccaaatggttctttaaaatgatgtctgctgagagccagtgcttcttgaagtttccctcagtgctgtttttccccccttgccttgaatcacaatgtttatttttaaaagcttttgtggttccagccttctgcctttgttattgcagctgggctgacttagacctcccttttctcctccagcccctttgtggtttggggtccagttaggctgcatgaggactgggctgaagggacgggagtctgaggccatgacacatctgctttttgttagctcctaaaatcacaggtgtccttaattgtgctctgcctgctcaaagaagccttcctttttttctacttgtcctttttcctctgttttctccttgaaatcccttgaaggttagagtttttaattttcttgttttgttgtgttttgttctctgcttcctaacctccttcctcttccttggtcaaatcctggtgctcatctgcacccagacgcttgtctttacagaagcagccagttgcagaagaggataaacctcccaggtagggagagtgtggctaccacacacagtttcctccttggcatggccagggacagagcagctctgggtcgagctgtgtagcaagtggctcaagccacactgacagatgaagctggtgagtggaaattcttcagggaatctagaaagatttgctttaattagaatttatgccccaatctaagtcctgtagctgcaggcctctctgaaacaaagagctggctctttctgtctttggcagagacttgattctttttaagcacctcctctggattgtcctgaaattcttttcatccctttctcctctcagtgctttgtgcatttgagattctccataatgtgtcccctgctgactcactcctgcttccccgaagaagaagggtcttctgtaagttttagtcaaataacaaccatttctctgcttttcagttcaaaattttagtgggtcgtaagccttcctttcatgttgtcaccagatctttttaaagctctcagttaatttatttatacacacgtccttgttttagcttctaatattctgagagattgggggaattttagagcctggtttggctgaaaagtcaaatggaatagtcatttttaaataattctcacaatttcttactataagattgcttgattgcagtttaaaacccttctctgttctggcccattcatgttgacatactgcttcctagtcctgatgctttctctagaaataaactgcaatatgcggctgggcgcggtggctcatgcctgtaatcccagcactttgggaggccgaggcgggcggatcacaaagtcaggagattgagactgtccttgctaacatggtgaaaccccgtctctactaaaaatacaaaaaaattagctgggcatggtggcgagtgactgcagtcccagctactcgggaggctggggcaggagaatggcgtgaacctgggaggcggagattacagtgagcagagatcaggccactgcactccagtctgggtgacagagtgagattctgtctcaaaaaaaaaaaaaaaataaataaataaaataaaataaaataaattaaactgcaatatgctatctgagcaggaaactcagacagaggtgccgttagtctgcagttcactcagcttcagggacagggacagggtcaggtaaagccccatcttatgctggtggaatgaaaattctggtacctgaatcctatttgtaactcttgagtttgatttgtcactcataaattattctgattttcttcatgaatccatttttggagactaccaacttagattttttgtgatcatgatagaaattagtcttctaggatttgcaaaatagtacgtgtatccctttattagtacatctctgaatctgagaacacatgtcatctagttcttttatttttgttcactttcttttgacaactgacaatgtagaaatggaggtagagaaagatactcaaatttccttttcgtcataaagagaggaaagtggtttaaaaggaaaccaattccattccaaaaggtagtggttatagttcttaagattataatacagaggaaaacattgctagaggagaagcgcttaagactatcaggaagcaataaagtgagggctttggacctttttatgctgtgacatttatgaatcactttgcttttttgttttgttttgtttttacgttaagatctcagtgtactaaaagtcattcaattgaattaagatgctttcctggattggaaaaaaacagcactggctgttctgtactggtttaactttttctcctttacacattttgtagcaagaaaacctttttcaattcaacacagaacagatgcgaatatatcaaagggacaacttgtgactgttggtatttgaaggttcaagttaatagccttggttagccttggtcatcaggaatatattatcacaagtgtaatgagacacaatcagctcttcagattgtaatcacccctttagtctggagaacaaagatcattatctgatgagaagatgaggatctggttcacattatgtaatgagagcagtaaagagtcccatgagtcacagccagagcctcctacctccattcagcacgtgaccttggccaccagcctgtcgtccctgatgcctgtcaatggtacagatttgtgtttctgaggagtctatttttcactccaggatgacttcagaaaggtctccgcccagggtggctagtgctagacagtcaggcaccagtggctcccagctttcagttagcaagataagttctgtgctcccctgaagcaagaaggctagtactttgctttcaggagtgagtaggtagcttccattggatctccctctgtggagctgattactcttctgagtgaactgaaaaaactctacttacacagtccttcaggttggcctgtgatgatcctgtgtcaggctggggaagactgttagggtgttatatctgttgctcatgtcctttgatattttacgtcttttcttcttatcattgagagcatgtggtaattatgctctatgaagtcactgcaaatactgaattagcaaatcctgaaccactgctcctaggggaaatatagggtttggttcctgcgagcctctggtcaccatatttttgtcaactgatcaataaataaccttgtttcaagtgcattttttgttaaaaacaacttatttaatatgcaattggttcattaacattgaactcatggtcaatagcactataattgatgcctgaacaaggcttatctaacacatgcattttcttcatagggcacatcacagccttcctgcacttaggaataccagccagttctgcagccctatgcttggggccattttaaacagacaaatcaccaacaaaaagtacaagagtgcaaaaaatgtggcacgaaatagaggatgtggcacttattttcagtatgagagctgaaacaagaaggtgataggattgccttgtcagacctcggctgggaatgcctgttgtcaggagactcaaattttcactgctcatgtccatgaatggctgggaagtgcctcaagttttgattctgaggttgcaaatacactttagctaacaggtgaatttgcaaatatgtaatctctggataatgaggtccaactgtatttttcttttatgaatctcaattactatgtaaaataaataacatctagactgatctgactccttttgcacttttaatcccacaggtataaagtacgtgtttagacttaggataatgaagcaggattttctgtctatgtcagtgagtatctgtggtggttgcagcatttctggtggcagatcagagtctggtggcattgagtcatttgacaggcttttccctctgaggcacctctcagagtagtccttcttcctggatgatgtattagaccccgttgggagccttaaaacgagctttttgcctgccctcctgatggcattattgtcgttgggcttcattgcttctgcatggacctggaggagaacagtgactctggagcttttgtaataaatagcttcttcagtaacaaactgggtagggaaactggggttcctcttattatataatttagacctgcatctcagtttttcttttaaaattttgttttgggagagtgtggctagaagctaaaagaaagttttgtttggtctggattaaaaaatgcagctgtatttgcgggggctcaccttgactttcatttcaacatagccttaataattccttccaaagcagaatgccaccctgtttgccctggtgggagcaattagaggcagggctggaataatctgaggtgggatgcatcttgcctgagagagtgtgtattatcaggtgtcagggaacgctggctgtgactggatagcagttcttcttcaagctgctgacttctgttgacagggctagggcagctttggaattccagtgcagcttcagctccgggaagcaaaccactgcttcacagccatgtgtctgtcaaagcaaattggaattgaggagaagggggctccctctggccatatgagctagaatgaagatgtcttttgagcagtgacagcttccagagtgaatgttcttggggaacaaagccatgtcattgtaatttctctgaccttccttcctttaatggtctgtcctcagcattaggagacagggcagggccaattctgagctgtaggggtgacaaatggaagaaatctggtggaaaaggtgaaggaagtgggtgaaaggaagagtctgtttctactgacagagtttattatgtaacatcaggcagattaagtgtagggctaacgcctttcaattattcagatttccttcatctttttttcctcctcttctaccaggtggctcgggtagaacttcagtccttacttgttgtttcctccatgctgggtagattgccttgtctgctaaggagagttactgtctgccatcctcagccgtgcaggaaagaagacggggaaggtgacatggccccaggttcacagcagagagaatcaagaaacctgggccatttcttaccctcctcattttatttcagggaggttgtgatcaatttgcatcttcttagctactggtgaaagaactctgtgtactccagaatgtaaaaataggagaaatctaacctgaagggattgggagtagttggtcaaggaatagcaataaccaccatattattgcatcaaattatggtttggtggtttaccttagaagcctttgagataagcagctgtcaccaacatttcaccccacttttctgactatggctcttttacaatagttaggaaagtggcatgacttatgagattgtcagtgaataatggatagctatgccccttcttccagcgtaccctgaaaaagagaagcagtaaagggcacatagggcaaggcagtttgttcccagtctaatgatgggttttgtcatctccccaacaatgctgccagctttccatttgaatgaggagtcttgtttgttgtttaatttcccaagcatttacagtggctgctgtaatgataggatggttcatgattagatggtttctctgacgggatgtgtgaggagacagagacagattttatattagcatgcagcagagtggctagatgtctgctgatctgagagaggatatagatgagaagcgtaaccgacaacagcctcttagttgaacccttgagtctgtatattagaaaaaaaatcacaaacaaggacaggtctttgaactgctgtagtctgactttatttctgcgtcattgttttgtccccttcagagttatacaagcctttctttttaaagctctgtattcaattattaggctgatttctcttatggagtaccttcccatccacagacctaaaaagcagttgatgagaattctaagtgtgagctaaccaagtacaacatgtaataaagtcaagattaaaacacacattttgaagtcaagcacagaatgctgctaaggacatattgattttctgatgctgaattaactaaaactattttccgtttcttttttttttttttgatgtggtagatcacattataacttcacttttattttagccagagcacatatgtgttttctaaagccttctgtaaaatagaaaactgggcagtgagaagaaagctccttcaaacttttctctgtggctgactggggagaggggacagctgggtgagtggagaggggtgtaggtgtgacaggcagcagcaagggagatgctttcaggtcattggatgggtgaaggagcctgaagcctatgattatggagggagaatgggagtccagacagcaaaagtgaggactgttttaatcaatgactgcagaattgctatatagaggaacactcctattaaactgaatatcattaatttcagatactggaacaatgtatacttagcaactggcctgatatctatgaaaagtgagcttactaagtggattatccatataagcatgacatttacaaagataatgtttatatttctaaggggaagctattttccttcttggtccctattggccaccgggttggcctcgttctccccacttgactgtgttcatgagcagcccttctcctctggaaatgtctctgaggctgagagtggttctcaagggcagtggagacagccgccccaagggggtctgtagaaggatcctggtataggggactcagcttaatggacaggaagaggggagacatcggtatgtttgcacagggaagtctgtgcaaagttgagcttttatgagcatgaacaggatggacagccattgttatctaaaacagggggacctaatctcctatgaacagcattgaaggcttcttctgagactagaaaacctcctaaggaggattgaaaagagaattttattgtgaggaaagatgggatcaaggtaggcctagagcctctggaggaggaagctgcagttttctctagcaacttgtaagaaaggggttcctgcatgctgctatctgccaaacgttacccaggcaccttctgtgtgtgtggtatcttctagatctgggtgaggcttaggtcatctccaggtaccacccgggttaatttcccctgcatttttgggtgattttgactgatgttaaagctaactttagggatatgcccctgttaatatttacacacattctgagataaaaatgagaaatgttcatcaaactgttgttctttttttttttccttcaacttttattttaagttccagggtacatgtgcaggatgtgcaggtttattaaagaggtaaacatgtgtcatggtggtttgttgcacaggtcatctcatcgcctaggtattaagcccagcatccattagctatgcttcctgatgctctccctcccccatgctcccaacaggtcccaaggtatgttgttcccccccatatatccatgcattctcattgttcagctaccacttgtaagtgagaacatgtggtgtttggttttctgtttctgcattagttcgctgaggataatggcttccaacctcatccatgtccctgcagaggacatgatctcgtcccttttaatggctgcatagtattccatgatgtgcatgtaccacattttctttatctagtctatcactgatgggcatttatgtttattccatgtctttgctattgtgagtagtactgcagtgaacatacgggtacatgtatctttataacagaatgatttatattcctttgggtatatactcagtaatgaaatttctgggtcaaatggtatttctgcctctaggtctttgaggaatcgccacctgtcttccaaatggttgaattaatttacgttcccaccaaccaaactgttgttcttgaatatgctcatttacttaggcctggccttgggaatgtgaagtcagctgactaagacagatgcctgcccttgaccaggagacagagaagtaaacaatggagggtgatgggagaaacagaaaagccagcatcacatgtcacggtcacagaggagaggcaacaacatcacacggggatgtcagggccacctggatttcagagagccagcaggcagggatgttaggatgaatggcttcagtgatgaagtcaagccaataagataaaatctaaagagcaagaattacagagatctggatttagtttcataaataaacttcacaggtaccacgaggagaggtgttactatctcaatggcttagcaaaccaaaaccaaaaagcagactaacaccagcagtcagtttaatactgttaattccacaaagggaggggaggagttgtcttgacagatgatgaaggggaaacataaacccaattccactgttggggtaggcagaaggggcggggctaactccctgctaggggtttaccatgtgtcaggcatagccctaagcactgtcagtgtaaaataatgaaacacagttttgtcaaacatggtttgcatttcaggctggtcttgtttccttcccatttagttccacagagtggacatccattgaatgttggcagttgggatagactctggctcctttaataattggtgaacttagaactttcctgagattattcatggtttctcttctatatgttaggtccataggatagctcagaaaggttggggagagtgtcaaaagtaaagaggaggacactgttaaatcaagttcctgggttgaatttttaagggtatgtgttgggaagcaaagggaagaagcatcttggcccctccaaaagtgcatctgcttccccagcaggttgacttcaggacatgccgaccttttggttctgtttgggtgtccgactggatcaggttgtctcctagatgagggctgtagagtgggcagagaggcatcatgactaatcaaaggcagctggcatgggtgcttttacatattagtgaaactgttccatgtcttcatttgggaggaagtttcaggacagtttgtgctaaaatggatgacatgactcattgccaaatgtgaaaaaaataagtcattacattcccccacatgtgtaaactctctaaacacaacagtgtttataggaaggtaagacaccatctggtttgttgtgttgtagcttatttctcatttttaatcactaatttatattgaggggatgacaaatagaacagaattagatttttggttgtgcgacacactcagggattcatatagtgttaagtcctctataaaacatgaaacaaacgtttaggtggaattcacattcctgagcaagttgcctgcatgccgtaatgcgaaaatgagatgctattttcttctttaggccttggtgcccatcttggacgatgaaagacctgacaggtcattgggactgattcaggaggatttaaaagtcttctttttcatgtgttcaaagaagcgaacattctaaaatgactccagaacattcactaggtttaagccagaatagaacatcagagtttgtcttccaaggcaaaacgcaattggcttggcccagatcattgtataccatgtaaaacagtgacactagggcttaggtatctaaaataagtgaagtcacagagagcccaatatgcacattggattggcttgcacgggtttatactaatcttctttccattactgagttgaaggagcacatcctttcatttctcttttctgagtgtgtagctagaaaattctaaaaatctactgcctgttctgtttttaggaaaatatttttctgaacaatttaaccaattgccatttcactaataattcattgtgaatttcacagttagccaacttttatgggataaatgagcccctctctgttttcatatttcttaacagacttgtctgcctcagctcagctttttctctgagaaaggtttggtgtcagatgtggtttaatctgtggccggcatttcgctcttctatgtaatgaccagagggcggatataagaacccagccctttttttatgttttaacagagatagttaagtaacaagagtagtcaaataattttttaaagagttaaatcttaatattaaaattaaatcttaaatttagatctagagttaaatcttgagtctcctttgtgtaggcaaactactgcttacagaataagtcttgttggctgtgtagttctgaataagtaggaattgagagaccacatttttcaaagggtctcagacaccctttttttctagggactgagattttcctctacaaaggattgatcaatttagctgtcagagtggaagcccagaggccggctgtccttgcaaattaactggttgtgcaagctcttcaaaattgcctgcatgaaaagtgaggtggccttttgaaaatctggcacatggtggccaaaataagaaagtattcactattctgaggccctggtgtccttagagagcgcataacagaaattgctcattttgagcacttgcttagtttttggcaacctgtttgctttaataaagaagtcatttttgccccctctctttctttccctcagccccatgcctctttgcagttcagaacacatcattgtctcatgtgagagtaatgaaataggaagtgtttactccagctttatttccgttactgaggcaatactgagtgccagctatttctactagctttaaatattcaccaaaggataatctgcatgaagacaaaatggaaaacaattggatttcttccttccaaactgttgttaggattagtcaatgctttgagaaacaaaatcccctgttactgtgtttatttttctttagctcggagctatgtttaatatttctagatcattccattcacagtgactactgtctgatggagagaggggtctcaggctggatctgggcatgaaggctccaagtgggaagagtatttctctttcatgccatcttactctttggatacaacttgtagaagtgcctgctcttctgtacaggaaagtagaacttgcccctgccagtcatagagccagatatttgcatgattaaatgacccaggtgtgaggtcatgtgtcatcacatggggacttattgtccatgaggccttgacctctgggactggtctccaggtgttcttactttggccctgtgggagccagagactcagtgaaggggaatctcacatctgacacttttttttttgagacagagtctcactctgtcactcagactggagtgcagtggtgccatctcggctcattgcaagctccgtctcccgggttgacgccattctcctgcctcagcctcccgagtagctgggactacaggcacccgccaccacacccggctaattttttgtatttttagtagagacagggtttcactgtgttagccaggatggtctcaatctcctgacctcgtgatccgcccacctcggcctcccaaagtcctgggattacaggcgtgagccaccgtgcccggcccactttttttttttttaatggcacgagagatatttaccgaagggattctttattaaatgttcttggtaaatatgtggaattatttctagatcaaatattagctggttcctaatgagattgtttctgatttggggaaaagcgattccaaaggctgaattccttgagggcagagacctcccatgtcattgtggtgttatgcacgtcattcagcacaacatccagcatgctaaactgggatgcaggaaaaattctctgattggaggttcaagctgatgtggaaagtaaggccatttatttgcttattggaatgcaatattattggatatctataacgatctgattgtaaatatgtgtgtgtgttttctttctctgtgcatttattttgtcccacattttgtgtaaggtctctaatgtgtaagccatgggtgtttgcatcagtgctgtccctgctagagacaccacttcattcagaacctgtttgtctgtgcacagcttggctggggtcctgcacagattctgtattcaggccggtgcgggcaaaccaagaggcaaaggaacatccttaagaaagaaaaaccgttaagagatgggcccactatatcccatctctttctaactccgctctcagcatttagacatcacaatgtcaaataccgttcaaaatttaggtggtgcaactactgggtatctacccaaaggaatataagtcattatatgaaaaagatacttgcacatgcatgtttataggatcacagttcgcaattgcaaaaatgtggaaccaaccaaaatgcccaccaatgaacaagtgaataaagaaactgtggtatatctatacaatggaatactactcagccataaaaaggaatgaattaatggcattcacagcgacctggatgagattagagtctattattctaagtggagtaatgcaggaatggaaaaccaaacattgtatattcttattcataagtgggagctaagttatgaggatgaaaaggcataagaattacacaatggcctttggggactcaggggaaagggtggaaagcgggtgagggataaaagactacaaataggttgcagtgtatactgctcaggtaatgggtgcaccaagatcttacaagtcaccacaaaagtttggttacacttactcatgtaaccaaacaccaccttttccccaataacctttggaaataaaaaaaaaattaaaaaaaataaactaaaaaaaaatttaagtggtgatattgaacaaatccagagatctatctttaaaaattacatcatttttcatttgagtcctgaccctgtcttgaatgtaaagtggccagcaatctcatatttgggagtctcaatggacttgctccatggatcagcctctgaccccagccagtgctggcctgtagaggagagaaggggtggggtatgcggctgctccctggaccatggtaagagtggttggggctggctgctgccttcatcctataatttcttcatcacctcaagcttttgtgcattttgcttttccttttcaaattgtttccttgaatgctggaatatttgcccaggaatgtggtggtagctggcagcagacgttctgccagtggaagggaatggccaggaactggccctcctccctcgtacctgaagctgacattgctgttatttgtatccttcaaagatactaatgcaggcgtgagaaccatatatggtatttagaacttttgtgaaataagtagattttagctgctcttacctcaaaaaatgtaactatgtgagatgataaatacgttaatttgcttcactagagtaaccattttactatctatatgtcacccattacatcatgttgtaaacctcagttttccataaaatttattttaacaaaagttgaaggaaacaataaaagtccattttataatgatagattatatcatatttttcagttggctgcaccatttcaggacatcctgttatccctgtagctgcttctagggtgtttttcttccccctcttccttttcttttgctcttcctcccctctcccctctctctgctttcttccctataacttttgcctcaaagccttgttctctgttcctgtcacccactctttgttttcttgagtggctggggtttccaaggacccccagccacagagattgccattctttcaagggacattattatcctaaatgtccactgtcgatttatccaagcacattcctgtggagaccacctgtggaacaagtgacagaggctgtcagaagtgacctaatggaagcctggacacccaggctacggacagtgacagaaagggttgcagtgcgtataaccagagtgaatggcgtttcattatcccacagcccacatctgagtgctgggtcctccacatagttcctgtcaatcaaaccagttggcattggatgaaggcaattccaaaaatagtgtcctttactcattttgtattttcattcctactgagaaaattctgattttcgtcatttagtttattgccctaaattcaagaacattcattcctcagtaagtacatgctgagtttttagactgatgtttctatataagtgattctttgcaaaaatggactgtgatgttttgactttttatttagcatattttaaaatctattttagatagttaatatatttctgggaatgtggaatatattttctttgtgaataattccaatgcgataggccatttgttgctcctgggttttaaatgttgatgtttagggctgaagctgcacacttagtcatgtggggccccctgaccctgtttgccatgtggctcatgggcaccctcaggatcaatgatttacatgaagaactctaagaatgtgtaaaacctgttgtattagtgattatggttgatctcagtcaaagggtacagtagtaccctttacactccagctgtggaaaaggtgcatagctggagtccaggagaggctagtcacgagcttctgatggtctctttccagtggagacacgtggacagtgcttcttcccccacaaggatgtatgacaacatgcatagggtgttgccaaccaggcgacttcacctgagccttggtgtcctgagtttttattgagaattgaccacatagacatggccagactaatccagagaggcccaagccctcagccattaaccacatggttagcctagactatctgtgtggcctaaagcccccccaaaacaaagtctctcatcaggcaggacattctaaggtcttagaggtgacttcccaggaacttggcaaaggcaagtcctttgcttggcaagggccatgttcatccttcactgcaattctcctcatacctggagttctctggtggcggctttttaccccagcttctccccttcttgtcttgtgcatcctctgcagagctgccatattcaccctcccaaagtttgctcatcctgacatcccactgaaccttcagtgactctgccttcctttggatgaagtctcatctctttctcatgttaacattccctacaatctgtgtgtcatctacttttcccatctgttagctgtctggagtgcctcttttgagctctccatgctcttgcatgtgagtgatcttgcaggtagtcatcgtggcacatgctgctgctagccgatgctggctgcctccacacactcctgatgccaccctccctgctccttggcctgccacctggaatccaccctcctgtttacttccttgtcttcctccagggacttgagcatgaggccagatttctgtctgtgattcttatggcattgcagtccagatttttacctttgtggaattgctttttttcacctatctcattcagtttgcactcctgcaaactcttatcttggtgggctccgtggtggggtttccacccaactccagggatggtaccaggaactcatgctttaactcaccatggtgctggcgtaaatggctcttctcttatacctgatgactttcagctgttcctccctcatctactgtttgtttcacctgcaatgcacccactaaaacatacttcactgtgtcttttaatatcctccttatctcctcctcatcccttagagcccacatcacatttcccattttcagaaatcttttccttgactcttctgcccataagtaacttctctttcctccaattcatagtatatactgaactacatagcagaaaaatcatatagacagctcctgagagtgtaataggttcttgttttgtcttctaagcatccaccatgtgtggccatggggctgtgctgtgcatggtgattaacggagggactgatgatgagaggcctgtcaattaaatgccatggcactggtctaagtcttgcctttgggaaatgctggcccagcagttcttaggtttcttgaacctgtatcttttacggtttcttttcatcactccactaaactttctgatgccaggtggtcttgtccatttttatttccagtgtaatcttactgttgtacggtttctaaattcagctcataagactggcctggcatgttaatttctgccatgtatctgcaggataaaggctaccactcagctcaactttggtctccaaaataatgcttaagtctacatcttacctcattctgagtaagttgggcagggagaaggttgcatattttagcagaaagtcatgtgctgatgagcacttagtaagttataattggtattcaatcttcttcatgtagttccatctagagacaatttgaagagtgtaggtggccacagggcaaaacttctgggaaagagttactgtttgtaaatcaaaagtgtcgtcaagatagttctgcacatatatgttcatggtggcattttttaagaggcagaactctgaaaattatgactcagaggatttcagaggttgttggcaccaaggttaaagctaagctaaaagagaaaagaataaggataatatggaattgagtcaaatagagaaatttatatgtttataaaaaataagcagtttcttattaaatgggtagttaactgtcgcttaaaaattttccaacttccagtctggagtgagcctctggggctttgtagtttctttgcctttcagctttcttctcagttttctagaaaatatgtcagtgatttatgattaatgcattggctaatttatgaccttgctgggagaggacacgggggctctgcttctggacctgcaagaatcattgtctgttcctctagcttggctccaactcaaggcctctgctttgtcactatcatttctgttcctgagtgcacgttcccaggcacacatgggtgtgttggtgagcaccctgtcttccccaggcaagggctgaccctcaggagcagaaagtcccaacatggctcacttggctgacaagcccccaggctgttaaaatatctttttcactatttatgtaaacacaggcacagtaacaaccctttcgggtggacacccttgaatcctgctgctgagactgatttcctgtttagacatcaaactctgtaggaagctgtgttttcccccaagccaagagagctctgtcctgtgggtattgcttttccacaaggaaggggctgggttttggagtctgttggttgcaccaggactgtctggcggtccaggctgtgggctgtccatgctggattcggcagggatgtcttcttcctgcagtatttgctctctggttgtgttactgattgtgaattcttgcaatgatctttttggccccagtctctttcatttaagagactgacccatattctgcaggtgtggttttgctgtccagctgagggttcacatcagctcatttgtgacctcactgggggaggcaggagacctattagccctgtttttaatgtagttctgagacatgggaacttacagaaattgccagctattcatggcggtaaccagaggatctgtcaaactttattacttacatttcaactcagatctaaacaactacaaggacattttagtaataattgttgtaaaatagattttaggactggagagaggatgcttgtgtattcaaacatgccatttaataaaggagtttcaactaacatattttgttgccacgcccaaaggtgatattagtgatgttgtgtaaaagaaattggccactctgaggaatatttctgagactgagtgtgcttccctggctcctcttttggcttcaaggatttgcatctgcaccttctcctgtccaaaggatgatgtcacggacttttgaggactctgctgggactggaggattggccgtgctgcacgatatgagggtgcctgggctgctggggcgtctcaggcaggcatgtcccagtgtgttgccctgggtcacccccttgcttcccatgaacataccaaaggcccgtcctggaggaagggagactcatagagaggcagtgccaccttgacctgttccctggcctctgaaccctagggcttccaaaatggcacttcagcaggtataacattttataaatttccagctgctgtcgttcagttcattttctgcaggcagatggcctcggatcatgactgaagctgaccgtgtgggaatcactgcctagagggacagccagaatgttctgggaagttctttctcccattttcccttcttcagggtggcgaggaagaatgtcagggtgtttcacatttatagcagccagaagctgccacctgggaagtgtagagaaaaaccagatgaatgaagagaacagaaaaaagcatgagccctgaaatgcagtatttgaagtcacaggcatccttcactggtgatgaacacatttctcatatggatcatagatggaaagtcacctatattttcagcctctggcatacatgtttctagggaggctggcgtttcgtggtcatctttccatccaatgacaacatcaaggtttcagaatttttgtatatgaaattgaatgacgagattggacaggtttacttggttttggtaaagtggcttgtttttcacgatgcatcattccttttcctataaagcctcataattgtgcacctaataaatcagtatgtaaataaaaatacaaactcaaatttctagcagagtttgtgctactgcctttgtctcctgttcttgaattgtataaggtaccatgtgttccaaaaagtggaatgagtcatgaaaaggataaattcatataatgaatcttaatttaattttcagactgctttagataatttcagactggttaagataattttgaaataatggttcttctggatgttttatgagagttatttcatctgttaacagcatttaaatgttttatttctccttttctgaagaaaaagaatccattagtgcacatgatcctgaactagggtagcatgattgtgatgccaagctggcctgcgtcactgctttaatcctacgtggccaaagcagcttgctctgattgtttaggactttaatggaacttcatagaactcatgaccaatgaccacatcctcttttaaaatgggttgacaggatctctctattttcttttttgaagtgttggtgtgtgagacttgggctggagtgcccacgtggctgtggagtcagtgtgattcatgattgaggaaacgcgtcctccatcctctctctccttggtaagtgagacatctaaatgggaagtgaagaaactaaaaaaattacagattgaaatatttttgacagcttgtgagctttacttctgttattaaaaataagagtaggctgggcttggtggctcacacctgtaatcccagcattttgggaggctgaggcaggctgatcacctgaggtcaggagttccagcctggccaacatggtgaaattctatctctactaaaaatacaaaaattagcctggcgtggtggcgcgtgcctataatcccagctacttgggaggctgaggcatgaggatcacttgaacccaggaggcagagtttgcagtgagctgagattgcaccactgcactccagcctgggcaacagagcaagacttcatctcagagaaaaaagaagaaaagaagaaaagaagaaaagaaaaaaaaatgagagttaatgagcaagctttcagatagagaaatctttcaagtaaaacaattgtgggcatataccaccgctacatcactcaggaacccgaagacgtgaaaaggcttagatgcttcttagcatcttctgcgccccagtgtgactgcctacctggtttcagttttgtctcctgcagttacctctgtgcgctgcccccacttatttgcagtgcataccactgtcatctcacttcctgtcctgggaccttctgcagtcccctgtacctgctgggtaagccctaaacctctcatgatactctcagggatcctcctggtcaggcctccacacaatttcctccttcctgtggccctgggacagtgtagggactgaccccccacttcacaatgatctgttcccaccacgaatcgtgcttgtttggatcttccaaaggctggctcagaaatgctggcttcacaggagcctttctgaagcactttagacctaggtgttgctaccttctgggaaggctagaagagaggaaggggtgaagggggatagaggactagttgtgtaggggaggaacaagtaaagtgagagaaagtgacaatttcattccatatactagtcactgcaaagacactaccattgtttattaacttatttatttttctccctaactaaattaccgtctcattgtggacaggcttatattttttccccattcacaaaacactttgctgattttagataatccagagattttctgaataattggtgaccattcctgctcttggattatgagttaccagtccctggcttcgtctatgaggaaggaggctaaatgggtcttagagctgggccctctgtatagatgtgtagatgtgctcagctgagacgagaggttctcctgtgtcgtccttacgttttgcagaagaagaaacggaggtctgcattttgtatctttctccagcccacgtagattcaggttcacatagtgtcttaaccggaacctcccgttccctcccccatggagaaccacagcacctgagagctggaagaatgaccacatggagcctgtgttggcttgctttggatggtcagcggttatcatgatatatgataggaagagttattagctaatgtaagtcctcattgtgtgtcaggccctgtgctgagtgagatgtttaaaattctcataacaaccctttcaggttcgtattcttgggtcactgttttaaagatgaggaaattgaggcacagagagcttaaataatctgcaagagaattgcagtgagtcagaggcagagctgggatttgattctatcttcttaacctttacagaaaactgccttttagcactaaccatgcctccctagaataagaacagtcatattttagtttttattccttactggagttactcagacctgtagagagaaactcagaacaaatattaagaaatcagtttttcaaacagtaatctaaatcaagaattggcgaacgttttctaaaaagtgtgagaaaacattttggcgcttacaggccatagagtctctgctgcatcactctgccgttgtagtatgaaagcagtcataggtatgtaagtgaatgggcatggctgtgttacaataaaactttattacaaagacaggtggtgggctggatttggcctccaggctaagcagctttctgagctatgattgacacgatccttgcactgccgaagacctcatagtatagtgaatgagagtgtttcggggacagtaggtattagtcccacagtgcaatttatcttggatgcttggattttaattataaacaaattttattgaagtctattgtaactgcaaaccttaccccttagaataaggacatttgatgttctattgcttgacatggtttatatgccccaaatgtgttagtctaagtcccacctaaattacagctttgctcaaattagggcctggtaaatattattttcttgacattttgttaagctggtatatataactcatttatgaaataagtttagatggtatttcctactttggtttttatatagtttctgaatgtgacactgttagtttgcacccttatacatactgccttttatatatattagggtaaacatgcaattatcttgggccttctgataattttgttgaacaagaatgttctggtctggtctcgaatatccctcttttattatgagcaaagatggagtttgaacaggattgacatagttaaatgatgaaataacatggcaataccctttgccacataaataaattgtggtatgattttttaaatttttcttttttattacaaacggatacttctgatacttaaaggcatatttgactctctactatatcatttacaaagatgggcaaagaaaattgaaagaccaattaatttgtgtttctttaagcaatttaagcaaggaactattgtactcattcattcgttcattcttagaaatctataattgcagcaaactcaagagcctgataatatagcagaagttttggagacatgcctttgtcaaggagcactggcccctaggtacttattccatgtgccatggcaaagtgtgcttcaccttaatagcaatgatataaaaaatgaaattctgaccataaaagtaatggaaaactatccttgattccttattaactgagaaagcaaattgcagaataatatatttaatataatcccattcctcttaaaaataaacacagactcacacacacaatctctatgcacaagttcatgtgtattataaagtctcctagaatatatattaatatataccatactctaaacagagattatctctggagtacaggtgtttgcactttatcatccatgtggtcagtaagattttcaggagtattattatttttacaattaaaaaaatttttaaagtgcattaatgtagtgaatgctcattactgaaaatatataaaagaagaggaaaattcaactataatgcctctattgaagacaatcacagacgacatttaatgtagtcttttatggaatatttttgataagcagtttaaagagttgagataatactagacataaaattctgcatactgctttttcacttatacatactttctcatattattgcaaattgaagaaaaaacccttgttttaatgtatatgtaatactctatcgtgtaaaggcactgtaatgtcatttcctgcttcttttgtggaacatatgttgcttccagttcacaaaagtcatagaccatgctgaaatgaacatgaaaagggtgatgggagacttcatacacctgagttccaatcctgctttctcattttgagcaggtcactgtatttggtgcatgaagtacatgcttcaaaaacaatagcaattgttattgtaatactttcttttaattgagggttaattcattagctcagaagagctatggttgatttactacataaaacccagggagtcttaaaaatctgccagttggctttgtaaaagtattgtagatatttatacttcatttatatgctggagaatttattttgctaaaacaaatttgaatatcattactcaaaaactttgagtagtattattaattgttttagtcaatttgataatattctttttttatatattttattttttactcattgtgtttctttgctaattttttttcaagcaataattagccattactctgagaagaggtgagagaaagagagaaaggaggaagggaaggagggagggaagggtgggagagaaagagagagacagagacaaacaagcgtgtgtgagaattatttgtccagattttataactgtttagctatagagactcaacatttttcttacagattttaaggcttaattattaagaatattaactcattattgtcactgttttttccgctatttcatttgcttgtttgctttatccttttaaatttaaataagtttattttagtgatgtcagattttttcttgataatgattttaatcagtgcttaggaataaaacaaaacattttcatctataaaatgggaatagtaaaaaaatgaacaaaaattctttactttcttctgattgtattaaaaatatttaactgtttaattcaggaacagatatttaaaatatagttttgctttttaaaaccttctcaatgttttattctgcctttctttgtcctcactgaaaaaaatcaatccccaattttaatttattgtggatgttcggacaataacaatatttgtacaagtgggagaaaatcccagaaacacacttctcctttctacaaatagagacctagtttagaaccagacaacttaaattttctcattcttttattcattcttcgttagggagaagggaactttctattttaagattttatataacctatgactatattttaacaactatatttcatttttaaaaaattttatagaacttaacccattatattaaccatgattaaatcctgatcacagtgctttgcttcttggctcattcttgtagctaacttaaggtgtttgcattaaatgttacatggtgggtatcaaagaccaagttaaggctggtcaaatcacaaataagatgtcctcgtttgtgcagtctcgagcactgatgtaaaatagtaatttgttgtgatgtgcgtacaataatgttaagggcaggagttccaaaagattgaatctagatctcgctttttgagattcataaccacctgaccgtggacagatcggaccaagagtcagctctcagtctttacttgtcttgattttgttagatttcttggctataaaataaggaaagtgagaagacataggtttgggtgtgataataggtaatgaggggtttaaactagacaaagagaccaaatatgaaaaaaaaagtgcttgctgagttgctgacggtgtttctttcggtgccacgttcctgaaaggaattttattttgtgatattttcagggcatctctatgtatattgttgatacaaggtacacacttgcttaaacatgctgagtggttgtaatttgggataaaggtttagcctgtcattcctaataatgtcagaaatacagggctgtagacaccactcctgagtcccatccgattgtgtactcagcctgatggaaaatctctgtgaggccatccagaaaggcccgtgcagagctgatctgttttgtcacaagcatttcactccgcttaccaaagctcactgacaggagaattgtcagcttccattatctccatcagaatgcattggaattccccattatggaacttgggaaatcttgcctctctctctgttctctgctgtttgagatttgggccttttcccctcttttgtttaggtgaatgtctgccaagtgtgttatcttcctgaaggtcaccagctttatggctactataaatatttgtgaatcacagctgtgtggtgaagttcagaattcattttcttttcttagtttcgtgattgagtgaggctgggagggattgacgtgtgctgtttattctcagacacccattagaggggcagatgtgtgtggggttaattgcttggatttggatttacatgtgcacgtaaggatactgccctctcaattacactgtgtgtaagatctctttttttggcagaactttcctgagggcataaaaacgaccccacgtttggatctttggatttcatgggactttggggattttcctgccctgtggtttccagatcagagtattggagaggcctctatagctgcagggctgcaaacctaatcagttcatgctttatctaggaaagctagtgggggtttcatgtgtgtttgtgtctttttgagcctccgaggccacaaagaaatcagagtcattttgcttcatttgtttttgtttaaagcctgagcagtaaccactattggttaaaccaaagcagaaaaagcaaaggttgggaagttggttgggagattctgggaagtaaatatcaccacattttcatgtaacagtatctaagaatagtgcacttacatttccagtgctgaggaattaagtgggttgatctaagttgtttactgtagctcagattttttttagtacatataaattggggtacccttatcacagctcaggggccacatactttttgagaactgttcctcttttcttcattgcaggccacctccttactacagtgatgttttaaaggtgaggtacctacccaagtgggccaatcacaatattccagctagtggacactgattaattctgatggaaactcttaaccctagtttggccaaactgtatcccattcctttgctcctacagtacttaagcagttatttcctttctttcctacataatcagcttttatttttccctctatgctgtttatttttttttccaataggaatggaaacatctatcatcctaagaaaatttgacctgtggcctctaatttcctctttagttataatacatttatctcctctttgctaaaaaaaaaacaaaaaacaaaaaaaacttggtttaaagtatttgcctgtacttgttgtcctccatttctgcctttttattttattttgagcccagtctgatcccttagtcattccttcagcactgcctagtcaagatcacccaacaccgccatgttgctaaatccagcagtcgaggctcagtcatcatcatacttaacagttagcagcttttataccatcgacccctcccacctccttgacatactttctctacttggctttaggatgctccatttctctggcctgacctcatatctctgggctttgcatcttagcctcaaatggtcatctccctgccatccaagcactggagtcccataaggttcagtgtctggaccttgtctcttttcccaccattctcaccatttagaaatctcttccagtctcatggctttagtatcatttgcacactaattactcccacatgtctatcttcagccaaaacctatccctaagctccagaattgtttatatattcaactgcctatttaacctcacaactggatgtctaatttatgtcttcaaattaaccatgtccaaactgaactcttttctccccacaacccctagccatgtccttctgtagagttcctcattttattaatgggaagtccagtcttccacttgctcaggctgaaacagttggaacaatacttgattattctctttctctgtcaccccacatcccagctgtcaacaaatcttattgttgttcgtttttttgttcaacatatatccaatatcttaccacttctcagcaccttcactgctccctgcctcagctaagctcccagcaacttggtccccgtgagttctcaggtcttccggccgtctcgctgcttctgctcttgggcctccgtggtcttttctccacacagtgaccagacaggctctctgctgagaatcctccagcagctgctgccttattctgatggaaagccagcttcctcccttggtgcgccaggcaccacgtgtcccttctttgtcctcatcctctctcttctctatctatctttctctcccaagcaccagcttcagtttcactggcctccttggtctccctggaacagagtagccactttccttgctcagtcttttcattctgactcctttctgtgcctgcagcactctttacctgaagatccctgaagattgctccttggcctacttcaagtttattcaactcttaccttgtcaggagatattcctgatcaaatgactaaaatggaaagtctccctgctattctctattttccttttctgctttattgcttttcttgtaaagaacttagcactgtctgatacatgagatattttgtttatcaattttacataacttctgcccctgccttctcatgtaagctctaccctgccagggattttgcttattttgttcactcactgctccattcctaggtgaggtaagggactaagatgtaataagatgccaataattatttgttgtgtagatgggttgatggatggatttttctgggactttctgaatcgcatgagtaataccctatttctaatttggacacagagctggaaggctatgggcttggctaagagaagaggaatgggattcttcctcccccaccccaatcagagattcatgcatttggtataatttcccccacattgttcagtgggtagatatttgcttgttcaccagttctcagctaatctgtctcattttccatgaacctttctcttccttctccatggccggatgaattaagtcacaccccctctgtgtccccacactcctgtgcacatccctgcaatggcaatttaaagtaggattcattgtagtattttgtaaatacatatagtccttccttttcacactgtgaagtccttggcttgattattgcatccgtcttcccaatacttaacactctggcacataataagcactgaatacgtatatgttatttaatgaagtgattcagatggaaattttgtaaaatataacttctctaatggtccttaagagtgtgattaaatgtactgctctagccttctgattgtgctatatttagtttaagaagtttattgcataattttacaataattaaataattatatttgctgtagccattatagactgtccccatattgtccagctggggccattcattttactgctttctcaaatagtcttcactgttttccagtgtaattgaacatcacttacagtgtaccaaagacaggaaagactgtgagatccttctaaagtccgtttcttattaatggttatctatgagatgtagaagagaacagaaaaggaaggtgaggtattcaaatagcaccaagaccgaaaccaatgtagctgctttcctgcactgtaggattcggtatcacttccttcctggcatctaacctttcttaaagtgagcatttgaacactatcagtgttacagtggaatttcatagtatcatcttcaaggagtacatattaaacataaaaatagcgcagcacagcatgactgtcaggttgtggggtgagccaagctcagaagactgaaattgtatttcctgtaacatagttatctggatgtacatgtccagaggacagcactaatgtttaagagtatctgccttgctgtgaccacaattctgggtcaattggatggatggatggatggatagatagatagatagatagatagatagatagatagatagatagagttgaatatatatatatatatatatatatatatacacacacatatatatatttacacacatatatgtaatatatgtagatagagttgaataaacagaaagatagaatatccacctatataaatgcatgtatgtaaattatatagagatagataaatagatatagaaacagatagagaaagccttataattggatgaaaccctactgcattaggtgcactaaggcagggttaaaatctctgaaatctatatgtaaaacagtatactaacacccagctatgtaacttaattatgaatttgtggcaaattaggggtaggctgctcaaggatccacctactagaggaaaatcacaacctaggtagcaccttttaaataaaaccttttcactaacttggtgctacatacacatgtgtgactgtggatacacacacgcacagtatggacagtcactcaccttccttacatccctgaagctataactgtgccttattactggttgtgttcccagctgtgagcagcagttgtgatgtattcatcagcccggcacagggatgcaccaaccaagaaggcagaaggttagtaaagcaggagaaggacagcacatttcccatgttagttctcaggctgaaacctcatcagagaaccaacacatgctttgataggcaggtctattcttttctcccaagccactatcatttttgtgtattttcctgaaattcctttcttctcgactcaacttgatatgtagttgtatgtttactttatcattctgctgcagtattttctaggagttgatttcatctttttcccccccgagacagagtcttctctgttacccaggctggagagcagtggcgggatctcggctcactgcaacctctgccttctaggttcaagagattctcctgcctcacccttctgagtagctgagattacaggcgcctgccaccatgcctggctaatgtttacatttttagtagagctgggttttcaccatgttagccaggcagatcttgaattcctgacctcatgatacacccgcctcagcctcccaaagtgctgggattacaggcatgagccactgcacctggccaatttcattttttaaaataactttctcttttatgtactggactatattcttttaatattattttataaaccaggtgttaaggtctatgtaaatgtcttagaagtgtcttctgggacatcataatattagcaacaataaaaaagtgaattatgacagtgtgactcagttctctgattataatattaagtgttttgtttgttttctaactttgactctcattttcttgctcattttttgtctttatggcagataatgtacaaagttattcttgttttcttgagcaattactaaatgatcagatacacccagaacgaacatttctaatcacgtgtgcatgatttgtgaagactttattgatttgaagtagcttttcttgtcttttcttaagcacatgccagttccccaagtgtagaaagaatagagtgtagctaatcctgggtcacctccacgggcctgcggtagtcatctgtgtttgcagccaaaggagcacttgaacatgctcagagcaagtcattaaacagttccttgtaatgtagcaatgacaatacacatttattttattttattttattttattttattttattttattttatttatttttttgagatggagtctcgctctgttgccagggctggagtgcagtggcgtgatctcggctcactgcaagctccgcctcccaggatcacgccattctcctgcctcagcctgccgggtagctgggactacaggcgcctgccaccgcgccaggctaattttttgtatttttagtagagacggggtttcaccgtggtcttgatctcctgacctcatgatctgcccgcctcggcctcccaaagtgctgggattacaggtgtgagccactgcgcccggccacaatacaaatttaataatgtggattttccaacatttccaaatctgaaatattttttgaagcactgctaataacttggtgataattcataatgcttacattatctgagcacttcctgtgtcccagatactgctttatgcatgccatttcatcttctcaacaagcatgcaggttctaatattatccccatttaaaggtgagtgaacagtgtggtgaggttaagaaacttgccaaggtcatgctgaggcctcctgcatggctgagcccagtggataatatataacttcttaatgcagcatgtgttttaccccttttattttctaaaggtccccaagggattcctcttggtagactattacagaaaagaattataaaacaataaaacccacctattttacaatttattgcaaagtaaagcagctataggtttctccaaatggaatcttggttttatttcactgagctagcaaatattttgagggttggaacccacccttactgtgtaatttccttgcagaaaatacatgattggtggttgatttcaaacaaaaatcccttaaggacagacatctgtataaacaaatggtgtccctgaaacatctcttcctgtacatggggtcaccaagggctagtggtcgtctcaattaatgtctgattggaaatcgtgcttctactgttgctgtcacacactgactgcttttcttgaaaattgcagtcaaagtgaccatgagaaataacttgcattctccctcctccccaggtatttgtgtgtgtgtgtgtgaacacatgtagtgtgtgagcctcggttttaggcactggcgatatgcacgtaagcaagacagataggctcctggctctctgagcatacatttttggtggaagagttagaccataagcaataattgcgttcacaataaataaaaaaagtattgtccagtggttaagtgctatgcaaagaattcagatgggttcatgtgacagagagtgaacaggggacaactttggattggtttgtgtgtagtggggaaagggacagtggtgtgaattgagaccacagaggtgggtaagggttagcatatgtagggctttgtaagccgggacatgaaacttctatgtctattaggggcattgggaaccctttggagaagcagtggtgggatatgagttatttacgtttccaaattgtcggttatattatcaaggtcaccactgggtcagagaatggattccagggtagctagaggggaagcaggaagaccagcttgaagctctcacagatgatggggtcaggcgtgatggtggcacagactacagggttgttagtgtagaaggagaaaagtggatgggcttgacatatttagaggtagagtctgtggtgctctgatggattgggcattggagagaggggaagataaattaagaatgaattggaagttttggacctcagtaagtgagtggatggtggacaacttactgagacagagaagccctggggaggtataggggttggagggaaacgcaacagttcttctagggcaatgttaactttgagttgaaggctttcatttctcatcgggtctagagagtagacagatacacaagtgtgggctatcgaggaatgattgggaatagagctgtgtatctgggggtcattgacatattggcagtatgtttgaaatccagggcctctgacctaggagatgcctcagacatgtttgggaaggtattggcatctgttgcaaagctcctcataatatttcatttgctatagtagtgctttgatacttcagaagtgatcttaaaagtgacagaaaatctcaaaggtaattctcctcttgagggatttcattcaacatcttagtagcaaaattctccactgttgtatcgtcaaatgccattctggctataggaaataagatcagactcttacaatgaaatatttgatgtgagttcctttcagcacttattttgcctttttttttctcacaatcagcagttcaggctttcattcttctcaaagccaggctctttccagttgagtcttgggaggtgctgggcaaagtaaggcataggttataatgatttttccagttttcttagttatcaaattgctactttctgacattaaaaatttgctgcactgtgttctcactccacactgcacttttaattgttataatttttccccagagaccttgggctagggaaaagtttgtgtttgagaggcctgctgagaatttttgtcaatgtagttcacattttcagtgtcagttccagctgcagtaggcatacttgttgactcattgaatctctgtgaacatttgtgatgtgttgggcgagaggctctttgacctgctgttaataaaatgcagcagttagtgatgcaggccagagagccactcagtgtgtgattccctgcaaggatttttgttaacctcacttgcattgttcacaccttttgtaagaggatcaaacctgtgaagctcaggatgtcaccagagttttatcagtggcttagaagtttgattttctatcaaagagaaatacatttggcctattaatgtaaagcataaggctcacatttctcacagttagtgaaaacaagatttggcactggccattaggattccctgaggcagaagtattctgctgtaaagtagaatatatgactgtctgttgagaagcggtgggttgtgagctcctagaatccatagggaagcctttgtgaaaaggctgcgcatagtttgtactgcacaatgatcaagaacttgtcaaaatagatgagctcaggaataaaacagataactaaggataagtcattttcatccagtggatcatttcattggtaaaatgccattacggaaagtagtttataagtaatccaaaatatctcactttaaaaattcgtgattttttagcacttgtgaatcacctctcaagaaagccatttggaacaagtctagtggggaagcaggtggtcggaagtcagccttctgcgtccacagtggccctcagcctgaattttaaaattatgtgattctccttctctgctgcatggcggtggtaagatatcagctaatacaccctttaatgaatgatgttgagctcactgagggcagtaaaatacaaaggtggaatttgcatcaactgttcaaggtctttaacgctggcttgcaagcagtctgttagacccagagaataaatcccctgcaatattgcttcttcataaaatgattttacagttgatcctggcttgcagatggagtcagtgaaagaaaagtggattccattatactttttaagattaatttttttgcactatttttggaatgagaaacataattcaacatcctctttattggtgataccaataatagtctgataaaaaattcaacaagataacagcaacaaaaacaacactgaaaaatgctttggaagatcagacagaatgacaaatacatttctctttccagccacctaacaaaaaagcctgtgactttattacttggaaaattctgaaaaatgacagatctagagaaagataccctcaatggaaatgtaagaaactagttctcggtcgactgcattccgttagcctttttgtttttatctgtaaagaggagaaaaactttgatactacctacaatttttaaagaaaaagacagtcggttctttcttgcaaattcaacttattttatatataaacagctctctcctcccctttcatgatgcttcttctccggatgctggagatagtttttgggctcagaattctggtctgtatttaggttcgggtcaaagacttcatcctatggacagcagagagtaacaattatagctgaaaattcccaatttaaatgcgttgcccaggttgaagaattattcaggagcagcaccctataacatctgcattgaagggtgagaccaactgtgttaatgatggtgtatgacagcttcttataagccaaggagggggcaaggtggcatctgtgccaaaggttaagaaagcattcttgaacatgcagttttatttgtactggatcttttccaagttcctctttcactggatgttttatcttagtaattgcagaacgagaattttctgctgattccttctttttggcaacttaagggatagactgtaatttggttatcgttaaactaaactgtgctaaaagatgacataaaccatctaaaaagtctaacattagatagagataatatttgcaattcctgcaataggcataaggttggtatttctaatatacaaagagctcttacaaattgatgagaaaaattcaagcagcccataagaaaattgaaaaatatatgaataggtagttcacataagagcaaatcctcatgtccagtaagtagatgaaacaatgttctatccattgctcttaggataattcaaatgagatatcattcttctgactggccaaaaagagagagagaaaaaagataacacccatgacaggtaaggatgctgattaaaggggactttcacccatgactgatggaaacatgaattacttacatattttggaaaagtggtttgataatcctaattaaaaatatacaaactatttcacccagtattacaacccctgggaatatgtactatacaaagaaaaacacccgtatataatatatgagggcatatatattgtaaaaataaaaataccagcatacatatataagggcatgtatagtgaatgtttatagaagcttttttactgcttcctttcctctctcccaaaaattgatctcacatattgaatgtgtaccaatcaagtatagattatatgtcagttatgttgtaagaatgtctcagatgtgattaaagattaattttaatcatacctggttaacttggagagattttatgatattatgagaaaatctcaaattataaagtaaaatgacctccatcccccatgtctgaatacctgtatttgtatgttattgcagaaacatggaggaagatacagaaggcagtacactagactgttcacactgattatgtgggtaggggaagaaataagttcaaagaaatggccctgaaataggcagtgagcttgcaaaagtatgaagattttggaaatgtggccatgaattcttttttgtttgtttgttttgagacaaagtctcgctctgtcacccaggctggagtgcagtggcgcgatctcgactcactgtaacctacccctccggggttcaagcgattctcctgcctcagcttcccaagtagctgggactacaggtgcacgccaccatgcctggctaattttttatatatttttagtagagacggggtttcaccatattggccaggctagtctcgaactcctgaccttgtgacctacctgattccacctcccaaagtgttggggtcgcaggcatgagccaccatgcctggcggggccatgaattctaaccctgttgttctggacatagcagaggcctggtgacaagtaagactgtcagagagccttcctattgtctaaagggctcaaaatactcttacaagggatataggccatctcccagcccccagtcattgcttccttatgttaggaatcatgtttctgacaacattcattcttctttgaaagttcccgtcttaaaataccagcagtcagcagcagtggattagaaatccttaagtctgcccttaggtatttgatgtaaggtatttaatatttccccttctctccagcataggagtaaccctgtgcaagtcaaaaaggctccctgtgtctcattttcctcttctatgagtgcaactaccataattcttttgtgcattacaggtagtgacaaatactataattaaggtaaattataatggtaaatgcctaactttttattccaggggtgttgcataaacaaagatggaatgtaatacagcccactagcaccactctgttggcaaatgctgctgctatcacttaaaagcaggggcttccatgagttttagcagtctctgtggtacattttttgaagcacccctgggcattgcacatcgttcatgatggagcgctccatcatgtgtgcaagttaccagtggagaaatgaaatagttcagcccgggaacaaaggcccttatgttatttgaactccatctggaaccaatatggccaccgaggggcccaacagtacacatcctgaaaccagtggtttggctgcagatgtgctaatagagcttttgggatgtacatcaaagagtatctactctagacataacttttctctgtgtgacaccacagaaaaacaaaagttgttcttaatttgcccttctgaaacttcacttgtttttgttggttattcgttgtgttgatttaatttgagctttgccatatcttgtcatacaatgattcttgagaaaaaaatggaatgctcccagatgataaacaggagttatttgggtgtcatttataaaatgttaaatctgccatgtacttgtgtgtgcatgcatgccctaggaaacataaagccccctattttatctcatgaccttatcagggcccacctgtgactccttaggtttgcacacaatcagaagaggttgaccagatgtgtgcatgtttaaaacctgtacttaggagatgtaatcagcatcctcgaccatcgttgcctcatcctctttcatcctgagctcagagatgcagttttgcctcactgaccatgaccattgaacatgactttgcactgcccttcctctatctttccccttcctttctaagtgaggcacacactctggccaaaacattttctatagacatctacagaacactccacccaacaaccgcagaatatacatttttctcatctgcacacagactgtcttctaagatcgaccacatgcttggtcacaaagcaagcctcaataaattcaaaaacctggaaatcataccaaggacactctcacaccacagtgcaataaaaatagaaattaatgccaagatctctcaaaactatacaaacacatggaaattgaacaacttactcctgaataactcctaggtgaacacagaaattaaggcagaaataaaaaaaaaatgcttgaaatcaatgaatacgaggacacaacttaccaaaatctctgggatgcagccaaagcagtgttaagaggaaagcatgtagccccaagacactttcatcaagaagttagaaaggtttagaaaggtttcaaattaacaatctaactttgtacctaaaggaactaggaaagaacacatcaacctgaaagctagcggaagaaaataaatgactaaaattggagatttatttgtcctttactttgtcctaaatggttaggatgcctattacctgcctgagcccttcttagcaccaacagatgtctctggatacattctatctgtctcattactggtcctcatcagcaccaggagtatatgtagtacaatttgattactctccggggtataaatacatatatgtcagagttcctgttcctaaagagcttatggtttagtgcgccgtcagtatttgtgaactgtggagggcagttgtcagatgtagagggtgaagaacactcctattgcagggcaggaatttccagcaaatggcaagcctttgattaccatcatgggagggggctgaggattacagctggaaccaaatgctgatgctactgaggcaaataactttgaaaatgtagtatttgcctttattttgctctgctttgcatataggaagtgttatggactgaatgtttgtgtcccctcaaaatgcatatgttgaaatcctaacacccagtttgatagtattataaggtggacctttgagaggtgattaggttgtaagagtggagcactcatgatgggatcagtgcttttataagaagagacactgggccaggcacagtggctcatgcctgtaatcccagcactttgggaggccaaggcgggtggatcacgaggtcaggagatcgagaccatcttggctaacacggtgaaaccccatctctactaaaaatacaaaaaattagccgggcatggtagcgggcacctgtagtcccagctactcgggaggctgaggcaggagaatggcgtgaacccgggaggcggaggttgcagtgagccgagatcacgccactgcaatccagcctgggcgacagagcgagactccatctcgaaaaaaaaaaaaaaagaagagacactggagaacttgctcctgtgctctgctctgccatgtgaggatacaaaaggtgacaccacctccaaaccaggaaaggagctccctcagacatggcatctgctggcactgtgatcttgagctttccagccttctaaacagagggaaatacatttctcttgttcaagccacttggtgtatggtaatttattatagtagtccaaactgactctggcaggaaagatgtaataaatgtaaaaatgaagttgttaagtagagaggctgataggcaagggatgtgctgatcggaggatttgtggtgataaagacaaggcacagaagtaacggggcgaatgtctcaagagcaaagaatgtgattatggaatcaggtgaattgaaccttcatgatcattcttgttccttgtaactttgagaactaccagaagtaatagaagtaatcactgggtcctgcattgcaaatataggaggtgctaaggagtaactgaggactggtctattcactatcaaaagatatggatagttgaaagaaaaatgtacaaattgggatcccacttaaggcttaaaaattcagatttatgtgagaaattttagaaaagttagtaaagtggataatgtgcacacgtaaatatggtaactatattctatgtataaaatccagtgggatcacatatttaattagaggttacagcttataatactaaaaaaatcctttggaaaacaattgtctgtgaattgtgtacaactggttttatttattctagtaaaacttcttatgggcaaaatgtaaaagcagcagcatcttaaaataatacaggagagaattcaaatggttgctataaatggcctctcttatttttctgcatggcagaataaagagaaaatctgtgtaggatataaaagaaaattagaaagctgttcaatgagtgtaccaggctccctattttagcagctgagaaacatttcagtggtaagagattctggtcttaccaatttcttttctacttacagaacataatgctacctaaattccatctctctttttttcagtgtaaagcagagtttttcaaccttggcactattgacaatttgcaccggataatcccttcttgtcagtgagggtagcacattataggaaatttatcagcatcactggcctctattgacagatacccgtagtatcccctcactgtggtaaccagaattgtccccaggtattgccaaatgttcctgaggaggggaagtaaaattgcccctggttttgaactcctgctttgaaggtctcttactaaattaaaagcaggggcaaattcataaagacattgtgtgtatttatgtagccataaatctgtgaagtccaggtcttgaacttgatacactataactttcatgttgcctttgacaacattcctgaccttacaccaactgcttgtacccagtttgcaggtgagaggctctggggtaggggcgaggtaggcatgccctgactaccctggttacctggctctgcccttccgcaccaccccaccagaggctcacctccacctggatctaattgctgggaagtgtgggacctgccctttgatgggcgatggctttggggttcattctgtggataccagtgatcagaaacgggttagagtggacagtccactcccccagtgaccctctatcttccctgacctcccacctctccaattctcaactttttctcctcatttatgtactaatgagttttagggtaaaaggatggagcacataaaatccaatttcttgagtaaaggttgggggaattgagagtcagtttatctagaagggttttgagagggaattcctcatctgatgacccactgccataattttttaccaatatctctctaaatagcatagggtttagtgtaaaatgtatacttggaacaacaagtagaaagtcttctctttttgtggttacccctgaaacacagagtttattgagctgagtgagtgcgactttaaagctgcctttgaaaggacaatttattttattttattttttggctgctcagctttctcaactatgtcccaaataagaaagttgtccaacaatggaagatttcacagtctgcatctttcagctacatcagagatctgatgccagctctagcactgcagaacattatatgaatttgggaaactctttgaaatagagtgaggccataaaccagtgagtgaattacaacggtgcagacagtaatcattttgatttgataggtgttcagcagggcttctattacatatattttccattttatttaaaggaaaattgcatgtaatttgcttagaccaaccatctggaagtactttttttctctttattgccttttgatacttcgccagttgaaagaaaaaaaataggttgagaaaattataaaaatactgattttgatgcaattgatgttaatggaaaagataatttttcatctttcattacatgcagaattaaattaaattcccctaagcattctttgataattatttatgctctggtgtgtgcgacaaagcatttagattcctgtccctcctcgtgctatcattttacgtccccaaggccccaacacatcttacatgtgtctgtgttcaatgatcatagcagctttattagataggagaactccatcttaaaatccagcaaccccagatgctgagcagttcccaggaatggtacaaagcttcttctaaattggccaaaggctttttcctttctggaatgaaactttgtttaagaaagcagtatttctggaaagctgcatcttaaaataactattcataagaagcacttggtaatagctgacttactgaaaaatgcaactttttgattaatttgagtcaaatgtctgtatgcttcaatatccattctgtctcatggtgactagatctttcctttgtgtcaagtagattgatctttgggaggcaatgaatcacaaaataattgagacccatctatgaaatgacataatatttttagagcagtcgcctatgaaagggagtgatatttatagcggacatgctatatgcaggcactgtcctaggtgttttacatatgttgtttcaatcagtcatcttgtgaaccctacaaggtaacgggctcttggtcccatttaacagataaagctgagacacagaaatatgtcactttcccagggtagagtcatgaagctgggattcattcccatttttgccaactcaaaagcccatggtgtgatactaggtaaaatgactaatgcttttcttctcttacttgtgaatgatacctatggttgatattttcttctaatgaatagatctggtaggttctgctaatgttttgggtgagtttcttgttgcatttgcatgaagatttctagtaaaggtcattgccaatgttttcatattatgactggtagaaagcagaagcgtcagtcttgccaatgatgcctaaacgtttgaaagtgaacctatttccatctatttatgcaggatccataatcagaccactggatgtagatctgtgtcatcaaatctgatctttgtccaaagatcaaatggacatctttttattttatgctcatttagtgagactgtattgcataggcatcagtaggaagagctagaggaaaactgtcatcttcgatgaaagtaatttttccttatagttgaatcgctagatcttaaatgcagccaagtagttttccatgtcttatgcttcatttattgtaaatgaaattaatgttgtttaatggtatcctttaaagcctcaaatattaaaatgaaatatgatgattataataacgtctgtttatacatgttatatgtgttatttgtaaaataattacataatagattttcatttcaccaagacaaaagggttgggtatccttttggctctcacttgttagtcaagaaagacagtagatgataattatgaatcagatcctcccagattgaaaaaaagttaggaaatgttctgttccagcttctctgatgagttttatttactttatagagattttatatacctattttgatacatgcctggcttgtgttcagtgaaattcattgaaaggaccagcgataaactttataaatgctaggctttgagggaaactcaaaatacaggaatgtttcagaaacatgtacattattatggctctgtaatctgacttttgttgagcatatggagcttttgttgtctatgtataacaaaaacattgtcacataatatctgctaccacttgtcttccctatcctgtaactgtggatactcaacagggtaaacatacacagaaacttattaatttatgcaatgatttcaagcattcattcttaccctctcttctaaatctgtcttcttctacgcccttttagcccccagcaggccttatcattcttttcaattaatactattttaaggcgtaaggtctttcgttatgaagtcttgctggaatataccagaaggctttgcccaatatgccagtgtataacagcccgtttatgtgactcctagctccatcttgctcaatactctgtacatgccattgaagccttggatgctctttgcctaaactttcaaaatctttccaaaggctcagaatccaggtgtgttatttctgattcttctccttctaacatctttatttctgattaatgccatatatatctagtgtagatggttacgtttgctgtcataagtggcctgtgtttaagtaacgcccattctcctgtaaaccattcccatgacaatttgagaaatgtttttggccactgtcctgtcactggataattttatttccagttttcctgaggacctgcccaccttccccaatgtctccttcactcttgactgctaggagcccaatgcctggccacctgactttgtacccatagctaggagtaaggattttgttttgtctcctgccaatacttgttatgcatacatttcactggatgggaaatatggaatggtacacattatgaacgaaacaccagagattgttaatggatggtacaggaatgctttgccatggtaatgaagtatctttatacaagaaaatgcaggatgagcatctctaatctaaaaaactaaagtccaaagtgatccaaaatctaaaacattttcgagtgccaagatgataccacaggtggaaaattctacacctgatctcatttgatggattgtagtcaaaatgctgtcaaaacattgtttcatgcataaaattattaaacatattgtataaatcaccttcaggctatgcgtataaggtgtatttaaacataaagagatttcaagattagacttgggttctatccccacgataacttgttatgtatatgccaatatcccaaaatccaaaaaaaaaaaaaaaaaatgcaaaatctgaatccgttctggccccaagcatttcagataagagattcttagcctgtaataacaagggggactgttccatgtgaaaaaaaaaaaaaaaaagcaatgaagtagtagaggaataacaataaaacagtttataatttactttatatacagtcctgatctgagagtttaaagaatattgtaggtcaatcaaggaaatcattccaaagatcttcatgcatagtctattgggtataggataatctaataagtggtagactacattttgtttttatacaattaattttcgaggacttaattaggacaagcagaagggggaggtagaaaggaaagggtattctgtaacccatgataagactgatttttctacctatgttttactgagacggggaatcaccttcctggaggagactgaacgttcatttcggggaacactttgcatggatttagctaagaccttctatgtcattctaaacaaatgccctagtcctgacagtcacaatatcatttacccttaactagccttagtttatcctcctataggtgatgagtggtgatattttataatcatgatgggatacttaatgtgagtttttatgttttgtggatacaagattaatttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccacccgcctcggcctcccaaagtgctgggattacaggcgtgagccaccgcgcccggccaagattaatttttattttctcctttcatcccttcctcattggtaactcatgagcacagctgagttcatgggactgaggacgagccatccttctggcagtgggtgagacctggtaatgatgggactggactatcagtctacaaatgacaggagggaagtgctcagcctcttctagttgggcactgtatagggaggctcaggtgtgcttctatgggtgcgcaactaacaacacacttttgcttccacttcaggcagcatgcacgttgcttgcgtgtgggctgagacacatagcctctgatgaggctcagttcagagggcacccactgtgcagataaggaacagagtacacatggaaaactcacttcctatttgtctacttgagcccagtggctgagctaaatgatgtccaattaagaagacttactaaactctggagcctctacagataaccagtggcatagcaaagaacatgctaaagacgtgtcacttgatttctattaggcagcatctgaccctgtttcttttgcctggggtaggtccactagcttagtatgtgtggaagttgacagcaatttttggagtggtgctataatctattttatttaggttacacagtatacatagtttttcaaattatcacaagatgaaatgagaaatgcctttatttaaaaaaaaaaaaaagtccagatggaaattgtcatttgctataactcaagaataaatatagtaagtagatagagaacgctctgttatggaaatgtaggcggcttgaatgtcttttttttttttcctgcttttattctttaaaatttttttttgtttttcatttcttctaaaaaaagtggggtacatattcagaatgtgcaggtttgttgcacagatatacgtgggccatggtgttttgctgcacctattgacccgctctctaagattcctcccctcacccccacctcctaaaaggcccaggtgtgtgatgctcgcctctctgtgtccacgtgttctcaatgttcaactaccacttataagtgagaacatgcagtgtttggttttctgttcctgtgtttgtttgctgaggaagatggcttccagctttatccttgtccctgaggaatgtattttttctttacctgaagattgttgtatttacttatttatatctgtgaaaagagtagcctgaatgctttgctagattaaagacacgtgaaatgaaaatcccaatcctgcggagattgactgttgaatgcccagggaagtcacgcagtaaaacagccccaggaaaatggaacaaaatgctttcaaaaggtgaattaagaaaggaaataactatttggagcatggtaatgagaatgacaatttattagtcatacatactgtattttaaataagatcttagtatccatttctggagtgcattgttatatttaatttttactttcttaatagacctacatgatcatatgatttttttcccagttattataggtataggtgaatgcttatctgttatgtatactctttctttaatttaataaaaacaaattacaggtactgagaaataaaacttttgtgttaacttttaattgtctctaaaaaaagaaattctcatggtaaaacagaagctaaaagagattttttcccatcaaattatttttataggtattttcatagaagatacataaaattttttatcagggttccattgtgcctggatagaaaaaaccctcagtaaaagatttacttaatatgaaaccagagaacggtgggggtgggggcattgttatgtgtttgttaaaaccacagagttttccaaagtcgttttctttacctggagactttgatttgggtatctgcatgaatgatcaccagaaagcaccccgcggacaacacagccccccgatctaatgcctcgtgtctgacgagctctcgctctgtggccaggttcatttaatcattctcaacacctcctcagagagagaagtgtaattttgcacaggagaaacttagtcatggaaaggcttaagatggtctgaaggtcagccagtaaatcagttacagagaaggagaaacagctgaggagcctccagcacacgcaggtaaaggtcccctcacaggtgtgggtcgggagggggagcccagggctgggggcatgcaccagatcacaggtggatgtacagagagaggtggagttttggttctggcttggccatgaactcagcctaccagatgagtacaatttttgttacatggtttctctgttgctaactggccagtaacttagtggcccagggttgcctgagaagggctttggactccttagatgagaggtaaagcctgaatcccaaattgcactgtgcgatattagactctgaagatttagcaagaggcgtgtttgggtgaatgattatcttttgtcttttctagtgaatcattttcatgtgtcatcaaccatgtttcttacctggtagatatgaaactgcacctttctgtagaaaatctatttaatgattagccagggggccaagggataattgaaaatcatccagttggcatcgggactccagggttttagtttcaactctgctgccaactaattcagtgttacttgggtaaacgactaccctttctcaggtcttagtttccatgtctgtgaaaaacaaatatttgccgtaaaaacagtgatgtctaaactgtgtttaaaatgggcccaaattttcttcaacgtgctctcagaggagagggaggctgggcttgaggctcttaaaaataggattctgttgttagaaaaatctctggctatctcttagactctatgacatttaaaaaaaaaataactaaaaatttgttttgaaattgttttcagtgtagagtagctacacattggagtggttcagagatcatggtgagactgctgcctggattcaaattttagttctgtgaacttgtgcacctttcttgatgtccctttgcctcagtttcttcatatgaaaaatgaggataataatagtaaccgttgtgttgtgctgttatgaggataaatcaactgataatataaaatacttagtaccatgcctgcacctactaagcacgatgtaggagttaaatcaatagatgccaatccactggaaagcttgtttcatatcatggagggaatttctgtaatttgtgagcaattcagtatttactgcatatccactgtgcttcaagtttgacttaataagttggtaacctaagaatttgtgtggagaggacatcccagatcaagataatgacttcagaaagttctggaattgtaaaagtgcaggaagtagaaaagtctagtggagttaagaagtgtgagctggagtgccttagtggattatgttcaaggagaagtttgattgtgctggagcccaatgcagggttatagtattccgtgctgtggagagtgagacttctagctagctgtagtggtggtggtggtgatggtggtggtggtaacagtggtgttggtgattgtggtggtggtggtggtgataatgatgttgaagatggtggtgaaaatggtggtggtgatggtagtgttggtgatgattgtggtagtgattgtggtgtggtgtggtggtagtggtgatggtcatagtgatggtaatgatggtggtagttgtggtgttggtagtgatggtgatgatggcagtagtagtgatggtggcaatagtggtaaaagtcatagtggtggtgttgacaatgatgatggtggtcatggtagtggtattggtggtgatggtggtagagatggtgatgatggtgatggtgatggtggtaaggcaggactacagactcttctttttcctaaagtgacttttgcgctaggtactcaccatccagagcttaaaggaatctggcaggccactgcatcaactgataaggaatggcttagttgacctagcagcatgagggtaagagatggggagggtagctggggactgaggaagattttattctttattgctgatccctgtgaaggtatagcccctcttccacaggtgaacacttggctggtaattctgttgtcattagcaaagcaaagcaaatgcagccaggtagcttatgggaccaaaatacacttcccttggaggtttgtggttcctgcttaagttttagaaatgtgttaaatgagggctaaatttcaatgttcacttcatttaccaaactgtgctgtccttattactgtggtaacagaagcctgtttttctggtatccattatataactgatttttgaaacccatgtttcattgtgctgaaattgtgttgtactaattcaggatacagttttgattactatgcgtagcactttctgtaagatcgtattagcacagtaagtagagaagaaaatcaaaatatggaaaataaaatcacgatattctctctttatgtttagtctacttgttacatactctttttgtagattgtatctttgtatacagcagtggtcctcaatggaagggagagcaattctgccttctcctcctctgcaaggggacatttgtcaatatttagaaacatcactaagattgtcaagactgtttcttgtgctacagacatctcatgaaaagcagcaggcaataccgctaagcatccttcaatgcacaggacagatccacaataaacatgtatcctgtccaaaatgacagtcacgctgaagctaaggaactctggaatagtgtttattctctgagaaatttgatacagtaccttcctcattctagaatctcttaattttccattttccaaattccatggtaataactgtctaacttttactgaaagacctgtttgaaatctatctactacaggacacctacttgcattgggctaatttcatttaatatcatttccgtacattctcttcacgtaaacatttcacatttgtgttaaacttacagatgttttatgattttaaatctgatattttatcagttattatacattaacctatatatgtttcttcttttctaatttggatttgagttacttaatacctgttaaaatttctttgaataatttttaaaatgtccagtgccatccatacttgacatatccaataaatatttaaggcttaaattttatatttgatgcatttatacaaatcaaaatattttcttgatatttataactccttttattaaagataaaatcagtgttgctggttttttcccaaagcagaaatttattcaattctcactggaattgagtactgacatgagggcagtttgttttatgtttgagaaaataattctagttttctacttttctaggactaattattgtaatttttaataaatctaggctgggatctttatgtgactattcccactggccagccttttagaagcctgtgttatcttttctttatttcacacattataaattagtatcgctgcctctgctggacttagcagtaagtaagtcattgccactgggaaaatgtttgtgtttggacaaatactgctcttgtgcatgcggagtcctctgagacagagctagtttgttgttgtcattttaaccatgttcgctttattttgcttctaacaaattcttcctccatgtctacttctctgactacgtaaggcagaagacctgtagtaccatcatcattcatggtaaattggaaacccaagtttcttttattcctgttgggtaaagacaggtcccagatattcatcatcttgttgtttctgctggcctgtgagtccttttctttgctggccacttgtgaccttatatgatgcacctgtctgcatctgctcaccgtggatgagttggtgacctctgttacagacatcgtttacctgcatatgccttctatatggccaattcaatgatggagtaataagtgatatggaagagaatccagcatattcgaagtccctccatttaaaagggcatggagattaattcatgattattggccattagctgtgcacccagcattctggccaccttttgtacgtattagctcattcactccttgcaaatgccccaagagacagggggctgtgagtatccttatttacccacagagaaacagcacctcatggggctgaagttactttgccaagacttttctgtaattgactcagctctgttcaggtttgagtctagtattctcactttctctctccttcagaatcccattggctttgattatacatcattcagttcaatgagactgaatgaagctgacacaggctcagaagaaatgttgtcctggggctttggactttagacattgcttaaaattaagaaaggtgctgccttttgaatggaaagtttagactaagttagaattcatggctactggatgataggaacaatttttccagagtacatatgtctgtccaaatggtgagattcctggggaattttgaatctctggggagtctgtttttctgtgaagttatttctaatgttattcccatcctcaggaagggcagaaatgctgtaacatgtgggtgttttcaacaacctattttgtttcttgtttcttgatgtgcacacggtctcagaaaacgttcctggagttagctgtttgggcttgttgtttcatgatggggtaaaataatgaatatcttgcttaacattctgtaactctagaatttgcttccaaaccacatagcttcccattaaactgggtgagagaacatactctggagagctggttaccttatattcgccctttctttggttggctggataatccatcctggaatctaatacttttcaaaaggagggcataacttgttggtttctggttgtaatggcagtatcctttttacatgaattaacctttggaggtcacctgagacagtccacctggaaggtcttagtatttgtttattcactagtggctgcattctttctgtgatctcaataactagctatcagaagttagtctaatcagagtttttacccttaacaaggggaaattgccttcaaattatttgtgtacaacgggacactggaatggtctttcataagataaacctcctaatcactcagtattgcaaatacacatttttaaacaatttgattaagtaagaaacctagtgatacagcattagagacttgagctgtgttaacaagtttataaatgatttagccttcgcagaaagatttattactggtattagaagattatgggcacccaggctgcgatatgggtgctatttttctctttaacatatatatagtggaggttgttatttgaaaccacttgactttatgactttgattagaaaaaatcattgatgtcttcttaatctaacttcatggcaggcagctaatgaaaacgcgtatcaccatggttctgggaaatatgacagctgtagatttcataggtgggaaaatgaacagagaaatcatatgtaattcttttaaaacctattcacaggccaggcatggtggctcacgcctgtaatcccagcactttgagaggctgaggtaggcagatcacctgaggtcaggagttcaagaccagcctagccaacatggtgaaaccgcatctctactaaaaatacaaaattagcctggcatggtggcatgcatctgtaatccccgctactggggagactgaggcgggagaattgcttgaactggggaggcagagtttgcagtgagccaagatcatgccactgtactccagcctgggcaacagagcgagacttcatctcaaaaaacaaacaaacagacaaacaaacaaacaaactgattcacagtaggaggctgggtgaggcttagaacttggatgtaaacactctatatccagacctttgccatgtttctgactggctgtagtggcagaagaggagagctgtctgtgaacagttactgtttcccttttctctcgttccctcctattttaataagttctttgcttctaagccttaagcctctgtggactgtcaaggagcattcagcaaagaggattggctcatttttcagcagagcatgagatggcttaaaattgggggttccaattttcattataatgtggcagcaggtatgtgttaatcattgtatgctagtcagtgtgagatgatgcatggagggtattcaatattacaatccttatagcaacccacaaggaaagtacaattaatatgctagtgttgtaacgagcagctgaatgttagtgaggtgaaataactcgcccaaagtcacccagccagcaaggggcagtacagagacttaaactcgggtgcctagtggaggagctgggcttcctaatctttccttgtgcttcctcatttgtcttacaaacattgcctgtgtctctgcaatgtttcagacctaagctcgattgtgataaaaatgtgtactgtactaaaagagtgtctttgcttacggtctggtttgtattggggagttaaattcataaacagttatatcactttgtaagtgaaataataaggggtatatacaatgagtttgaatgcaaattggaaggaataattcattcgaatgggccatgacagagggtaattaacacagcttttgtggatgcatttgtagtggatcttcataaaatgggagaagatagaaaattgtagtttggagatggcatttggagcataaagagcaaggggcatgtaggcatgaaaatgctggtgtcaagggtgctgaattgttggtgcaaagaggaccatgaggcaggaagaggaatttggagtgagtttgtgttgcatcttgctggccatgttcaggggctgtcataagaccaagtccagaagttcctgatagatgggtttaagccatgttgaggatacatgagagaaaaaggagaacagagccaggaatgattcaaccaggatactggctggggcaaggtgagaagggcattcaacagataacatcttgtggacccttaatacagttctgatggtgtattgggaacattaaaagcaggatgagattattgggtcttcaaacccttgacaagtagacggtaccagtagattatttcacctcactaacattcaaaaccccaaaaccttgatgagtagatggtaccagtagatcatttcacctcactaacattcaaaaccccaaaaccttgacaggtagatggtaccagtagatcatttcacctcactaacactcaaaaccccaaaaccttgacaggtagatggtacttcttagaagaagaaaaaagagaattaccgaagattagtaactctttcaaagtcacaaagctggaaagtggggcatatttcaaactcacatctgtgtgattccagaaagagctcaaagggcctatagaatagtcacatttgcatggaggaatcatagataaagtcatagcatctcttgtgaaattggtggtgaggttgagacactccacttttgcaagagccagagaggtgatgaaagagcagataagctgccaaaatcctttattgctctgtgattgtgtgtttatagcagaacttactagtccctggccgtgacttgcatctccttgttaattgtagtaattacatgaatgttctgtggatcctcctttatagattgacattaagagagatagatgggccaaagaagtatggtttagacatctgagtccagcatgtagtgtgtacatgtatagagttaattgtagtgaacatgtggttacagcaaataaggacacaattttctatgttgtagaccagtggagacaagtgtgtagcaacacatacacggggccttattcgactggtacaaacttgtgtttgatttattagagcatgctgaagacagtgtgctgaccttctcagagatattgatatggagggaatggtgacagttgggagcagaagcagctgcttattaggactgtgttgagcttaactagcaaccccaggctgattctcatctttaaattttttaaggaaaactcctataggacaaaaacattgcccagaaaatccccataggatgagagtcttgcctagtggtcaaggcattaatttatggaaagatgcttgctaacgatttatagaactgtgattttggggaacataactattttgtgatctgaaatcctgttttgacagcacgtcccacattatattcctgtgctttggcaatggtggaatgagggtgattcttttaggagctgagaagaggaccacacggggatgctgagtcattgtaattgcacaggtgtcataagattgaggcctcacattacgaggtggcacatatggcctttgggatagttctgagattctagaaggacatgtttaataattaagggtggacaccatgggaaacattgtctttggctgacatatggcactagaccctttgtcttcactgaaacttaacacactgtacagtaaaatatgcaagcacttgtgatacatagtggaagaaataggtccaggcagtgtggcgcgacttttatggatactgctcatccaccttcatgctcactgggtcttccagcttgctcttctctttgggaatgaccagtactgaaaaagttttctttagctatttgccttaattgcttgaacagtggaaaaaaaattctgggaaaagaatggaaatttttaataaacaagttggagtgaagaaatgtgtacctagtctctcagggttgtctaagggtacacaaaagcatgcattttggagaggagagtgagttcctgaggtcagacactggtctccaccaacacaagcattaaataaatcatggaaataagtcatataaatcatgaagtaatttataattctaggtaatgtaaattataataaattataattgtatataatgtaacgtatttaaagtaattgtagagttgatttcttcatgaatattaacagggcaatgagctatctggagagctggtgcatttcagtaaaaaatgttttgggaggccgaggcgggcggatcacgaggtcaggagatcgagaccatcccggctaaaatggtgaaaccccgtctctactaaaaatacaaaaaattagccgggcgtagtggcgggcgcctgtagtcccagctacttgggaggctgaggcgggagaatggcgtgaacccgggaggcggagcttgcagtgagccgagatcccgccactgcactccagcctgggcgacagagcgagactccgtctcaaaaaaaaaaaaaaaaaaaaaaatgtacattgtgttcaaactattgaagaagaatgtcaattttacatttttttttagatcttcagattgtttaatttgtctaaattgatcaaattattctgaattgaaaatgataaaaagaatttatttttaatttttattttttaagttatctgagtttaattcttttattttttaaattttactttaagttctgggatacatgtgcagaacgtgcaggcttgttacataggtatacatatgctgtggtggtttgctgcacctatcaacccatcatctaggttttaagccctacatgcattaggtatttgtcttaatgctctccctcacttcgcctccaaccctgcgacaggccctggtgtgtgatgttcccctcgctgtgtccatgtgttctcattgttcaactcccacttatgagtgagaacatgtggtgtttggttttctgttcctgtgttagtttgctgagaatgatggttcacagcttcatagatgttcctgcaaaggatatgaagtcatccttttttatggctgcatagtattccacggtgtatatggctcttttactttgtatgtataccagtatcttatcccccttcaccatctatgtcaagctaatgggaacctagactatggaaagcttcctatataaagagctctctcctttacttttgtgactcccatagtcaccgctatcaccaaacaccactgtggaagcccctcttacccaagactgagaagttcccctcaaggcccctttccgtcatcagccacaccctaatcttctttctctatcaccagcttctgctggaaccatcatcacaagaacctggtagcctggttgctagttggaaattattttttaataacagctttacataagatataaatcacatatcataaaatttacccttttgagatttttcataatttttcatacattcacagagctgtgtaaccaccactgttatctaaatttagaacattctgatgaccccagaaagaacacccgtatccattagcagaaactctccattcttccttccatcaacccctggcaatcactaatctatattctgtctctacggatttgcatattctagatattttatatacatggaatcgtaaaatgtgtggcctattgtgcctgatttctttcacttatcatgttttcaaggcttatagcatgttatagcatccacattatagcatatgtcagcactttattccttttactggctgaataacacttcattgtagcatctaccacattttcttcatctgttctccatgtattagttgatggacattcagatcatttctactttttagactattatcaatagtgctgctatgaatgttcatgtacaagttttatgtgaacagatattttctttctcttagatatagacataggagtgggattgctgggttattgaaattcattttttatagagaggtaactatcttagcactatcttacatttgaaatgaagcacacatttttcaaagttaaaaaatgtggcgttttctttgatgatgatggtacaatatttttgcaaattatcaggatactcaaaacagtcagtctttataccattggtagcacaggcttgcacagtggtttccgattcagacacatgtgaattcaagtcctggcacagccactttctagattgctgataacctggtgctagaaggttcactttgccgaatcatactttattttccagattaaacctaggcctgtgtttctcaaactctcatagttttttccaaagtttttcatgacattagacacagaaaattgaaatatttttgtgggcaaatttggtaaatggaagagacttttcatctgaagggcagaagggcttggtacctgatctacctgaattgcagttcttcagtatcctcagccatgctggtgtcttttctactctactgaggctcttgtctgttaggaaattattttctcaatgtgtttgcagacctggcccttgctataaccttttctgttccaatctgtgagaatcaccattaaccactggagaaaaatattgcacaataagctacgcttttgaagggttatgatctcattgtattttatcttcagtacgatatgtgggggaaactctcaagataaatgaagatgccagctctggtgtttttgaacactttagctccgacttccatttaggaagttatggatgcttgccaccagtgcacttaatttgatctggaatttgatgccacaccagtgtcatattttttctaggcttctggatatcatagtgttttccttgacgtgtgtttttctgttttcatctcagtcagtggtctttggtcattgtgctgcttatgtaaaaaatctaatttaaattcaagttttctactgtggaaaaaaaatacttggccatgttggatttcctgtagagaagttgggcatatcattgcactctattttatttttctctgaagatgatagcgtggatcagctcttcctatcagaagagcaccactcacatgccaagctccagggaatcgtgatcaacatggtgttgtggagttaggatgaggctgtttggatggtgatttgagaatttggtatgagaattctagtcattttaaaaataattaagggctgtctttgacactgtcttccacattcttgatgccatcttcaagcatgaccatgtataacaaatttatggggactggacttattagtaaagctactgcaatcctctggtggtgtgaattagagacagcgcttaagctcccaattcatcttgattcttgtctgcagcatcttcttagcaaaaggatacatgactttttattataataatcatacatgctaatttacattaatcttgcaaaaacaattgccccaaagcattaaaaatgtgcaaagccatatatctcagaatgttctaatgattgggtgtgtttttctccagatgttcattataaccttaaagacctgcattgtcatgtctaaccattattgagtacttgcagtggacctggcactgttctaagtgttttacgttgattaaattattaaatccttacaaaccatatgagaaaggtgctagtattatccccacttgaagatggaagcacagaacacacaaccaggaagtggctgagctggaatttgcaacctggcactgataggtgcagctggttttataaattatagaaatgtatgtttatatttcaatatgaaagtgtttttgtgtgtgcattcacatgagcactcatttatgtgtgcagctgtgtggatgtgtatatgtgggtgtgcaactatgtgtgtgtttgtttatgtgctgtacatagagttgagtttcttgccaatacacttaatattataacttgagcatatttatcttaaaagcaatgtcttgtcttcctgattttattttgtcttctttggtcctattttttttttttgtcttccttgttccatttgtatagaactatttccctcttcctcagtagaagcttccaaacgatgcttgtaacacataataatcagactaggttgaatatatttcagtgtaaatctttgctgacatctatgttaaaaatgtctgtgggatttgtgttaatcaaggatggtgagacagcagaggcagacatgatggtcatgaagaaaaggtttatgctcacagactctgtaaacaggaggctcataatgctacacagggccacgtggggaaggaccagggagggttgggaggcagaagaaaaccgaggcttgcagaggcttgactggggttctctctgtaaggagtgggcaaggcagggtgagtacactaagtttaggatttgagagtttgagtatttttggtgggtgctgggctatgtggtgttccctactgctgtggtagttggctctggggtgctttaggtagggggaacattagcacattgggtgagaatttgataaaggagatggttgagagtgggggctctggcttggctggttggtaggtatgcagaggtatcctctggggtgttgtttgctgtctttacgaatatgctagccctaggagggccagtctctctagaaacaaggctccaaatgccagaggatcaagaatacagaaatcaagaaaatatacccagcacaaaatatctgatgaattcctttggagaatgtcctagaggtgaaaccaactaggcaaagtagataaataatgttaagctcttaggatgtatttgtgtgtgtgtgtgtgtgtgtgtgtgtgtgtgcacgcacgcgcattaaatcaaaagagaccgttctgttaagcagccataccaaccaactgcctcatgtttgtgttttaaaactcacagtcattaaagtactgcctgatcctacaagttgtaaactaacttttttccagacttctcgtgtgggtagcttccttccacaacctgtcatttattgtgatacacggtattagttactaaactaaatagatctgtctgtgtgcccctgcaaggaagtatccttaaactgtgagatttgtgcttgggaaacatctgaccttccagaatgaagtgtttattccttaaagcacagccccatctcctccagtttcatctctgtggttaatgaactgtctcttatgttactgtggtcataatcaaagagaactgcagggattttcttgaacagtaagattaagcagaacatttttcctcctacatatgatgttagagaaggcacatcactttcatctactcactcaaccagaaatgtaatctattgcatacagagaaaaacatgtgtgctactttgcctataacgaattaacaggtgtgttctatttacctagctacgggggccactttgaggaccaaaatgcagtatggccaagtcacagtggaaagtgtcaatgactatgtgcctgagcatttcttcttggtataagcagaaagctttggataacatagtttatctgatgcagctgataaaaccaatttcatttccttaggtacaagtgacttttttccctccaggtaaactgagtctagcaagtaagaggtagcaggttccagttttaggaatggctatcattgacttacaggctacacctgtacgccacacattctgaacataacttttttttggcccaactttacatgagaataacaaagatttcacgttcagtttggagaacacttatggaaagaagacctctgctttatgaaggtttatatcttcacacctcccattctttgaaccagttttttcttttccgtactgcagcaatggttccctccatggttttctgctgtcttatacctggcaagtcaaccctgaactggatctaaatatgtgcattgaagtcctgtctcactggttaacccataaaactaatcttacctccttcctttaaatgtaaatattttgctcattttaaattaccaaattaataaatgcatattgttgaaaatttaatatagaattatatttttaaaaattttcctacgacttaggagtaaccacaattttcttggcacttacaaacattaaaaaaattagtttattttagtcaaacattggagtttttcttctctatttttaatctatagataaataaatgtctgcactttatttttttccactcacatcattattgaatttataaactcagtatatagagttttactacattggcttaataagctgtataatatttaatagtatggatgtgccatactacttataactttggtcttttcaaacaaaaatgcatttgctacctccattcttggtacattctatcttgagactttatttcatttctctgccaaaagtgtggtctctttatttccacttcgttgacatgattcccacacttccaaaacctgcctgctcccccacctcctcccagatcaacctggggcttctttccatgacttgttattgctcggttggttgttatgttcattccataaatattaggtactttctacgtgcaagaaactttggtgggcagtgagtggccacagtaacaagcaggccaggctctggtcttgtggctttagtgtacagcagggacaccgtatcccacatcacaggaagccagactccacggcagggcgtgctgagggccatggaggcaatggtgtgtcctgagcacgcttcctggaggcttccttgcttctcacatggtaaatggttaccactcttgggggagctggtgtttgatttggacctcagagaatggataaggttctaaaatggacatgggggagtgtgttccaggcagaagggtggaagtgggaaagtgtggggcctaagaaggactgtgggtgacctcattccactgggggcttgatcctggggaatacctctgttgttcataccacacttattcatattcacagtagcactactgtgaagcttccttttacttttccttgcacatttacttttatcgaattcaaaatattgtttaattgtgcttgtttttttattggcggtaaatattgatttactatattattcttttttctctcaacgttcttatttctaatatttactttgcatatagctgttgtccatccattttcactgtgatataagagaccatgaatatttgcattctctcaatggacacctgtattatttctaattttttgctattatgaacaatgctgctatgagcattcttttatagatttcttgggcagatgttgaattttcctaaggctaaggcagcacattctcactgttcttattaaacactgaactggttttattgtctttttttaggaagacactaatttgtttgttagacgtgtctttcctacaagatttataaagcatttttctttttattaaatagcctttatttgtttataattgtcaaaattttttagtgcttcgtaattgccagtaagtggtctaagttctttcaaattaactcatataattttaagctatggtttttatctccatattacagggcatgggaactgaagcataaggttaatggtggagcgaagatttgaacccaggtgatctggatccagagtctgtgctcctagtatctatgcaaggctgcctctcctaaactagcattggaggcagggtggatcactggtactttgtaggctgaggaacaccgtagatggttctcactcttttggactgaaaaaggagacagtcaggcatccagcaacagtatttaaccccttcagtatttaggagctacttaccaaatggatgcaatctgtcattcacttttctggctttatatttaggatgggatcatttttgtattttcattaacatatttcccatcacataggttttaatattttgaaatacagaagtgaacacacttgggggttacttttccaccatggagacctttattgtaatgtcctccatgacctctccacatttcaggctaatgaactgaaggatgagataccgtatgttcacagcatgtgagattttatagcatcgcatatgtgctaatcattagatgctttaggggaagctaattctgtactgactttgtattcctaagtttcacctaataggctgactgtgaactaacttgtacttttccatagcagtgctcctgaaacttgccgtaagcactgctcaatggctaaaataaagtggatgattcattgcctttatttagtagaaggtatcttggccttcatagtgagtttatccatcacttggaaaatgactatcttggtttctggcctttccactgcctagtcaatcagttgataatatttatatgggtcatactgtgtcctaggccctggggatagcaagagaacaaaataaaatctgtcctccagttacttgtattccagtgtgttaaacaggactcacacaaggacatcaactgactatcataatctaagtcctgttattcctcccacacaagcatacatatccaatatcactgaaatgactgaggacaaaggcctctggaaactattttgctgtcattgagctcgccaatatattttattctgtcccattactgaagcttccccccctcaatttaccttctttgaaggtactgaatatacctgtatcttatgaaatatttttatttatttatgtatttacttgtatatacctaagatgtacaacatgttattttgatatacatacagcacattaaaaggagaagctgtgaaaattatagatcctttaaatcaatttcatataataggatgtaaaaaaattcccaaactcaaaaatgtatcagtcaagcaattttaagtagttttaagtgatgtgaagaagataaaataataatggaatctaatagtggagtaaaagggaggtactttagcctgcctggccagggaggctttcctgtagaggtgacattttagtaaaacctgaatagtgagaagggaccttgggagaatgtagaaaaagatctaggatctaagggccagcaagcgccatctgcaaggtgatgagcttggtgggtttcaagaccagaaagcagttccatgcacacgcgtgcatgtgcatatgtgtgtgtgcatgtgtgtggcgggagcacagggaacaggaaggctggagatcatgtagaaatagggaggtggccatggaggagggtttgttggtggggtcaggatcttgcattttagggaggttgcaaagagatctattggaaatttttgaacagggaaaaattacttaatcagatgagctctttacaaagatttatctggatgcaacacagaaaatggacttttgaggggcatgaatgaaaaacaccaaggcacattagaatagcttctgctaaatccaggtgagagaggaaggtgcttgaggtgggattgcagtagcagatgggagagaaggggacaggggtgcggtatacattttttgaggaagtagtgacgggatttgcttatggtttagagtgttgtgtgggggaattagagcaatccaaaatgactccagctgtgatggcgaagactcagccaggaagtagactggggaagggggaccaccagtggtttgcttgatcctggttagttgggaggcaattctttgtctcaggtagagatgaagaggcagatgaagttgcagtttcaggcacaggttgaaggtgatatgtacacttatattcaccagccgataaatgttatttaagtcatgggactgaatgagcccatcctgcccctctgcccctgcctcaaggacaggagggcacatgacacggacaaagccattgcgtcatttgctggattaaatcctggtcagtgaggtctctggtcccagggtcagtgaatgatgctgcagctagttacttagtgaaattttcctctctaagaaaacacattttcaggcccgacaagaagttagttagtaggaataaatcatcagcttatttcttcagctggatgacctgtgtgtctagcatgactcctaatccttagtcaatagacaatctttgtagaagtgagaggacagcaagatgaccctgggttttagggccagggacttacctgttaaaattttacttcttccatttggaaatgggacctccttgagtcctgtctccacatctgcaaaatggcaaaggaatgagaacacttatcttataggtctatttcaggaaacctgtaaaagatgtttgagtagtgtacataacctactttggattttttgcatcttttttattgtctagttagtgaaatctttgatttttatatgatatgtcttggtaattttttcttttaggatggatttcttatttttatttttaatatactcaccaaaaatggtgattagtgctctagaggtctgactttttttttttgagatcaaagattgtgacaaactctaattaactcaaaggtatcggcattgacatgtctaatccattggatttaaaaggtttcatcagatatacaccgtgttattcctgactaaaatctgaaaacatcagatcagaagcctttctgctaaatagtttatctaagtttattagcagtctatttactgtaaatttatctgataatattttaaggtatttgtatttcttaacctaaaattattaattcagtaagtttctttctggtgtgaattataatatcctccttttttgtcctttgacatttcaagtggttccagtgaattatctgtgctggaataacttatctgaccccctcagggttcatacatttggtgatatcttccgtctgctttcatgtttccaggcccaggggacccccctttttttaagtctgtctggctatagtaatcccttcatccctttgaccattaattggacaattatgacatttagaaaggacatttttcaaaaccatgggaatctttatatttggaccagatgttaagagaattttaaaagagggataaaacatctgtgacaacgaatggcagagtcatagaagaaaagggaacttggatggcattttaatggaagtgctaatattgtaaagaggtacagaggtaaggtagagaggcacatgtggatttgcattctttttctccatcaatccacttctcaggtgttgattgtttttctgcactatgtccagtactatctggagactgagtttttaacagccttgttttagaaggaggcagatacacaggtaattgtagttcaggatgataaaggctgtaacaggaataagaatcaacgtacagtggggccagatagggacgagagaaaagtgggaaaaaattcatagaaggctccatagaagtgatgcttaagggttgggattagcagcaaggaaactcaacaacaacaacaaaaatggctgaaattgcagaggtaagaaatacaggaggttggtcaggacagagaggagggcatggattccagaggagggcatgggttctaaatgtgggtaagggaaggattgtcaagacactcacaaaatgaggagtgagttttggtaagatggaggaggagggaatggtgggtatcccttgagctctgagttggctgtctgagtgatggtgtagttagctatgagaggaagcagacgcaagggagacagctgatgaagacagataatgaggcctgctttagagcagttacactggcttttatatgtaaatacccctattttgatgtatgagtctagattatatacagaggttggggagaggatctagatttgagagtcaccagtttttagagaccatgtgaaatcacatgggtttgaagaaaagggcctctgagaacgtgtagatggagaaaacaatgaacattcagaagaggttggagtgtactttcattcgaggagaatgccagatgtgaaataaatacagagagattggggagttacagaatccagggaagacaggatgtcaggagatattcaaggaaaggtcagtggtcacaaaggccatggagatatctagttacataagcttcctggatttcacaagcaggaagtaatcagtgatgttgaccagactgatgacagtagaagggtatcgtcttttcttcccactgtggtagcattgcttttctgtgttggcatagactccacatcttgcagtggacgaaagagaaaatggtgctcccttcttttttttctttctttctttctttttttttttgagacggagtctcgctgtgtcacccaggctggagtgcagtggcgagatctcagctcactgcaagctccgcctcccaggttcatgccattctcctgcctcagcctccagggtagctgggactgcaggtgcccgctaccatgcccggctaattttttgtatttttagtagagatggggtttcactgtgttagccaggatggtcttgatcttctgacctcatgatccgcccacctcggcctcccaaagtgcagggattacaggcgtgagccaccacgcgcggcctataactggaatattttagtgtgtccacatgaattttctgccctgaggaaacatctctaggtaaattctttagaaattgccaaggtagttacattgccttgaaagcccattatttaagtacttttttctttttcttttttttttttttcttagaaaggacttttgttgctttagctgacacagaagtagattgaatgaactttcacttagttttaaaacctgctgacagataaaattaatattgcctttgtgtaaataataattttatctaatggacttcatttatttttatcgttcctccaggcgatctggagctaaacaaggggaagaagacaaaagtataataacaattccctttgaagggagatataaaagaaggtcactggagccgaaccattattgaaatgtataaaatagtttaatgtttgcttttttccattttatatcatgaggtccttttatatagccataaaattccatctcctctgagttcagatatgatgaaaatctgtgggtaacaaagccaacttcttcagttacctgaaggtggcagtgagtagtgtttctggagttaagagtggtctgtgtttcagtaagacattcctaaagatgtttccctaattcatttatgacaaacttctttcagctgaaacttggcaatcgagacacgtgggttaaaataatataaaaaagatcttgtttctttaaaagtgcactataaaaattgaagagatgtgatatatttgtggaacatcctgattccccttatgggctcaatgtaataagaagaaacctttaatttcactgtatttcccaaataataaaatgttcagttatcgtttttgaaaaagattagaagaatctgtttacttgaacattgcattaacttaagtttattgttttattgattcttcatttaattccatttcctacactgtacctagaatatctgatacaacagcaagaaaagagcatagattcatttaatacattccttctaggcctgaacacaccgtgggctttgattctcctggattgtttattcctgtttcattgaacgctctacttgaacctctttaaagatgacagtctctatattcccccattcaggaggatttcttccttctttgtttctgacgactttgcttctattcctacttcgatttcataaatataaaaagagctttttctttgtttgactactctgagctgtgatctgggagtagtggggctagtgtcctcttcatcctcgctcctatcttggaaagctgtaccttgtccaccgaagaaatccttcattatggctggtttaatacagattaaggataccccgaagacactgcccgttttcatgccttaggttcatccctgattatattcactagagacaaggctatgctcctggtctgggggtgattcaggtcatgtgaccttgtggccataagtatgtggttttagaagcctgagcagagagcttgggctgtagaatataagcagccagaaggtagcaggacccatcctgatgtggcctgtcactgcacctttgatctcacatgcactgtttaatctctctgagcccatagccttctcagctacaaagagggaagagagactagatgatttatctttcctcgttcaccttccaaattctgggagtccttgactcatttcttgtctcagatgtaccaagggcctaagccacctcacaatgggctcactcagtggcaggggatgggtggattataaatggtccataggacactagctctgttttctcaggttcattcaggcagccaattcagcatgttggagcacatacacttggcattgggactatgtgtagattgtttacaataaaagagagaagcaaaacttaatcaagacttagaaacaaaaggtctgggtctctccaaggcaacctttcacgtggaagcagtggtgtggcaggcactctaatgtcccatctgggtttctggaaaggagctgccgctgtggctggtgtcagccaccatggtgtgaccacggaagacagtctgcaccaggagcagtgggaggactagacagatgaggggctcatgacatcagcaagggtgcagatgtgactactgagtgtgcaaggctgcctctgaggaccctggcaaggtgagagggaccacagggaaggtcttgcagtgtgagtagtggagacagattaagaaggagctcattctcagctattcctctaaaagcatgatttttttttgaaaggcagaagctgaatactgagtttttcaatacgcagaactatttactgggcagcagctgacaatcatgcactggaccccatctttggctctgtcagggtgtgtagggcatggcttcggggttggtttgtttgctggaatgattctttagtatttctgcattcagtctggaaggcgactctagtttctgtgtgagcagttcatctgatcccttaaaacagggctaagaaatggaaagaacaaatgcaaaaacaaacatttgaaaagcacgttccagctgggcgtgatggctcatgcctgtaatcccagcactttgggaggctgaggtgggcagatcacgaggtcatgagttcaagactagcctgaccaacatggtgaaaccctgtctctactaaaaaaacaaaaattagccaggtgtggtggtgtgtgcctgtaatcccagctactcaagaggctgaggcaggagaattgcttgaacccgggaggcagaggttgcagtgagccgagatcatgccgttgcactccagcttgggcaacagaactagactggactctgtctcaaaaaaaaaaaaaaaaaaaagcgctttccaactccttctcctgcaaatcctggatgttttgtttttttacattatgacaatctgtaactgttcctaattaagagacacacatgcagcaatcgcttcagccttttggtactaaggattgtcctgctgtggcatgcatgggacaggacttcctgagacatctctgaggccacctcactaggtcagctcactcacctgactcctttgtccttttgccaaagcaagtctctaatgccatcaagtaggggatgggcgcaggaggggtttgtggactctctggactataccaacagattaggctatatccatctttatgataggcctatagctcagaagaaacccagcctcctctgaaaagtacattaagcttatgttggatctgtttttactaataactggttagacactgttccctaagcaaaatgcctcatggaagcttttattcctttgatttcttttttatctgacagcaattttttttcctaaaaggagcagttattttctgtccccaaagcctattcagtttcagttgtagcgtgggagtgaatgagaaatgttatttattgcacaaacacttctatacagagttgtacttatttagatcgagcttatagagatatcctcctacatctggaaaataaaaggaagtttaggggtttcaggggttttgaagtagacgcaccaaaaatgcttatatgttgtctcccaaattggctttctagaataaatcttcatattggcaaattcatttgtttcatattaactcacgtaatatatttttatttttctagagttggttgaatgatgatagaactttgatcctttgaaaattccttcataatgtatttcccaaatgtagcacatagttataattaacaggaatttcatatatcttgaaattttgcctgaatgactcaacacaaatttagtttggtgttttatataagcatattttgaataatctttcaagtcatggcagcttgtttaacttccaaagagggaagttatctatgtatgtatgcatatgcagatgtatgtatgcatctgtctgtctgtctgtctgtctgtctgtctatctatctatctatctatctatctatctatctatctatatctatctatctatatctatctatctatctatctatctatctatctatctatctatgtatctatctatctatctatctatctatctatctatctatctatctatgtatctatctatctatctatctatctatctatctatctatctatagcagaggttctcaaccaggggcaatttgacattgtctagagacaattttggttggtgcaaagttggtggtgggagggggtgttactagctctagtaggtacaggccggggatgctgctaatttcatagaatagcccagaacacgggattatatgactaaaatatcaatagtgctgagcgtgagcactaaaagccctggtatgaatgtgttcctcctacaccactgagaggcaagagctccatgattcagtggaatatggacctgctgagtccgggaaggagggacctgctatttagagctgagtctatttagagtaaaagcctcttcaaggagttagccttccatggtaagttgcttaaaaaagcccacgtctctgcatgaagactatgaatgccctttcctgtcaccttactgtaatgacagtttacagtacctttagtttaagaaaaaaggtactatgttgtagtctgaaaattataaacctcaaaaaattacctgttctcattaaatgttctttcctaacatgacaaacatgtcatttcagctcatcacccttgaactacgtgttccattttagctgctcattctctatatgtgtcatttcccctcttctctaattgtcgctttccaaatcccaaggaaagagcatttcagacacttgggttatttttctcttcctttcattcaggtggcaaagatgttagggcttctaacatcaagtctgttaagatcagagtggagggcatattgtaaataaaggacagttgcggtcacaagcaggtctggatgatgcccttcatcggtagcagaaggggaatctatgttggcttagatgtgcacgttgaaaaactatgtgtaagaaaagaatgtgctcttagtccctagttgatttgcactcattcttggagataatgacagggcagtgctccaacccatctccatgatggcttgctgctctgtgacagtggacttatcattgatatggctctgggtggctgttgggtgccaggcatgggtgtgagtgcttggcaccatgcttactgcagagctagcatgtattaaggattgattgccacttcatcatccttcccattttatctttatcattgctgatctgttttgatgtgggactgtgataatttacccgaactgatatgggtgccccaaacctccttgcttttaacagaatgaaatcacatctaaagcacctctaacaagtgctattttattttgaaatacatcatttgataacatttcatatcttaagtctcagatcaggaagctcagaaaagataggctacttcatcttgttacctttggactggagttctaaagcagacaccagttttgcacactgtaactccttttcaaaagtgaaactcatagttttaatgttataatccagggacaatgagcattttctcatccattgtccattacagtgctctgtgcttgggcagggattgtgggctggcggacagatgagcctctggctctctgttttcctccctagcccatccccaccttcatgctcagcatctcttattcctatagaagctatactcttcccttgtcttgatttgcagtgccattacctgtttctctgcccaacctgaatgttttggtcaatgggaatgttgtagaattccttccattcttaaggacctcaaccttctgcctgctctgaagttcttggtcctggtgactctgtacttggcttccttatatcaactccatggttgctgcttatcgatgcaataggccttacctcatgcttcttggttcctttgcaaattcatacatgcatagagctgagtatgcagttgtcactcagtaaatattgagtgggtgagagactctaaactcagctggaccttcaggtttctggtcaggtttattcatattgagccaacttccatgaaattaacccttaatttttctactcttcaatttcaaaatttcaattatcatgtcttttccttcctccccatttgtttgactcaaaaaatacagacagtgaaatttgatacaccctcaaatctatgttttatttatcttgaaatctcaccatttgttcaggtggtaagcactcctttttaaagaaggcctctttcctttctttcactttctttcctgggaccctaatagcttttcccctcagttttctctggattttcttccagttcctctctcttttatgtattcatttatttattattattatttagagacaaagtcttgctctgttgcctaggcaggaatccagtggcacattcttagctgtctgcagacttgagcttctggactaatgcaatcctcctgcttcagccacccaagtagctaagactacagacacacacaactatgcctggctaatttttagttttattttttgtagagacgaaatctcattatatttcccaggttggtctcgaactcctgacctcaggtgatccacccgcctcagcctcccaaagtgctaggattacaggcatgagccaccatgcctggccacgtgtctgaaacttgatgtgcgcgcgcgcgcacacacacacacacacacacacacacacacacacacacaaaatgattctaatctcatctaaacaaaatccatctgctgtttatcctattaaaatgaatggcatcactatccttgaagtcacttacattatctatcttaagtccatctgtgtctctttgctctgtgttccccaaatgtagcagattataacaaccactcttttattacattttgcatttgtggggtcaggaatctgggcagggttcaactgagagattcttttgctctcatagtatctactgaaattactcaatgggtttcagctttactcatggctggagagttgggctcatgtgtgacccatcaactatagcacctaaatgtgttctctctagcatggccatctcagggtagttggacttctgacctagtgtctcagtgtcttaaagaatgtgttctaagctacaggatgtagcaactgccaggcttttaggtcctgggcttggaaactagcacaacatgacttctgttgtattaaaatgagcagagcgagcagagcagtcactgagccaacccagattccaggtggagaacatagatccagctctcaatgggaggaatgcccgaatctgtggccatctctaatttgccgtagtttccattacccacagttattgtgtactatgtttgccttttgattcacattgaaaccctcaaagtcactgcttcatttatttctcttcttaacaattgtaatggcttcaaactgacttctccatttctatgttctcatctgcctagtttcctaggtacactattgtgataatggtcttattaatattaataagatcttctaacattaatgtactatggtagcttgttgcctgaaaataaagacctcacaccttagtgtagtttgccttccatatcttaacctactctgtaagctcttcccaatacttccctttaaacttcctagatcgagtacagcacaccattcctaaaacatgttgcgtacctcttcctcttgcccctccaatgtgccttttcatcctcctccctggggacggaacgtccttccagaaacctccatctgttgaaatcctctttatcctccagcattacactcagatttgagcccctgcatggacccgtcatagatccttctctgtagcagtcgtattctcccttgactcccacagcactcctgttctttttgaggtttgctaacagcttggattatagttatttttacaggcctgtattactttaatgcttgttaatcatttaaattgttcataatctttaaagtttccaagcatagtacttttatttcacccagtaggtgctcgatatagattttatttgattcacacttgatctctagccagatattttgcaggcagattatctacaattttaaaaggttatcctgcatcactaaatacagaatttagcaaatcgtgatgattttttaaagttgggcagcataatattcatcaatttattagtaaaagacaatggctgtggccttcttaaaactaaatattttaaatgttaaaaagggatgggcaggtatttgtagggtttccacatatagacctgtgtttgcgcaaggggttaggacaggtgaccaagggaaatccggccaatcccaactattaatctgcattccttaggagtgagtgtgacgacagtacagcttaagcttgagcatttctcgtttaaaacaaatgggctatgtcatgcaattattgggagaatgagaggtctgtattgagatacacgcactcacgcatgcattcatacacacacacgacctgggatatgactagaaaaatatgctgctctaagccctccaagctctcctctatctccacaaagtgtaaccttaaagttagtgaggaagttttaccagaagaccacccaccagaaaacgaactcacagtcatctgattcttctcttttgtgtgttttaggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaaggtaaggaaccagcacgcactgattgcaaagccgtcatctaaatgcacattctgtgtttagtgatagaagataatagagcatcacgaatgctgtataatccagtggctcttgtttcagacacagtttaaaataaaggtaaaactacaaaagcctctatcattagaatttcatatccagaaactgattaccacctcaagagggatctaagacagggattaccaaggtaaaaaaatctcattatttctggtcacctttatttaacaggtactgtgggcctcctaagtgtttgaaccaaaggataaaaatgtgaccataaaaataacaacaaaaccaaggaaagcctaaaattcttcactatggcatttccctgcaaagccttagtcttgccacaaacctagccctttgtttctatctagcattgcatggcagcagaattgatttaatgtcccaagtatctctatggattggtaggattaaataattaatctgtatatccactcatttattctttcattcattgaaatttatttaaggtccttcacacccggggcactcaagcattcagagtggaaaagaaaatagactctatctctgtcctcaaggaattatattatcaggctaaatatgatgaatgagacattgtatttcagtaattcatgcaacaagtggttttatattttgttgtttttaaaactttgtatcaaacactttcaaatatctatggaaatagaaagaatagtctaaggagcacaaaaaaagaaagaatagtctaaggagcatgcagccccacacttatcaattcatggcccatccccatcctttttcatctaaatttccactcatgcttcatctcatacccattaaattattttggaggaaattaaaaaaaaatcaaataattttatccatcagatttcagttgataatactcaaagataaggaattcagtaccattatcacagcaaacaaacaaacaaataataaatgatttcatgacatcatcaagcacccagagggcattgagagatctttcatgggttcataaatacttcggcatcttttggccagttaagtcaaatcgagatttaagtaaattccatgcactgccattggttggtatatttcttgagtctcttttaatattttacttttatttcacaccctttgcaaattacagaaaccaagttctttgtcctggacagtttcccacagtctggagtttgctcatcgcattctgattgtgtgcttcaaatattcctctttccaaagatgtctgtaaattcctagtaatctcaagacacctgctgagatccaggtttggatctttttgtcttgaccgtgtcatgggtagtgcagcgtatttccttcaggaggcagagcatatccagctgggaaatgatcagtcattgatgatcacagcctcaatctactgattcatctgtgggtacaaaactgggattttctcattttattattttgctcatttaatggttagaatacttctatataaactatctttccttcatcaactctttacgtatcctgaaggtacaccttatgcaggaaaggcaaaataaatgttccccgccccccatcaatttatacttttatttttttttaaatacacaagtaggttggttctttaacatcccacaggtcattcatttgtcatccaaaggggatgaataagatgttatgtttgcctttttcttattttgattattataattattattaatacatgaatttcaacatatttgatgtattttaatccatgtagtttacatccttgtacatggtgaaattatagcattttaagcccagtgtagcctcttgagagcagcttctggactcttctgactccatccaagtcatctttgagagcttctttactctctgggttgacaagatgttcctattccttttacttatttccttccacagacctgggaatcactcatttctgtatgctttgagcaccaaaggtgcccacaggtcttctcagtggacagtgctaacaaaagcatttttaaaacataccataaacttctcctgatactcccaactcatctccaggactctagggtctttgttaacctttcccatcttagtgtctatttcttccttgcacaaaatctcaagtctctgctgaccaacctaattatttctttgccttttttctttagtacacagtcattttagaataacagcttcatgcaaacctagttgttttggattattgaaaaatctttaaaatgacttttttctctctcttttttttttgtcctcgcgtatatatttcactggaaaattttagtgaaattagcaaaattactgctttaaaaccagtagaaataatttctttctgcgtggttatggcaccaacccaagacccagttactatcatttgtttaattattgaagcaaaaggtgttcaaaggaatctagctttgcttcctgttttcttgatcctattccagagctctttctgcatttagctatttacctatattttatgggttaggctacttttgtaatagaagcaaagcaacacacacacatacaaatatatatttatgttctctttccttagatgaaaggtggcaattatatagacttgtttctgtgtaacattattttaacctaatgatatatgctggagcctactctctagaagagtgtagagattgatgtcattcttttttttttttttttcggtagctacatagcttccactatgtgatgagccctaacctaatcaaaaacaccttactgagagatgcttaggttattttctgccatttgtgaccatggatagtgtttcagtgagtaatgcctcctgtaaacattatgtaatatttttgcaagtgtaccgttgaaagagattattcgaattgggatttctgggccaaagggtgaatgcatatgtcgttttgtaaatgttgcccaattctctttcatagaggttgcaccactttgcattctagttgccctggatatgaatacctatttctctgccgcctttcctgcagagtacaccgtcaggctttgggatttggaccaaactcagtgcataaatggcatctcagtgtatttttatttgcatgtttttaattcggagtgaaccttcaatgaacatttaagagaagcctgttgtgtacagggtttttactagatattgaggagatcaagaagatgctcagttcctgttaaaagggtttagactatttttaggaatgtgaaccaaaagggccattgcgtaatattctgtgaagggtcctaacaggtgcctgtgttgggtgctgcagagcctaggagaggggctctaagcccacatcctgggctgtaggacggtggttgaaaaaggtttctaggatgaagccatgccagaactgcatcccaagtgattgttagaaggtgtttacaaaacttatgaaaggagaggtttccagggagaggaaaagagcaagtgataagccctgaagtgagagagggagcattgcgggtcctggcaagcctcacgcacaggaagtcaggacatcttattttacgatatggaggaggaggtggagggcatgaggctcacatggcaagtggggattcggaggtgcctggcattggaagtcatctgaataagtttatcctttatctggaggatgacaaaatgccggcagggacagcccattctgaggctgctactgagaccaaagggaggaggaactgcattaagggaagggaggcagaaatgtagagaagaagtagattctggaaattggaaaggagtgtggttgaggattcagtagatgtagagcaggaatgagaaggaagccctgactgcaatccccacattcttggctgttgattccatatagaatcaagaagagaaagcagataagaggggtgtggtgattttagatggaaaaggctgagttcctgtgagccaccagatggaattatctagttgagggcaagcctttctgagaaccaagaatggggatattttcaagaaggctatgtccagcagagcgtcagatactgcagagtgttcaaggcaggtgtatgccagaaggaagagtgacacacttgtcctggtcttcctgggactttcctggttgcttctgttctgggaaagccaggacaattcgtcactttctgagaaattctgtcagcagtactgtattagctgcttagggctgctgtaacaaattactgcacactagatggcttaaaacaacctaattgtctcttcttacagttctggaggccagaagtccaaaattacggtgtttgcaggtctgtgttctctctgaagtctctagagaagaaccgatctctgcttcctcctagcttctcatgattgtcagcaatgtttggcattcctttgctcatggacacatcactccagtctcttagtctgtagtctcatggtatcctccctctgtgtccctgcctttttgtcttctctttttataaggacataagtcatgttgaacttagggctaaccttaatccagtacgacctcatcttaaacaatttgtctgcaaaggtgccgtttccaaatacggtcacattcagaggtacctgtggttaggacttcagtatatcttttgggaggacacataaaaggcagcatttatcggagcagtttcagtgcagggttgggggaagaaaccagatggtgatatgtgtggggatatatcaaaggttagggactagatgatagatataaaaggagagaattcatgtcagtcatgcaaggacataaggggcagggaacagcttttcaaagagcatgacttaaccatcctcaaatggcgatgggaaggaatgaggtgaaggaagaggctaaagagagagaagagaggggagatgattgtttaagcagagaccccggtgctgtaggagggcacagcaactgggaacaggtgcccagtaaagttataggaagccaactccacctccagtgagcctggagggcaggaggccaaagcacccaggatgcaggaaagcttgtgggtgggggtgggtgcgggagaggaaggagttcctgaagatctctgtcttggctgaagaggggtaggcaggccccaggccaagagtacagggccttagaaaggaagtgcttctctgaggagggaataaaactatttttctctctctctgtcacacacacacacacacacacacacacacacacacgatgtcttgtgatgttatgcacccagtcaggccttgaaatggctcatgttacagctgaacaagtggtctctgcgactccccgtgaacgcttttttgtaaggcaccattccaagaaactttgagaaagtaggatgaaacactgactaaggggaaataaagggagaaccggataatcttgacttaaaatcctgatttccatgcagatagtattatgcactggaggcattctgcataggatgctactgatgaaggactggatggtaacggaacgtcttcatgcaacttagcatgttctgtcagagtcttgatctgatttacctggctaggcagaagatgctggtagaatctttttttttttccagcctctgtgaaatatttgccactgcaggctcctcctgtctagtggagttcattgcataacacgctttaacagcttgctatgtttgcaaggttacttgcctgactctgtgttctggaatatttagccctgattgtgcagtggctgctaaaacaccctgacccattacagatgcaccgttcacacatatgtccttgtcatttgtttaaatgtctattccaataaagaggggaaaaatagtgacccttcaagacagcatgtttctcagcatgcttactgagtctcaaaaccatctctgaaattagttttaaatgtttaatgtctacttaaggcaatgtgccatattctgcttttgtttgtttattgattaaagtttactcagtatgctggctatttagagagcatgctcctgttataggaattggtttgtgggaagcaatttcacattattcacaaagaaagaccaccagtgatgtgagtcatgctgtactttgcgtgggtccttcatatgactgatttggaggcctttcttcagggtgttagctggcagcatttagcattaatgcctaagattactcctgcctgcagaatcaggcagggccctattgatttccattcccaggtcccagcgatctttatctttaactccttaatgttcctgtagagtgtcctcctacttatgggtttattgattggcctgagaattgttctgaaacttaagcaagagctgcatggactcgtgatagaggatttgcaacatttagctccagtggcttgggaagggcatggagggaattgagatgactgctccagcttgggccatcaccgggactgggctagggggttgcacttggttttctgctgcttccctaaggaacttgggttttaacagctgcctttatccccatatgtagtcttagatgattgaaaaaacagtgactgaaagtgaccaattaggattttaaacttgggttttattcccatatcacagtatgaatgattatttttcatggatcctatattttcctttcaaaacatatcattatattacattatatttatgtgtgtgttgcatgcattgctttgttaaattttgacaggaagaatatctgacatgttttgtaactctgagttggctctttctcgtattcactcactgtgcccccagcccctctcctagtctaagaagctctttctgcccttctctaatgtggccatgtgcatattacatgttgtcatcataactgcccttcttgcctgttttctggcctcctgtcactcttcccttgaccccgtgctgtcttgtgggccactggcattgctcagcctgccacctgctcctcctgcggctggagaaggcgtaacacggacagtgtcaaggtacaacaaactgtaacctctcagaaaatgaaggcatgctggatgagtgaaggagatgtttctgtgctaggctccatgtgtgtccacaggtccatgtgtgtgacatggctccgtgcatgtgtgtctcatggctctatgcatatccatgtctccctctatgtgccatctaagtgcctcccatggctgcacgtgtgtgacatggctccatgcatgtgtgtctcatggctccatgcatgtgccatggcactatgtgtctcccacagctacatgcatgtctcatggctccatgcttgtctatggttccatgtgtgtcccacagctccaggcatatccatgtctttatgtgtgtccatgtatccatgcatatcccatccctccatgtgtgtccacagttctaggcatgttcacaactccatgtatgtatgtcccatggctccatgtgtgtcccatggttccacacatatcccatggttccatgcacgtccacatctccttgcatgccgcatggctccacgcgtgtcccacagttccatgcgtgtcccatggctccatgcgtgtctcatgatgctctgtttcttctctgggatttggctgtctggtgtctaatgcaccaagcagttgtgtggagtcatggtactggctgagtttagcctcttcattaggatacagcaacctcattgccacaggacaggctgcagtagaggattcctcgagtccctgtgagattccagaggtttctgagtctgaatatataaatcttgggtaaaactgcttccagtatttctctctgttcatctagtctcagatctaccactgtgacctttagaaatcataaatgtgtgtgattgcatgataatgtcctactttctccaaggaggaattaagaacatttattttaattagaaatagatagcatgacattaattttaatacttagttttaacattttcatatgaatctgattaacatataggaagacactgctaactgttgaaaactgtcttgaactcaacattttctctgtaaactaaaatttacataaaccaagtgtgatcttcacttgtttcagaataggatatgacttatcctcttaagagtttacttggggaggaaacgtgctgttatggatccttaaatatcctttgttccatgaataatttgtcttttcattatcatgcatatgactggatgttttatgtgatgtaatgtcaaaatcacattggcaaaatattttaatctatttgcaaaggaaccagctaaggtataaccacattgcctgctttttacattacaaaatgcattttgggatacatttctgattttaaaatatattgtcagttttctatctggagaaatgaaatatttttaaaaaaccacttttcaattctataatctaggtatgtaataattattcatgagtgcacagagatgttaggagaaaatgcagcatgtaaccactataagttattaacaaagagaattggttctaatacttagactggactttaatgttgttattgatctttggctgatgagacctgagagggtccctgttgtgcatttttataagcaataattagactgacgaaaatggtttattgagttttgaaaattattaataactttcatgttacttttgcgttctagggccactaattaaataatttataagattgaatatttatattttatcttcaggtaaaatttcaattgttttttggttgatttatctcaatagggagatagtttttattattttaagtctttgagtggattgcttgtaagtaaagttgtgcaatttgattgagttaaaactgggaataaggatttgtaaagttactgttagaattctgatttaaaatagtgtttccatttggcctcaaatggtacgttattgtattttatctatctttaagtatattataatctttctaagcattaaatgggcaattcatctgtttgtcatactgaaggtagataaaaatccttattttatgtacagaggaagagttggagattaaatgtggggtgagtaaagttttaattaggcagtatctttcttggattatgtcctcctttcttctctttatatcagcacaaggtaagccaccttggttacatttgggagacaaagcttatgccatctccagtggatagcagtggtgatgtctctctgttaccaacaaaacaacagaaaaagactgcatgaaggtttccaaatcttatttactttggtttttaatttaatcaacactttaaatttgtattttcttgaatcttttttattattgactaaagagaggctgggaggtaatctctagctttattctttaatttctcttttgctctcccaattccttcatatgactcaggggcaagtctaatcacacatgttccatgagtgagaaagtgttcttattcatgattaagagcctgccagactcatgctgtcatccacagtgatgttgtgtgctaaagcaccaaaatgaatggattcctctaatccccagtgtaaaaagtcggggtaacactatttgacccatcctaccttgaaaatatgtctgggtgtgccttagagaggctgcaaaccctgctaactaaaatcaatgaagcaagaccctgacgccaggaacggctgagcagagtgctcatggcagctctcagaaggtgattaacggttgtcattctcatttgtatgtttgattttttgtgccactcaattctctggcttcagcacagagaattacttgtttaaagatgaaagcagaggcccagttcattaataattcagtcaatatttattgagtgcttattatgtgccagaaattgttttagttactagggttaccccaggaagtaaaacagaaataaatcctggcccacactgagtttacattttattaggagagtcagacaataataagatatagacatgtagtagaattggttacatagtgataagggttgaggaaaaatataaggcagggaatgggttaagtgaaggaaggggttcatctaatcacacatgttccatcagcgatggaactttcataatgataaccaggtatgcctctaagctcctgcactgccatttttttttttttggtttgttctgcagggaaatgttggaagacctacactacaagaactcaaaacaatgatgtaattgcatgaggaaaactataaggcaatgaacagaaagcagagatcagaaataggcccacatatacatatatattgtcaattaacttttagtgaagaggctatggtaaatcaatgagaaaatagtagtcttcaacaagtggtactggaaaaatggtatatctctctgcaaaaagtaaactctaaatattgcttcacacaatatacaacaattacctgatagggatgacagacctaaggttaagagcaaaaatttaaaaacctctggaagaaaacatataagaaatatttccaaaactttgaattaggaaagattttttagctagaatatgaaaagcacataccagaaaatttgataaattggaccacattcaaatgaaaagcattttctcttcgaagacaccattaagaaaatggataagcaagccatacactgtgtgggaatatttgcaaaatatttgacatacatacacacacacacagagatacacatatttaccatatatatatgtggtcttgtgtccagcatatataaagtcttacaacttaagaaaacaatctaatttttaaaaatggactagcaatttagacataactgcatagtgagatacctccacacacactgcagactgactaaaattagaaaggctgacaataccaagtgttggcaaggatatggcacaactggacctcttgttttgttgttaataatgcaggatgatgatgcataatgattcagccacttgggaaatgtgacatttcttcaaaagttaaacatatacttacaataagtcccagaaaattcactcctaggtattttcccaacagtaacataatattgaataatgtctacagaaagatttgtatccaagggtttatagaagctttattcttaaaaactccaaactggaaacaacccaaaagttcatcaatggaaatgaataaattaattatgtaaaatggagaactactgggcaataaaaaggaaacaaactacaaatacagatagcaagctagatgaaatctcagagtatcatgctaaatgaaagagtctagatacaaaagaatatgtattcattatctcattatgtgacattctgtggaagatagaattgtagcagcagaatacctattaatggctgcctggatatagggtcaaggaagaaattgactgcaaggtgtacgagagattttttgagttgctgcaaatattctatatcaagatgaagaggtggtgacaggttttatacatttgttaaaagtcattaaattttacatttaaatgagtaaatattattctacctaaataatacctctatgaaaccaatttttgaaattacgttagtcccaactcaaatgaggatgcataaacttgtcgagagtgtcaaatccagtaatcatattgctttagaaatagcctgagtttgttaggatacaatgccacatatttttgggcatcacgtccaagcattatgtgagaactttacaatgtgaaagataattctgaataatgtgttatgtaacatttaataagacctaggtgtgtgtatgtgtgtgtacatgtttcagcaaattacttgaaatccaagattatctttaatgaaaacccaccatagactgtgacttagttcattttgcattactgtaaaggaatatctgagagtgggtaatttataaagacaagaggtttatttgactaacagttctgcaggctgtacaagcatggcaccaacatctacttgacttctggtgaggcctcagaaagcttttactcatggcagaaggagaagggggtatgggcatatcacatgccaagagcgggagcaagagagacagggcagatgtcccagactcttttttaacaaccagatgttacatgaactcatttcggcaaagagggccccaaatcattcatgagggatcttcccccattctccaagcacagcccactaggccccaccctcaacattggggaccacatgccaacatgagatttggagagaagaaacaaccagactatatcagactgttttatcagtaaagttttcctcacaaagttattttaagggctaagttcatgttaacttggcataagaaagttaatttatttaactcccaaaggcagtctggaggaaaatttctgagtataccactttcagaggtgccatcacatttgagaattgttgattttcagattgcttttgaatttaagtgataaaaatactttttggaataatagatattatattaaccatggagaggaaataagagagatacatatttagcctgagtagcttttgtagtaatgcatgcaattcttcttttaccttttcagggtgagttttctataggtgatccttcctttcttcctgttcctacaattagaaacagaacaataagagaactcatggctataaagcagtgctggccaatagaactttctatgatgatagaaatgctcatattctgtattgacaaatatggtagccattagccatgtgtagctgttgaggattgaaatgttacttctaaagtaatacgttttaattgtatttaattttaattagttaaattaaaatgtagtcatttattgccagtgtctactatattggatagcataattatagacctttgccttccagcatcacttaacgaagatcgatgtaggctgttctgctcagagactcatgtgccttggcctcctctctgagtcaattttttggaaagcatcatggttcatgtttaaagaataccagactaggaaaggaaacctgtgcaattgttgtgaatctgctgttaactgcttctctgatgtatagaaaatctattgtgttccattttcatctcaatttcttcaagtgaaaaatgagcccatagggctactatatctaaggttcctaccacattgattctattgctcttgaaactagggaaataagggaacataagggacatttgggacattctttatctcttcaggaaaattccctcctttcttcatcctcaaacaacaacacaatagaattctttattgtggctgggagcggtggctcacgcctgtaatcccagcactttgggaggctaaggcggacggatcatgaggtcaggagatggagaccgtcctagctaacacggtgaaaccccgtctttactaaaaatacaaaaacttagctgggcgtggtggtgggcacctgtagtcccagcgacttgggaagctgacgcaggagaatggcgtgaacccgggaggcagagcttgcagtgagccgagatcgcaccactgcacttcagcctgggcgacagagcgagactccatctaaaaaaaaaaaaaaagaattctttattgcaggagcaaaataaaaatggagatttctgttgacattattgacactggcatttttgtcacaaatatttagtaggaaaaaatcagtatattttatttgaatgatggtttgacctccaatttgcatacatttccacaattaattgccatataaagagattacagccatattccaattgagaatttgcactgcttcactacctagaagcaaatgattcagagatgaaatattaacatacatgttttaagtcatcagtgcagtaaagtttagaaacccttaccccgaaagctcactggctattaagctagaatatccattagaaatattttgacttcaggtaatagatagttagtctaattgtggtttatatcataaggatgttcattgtctcctaactagatgcaaagagtaagcagtgcagggctggttcagagctcaacagtggcagcaaggacccaagtgctgtcattttgctcaataatcctcacggggttggctcttgcccttggtttttatttcatgttaggatggctgctggcagtgttcagagacaggcagtagtgggagggtgggggcaaccagcttctttgctctctgcttagtatcagaaatcaacaacaaaagccaaatcttacatgaagccatgtgcagaattgtttgcatatgaatggccagagctatttgtgtggctgcctctaggtgtaattgaaaaggaagtgtctggcaagggagaatggaaaaaaaccaccatttatgtcctgagtccagcaggcctgggaccaggattaggtgagtgaggaactcatcttgggtacactatttaaatggtgctgaaacactcagtaatcaagataaataatatactaatgcaatattttaaaaagctatctgaatgcaaaaaaatcaagcaatgatgaacagcactctagattttaaataaagacaggatcagtacagtctcctgccgagccccattggggctccagggtctttattcaaaatgttgatggtttgctcctcctggatttttgcattaatctagaccttgaaaaatattatattaaaatattatttatcttgattactgaaattttttgatcccctgaaattttacactccaaatgaggtacttactagccttgcccttgctccagccctggttgtttaacaaaatcaggttctgttagcaaggaagatccgtactacggtagtttagctttctcctcagctgtgttgtcagttctgtatattttctaatgcatctgcccacagaaatgggtatccttatatatgtgttgtggaatatgtctgtctcccctgtgataaaaccctggtgagtaaataaaatgtatactccaccttgtgctttacataagggctctttctgaacaatgagtactcaatacatgttttattaaatagctgaacagaaactcttttgacaagaaacagaaaactcaacccttgcaaattattcccaatcaattctgagatacaaagaagaaaataaataattcctcattttaatatattttttgtattttagaagacattgaatgactcgaaattcaaaaatatgagtcacaacaagtttgggagaatggaaggatctgttggtgctttttatgacttttgagatgaacaatgggaatttgactctctttaggaatagctaagtatgttttcaaataactcacgttataaaattgtagaaattataattaaaaattatgaaagctggtgcacaataatttgtccttcttataattttaatctaactatgtctttggtctgattaaataatatttgatattgataagctgtttatttgaaacctcttaagcttttttctcctcaaggagcatgataaaagcaagccatctctcattgggaaaagctttaaaatcctattaggatgttccttgtgaataaaagctatgctccttcagtgaaaatattagatgaaaagaatttcatctagacctgtgaagcctgactaatatagatatgtagtaggaattacattcagggctataaaataagtttgtattaagggccaaaggcattattcacaccatttataagatatagttcttcactctcaaaggtgtctgcacaaaattgttcaatgtcttctctgatttaattcagattttgaaagctcttaagggcaatctttggaatttagagagaataaagaaagaacatatgaaaataataaatttacatggttgttaaagatgcctgctataagaaaaattaacttagcaaggaaagaaagagtgggaagattatagtgaactttgcatgtgtttatcattactatacttatttaagacttccccttccttctgagccaaatttgagcaccccaggtttcttcagcaacattttttaaaggagctaatgaaatactgtgcttctcccatgaacatcctgcctcatcgcctgcctacttccatatgccccatgttttctggccacttgaaatgcctttttattttatttttctttgatttagtcatgccattccatgaattgaaaatagtttttgctacaactgagcaactgacccttggcagctctgagtctcttgacagaaccgtgtaactgatgtttaggggaggcaagaaatatagttggataatattccatctgtggtatgttttgtaattctcaaagcctccagtttcctttacctccataactatgtggagcttcggttgatatcaccaagaatttcacactccaagtgagagaaggatatctcccaaaggatgtgtaattctattatgctgcaatgctctttctgtgacttcaagccaagtgaaaacatttgctagttctggaggtacttttcagccagtctcaccatgtgaccttctagaacttctctcactcaggcaatttgcttttgacccattcctaccccaccatgtaattatgacccccccttacctactgcaggaggtgggggtagcagccattcactgttttaagtgtagatccagtatgtggccacatctgcctccctgctctgtttgttcttttcttctgtagaacattaaatgattagtgtgcatggttcaggcaggaaccatcttcagatggagtaaaacagaaaagattatatcagcgctttgcagtgatttcctgtgtgctatatttggttatgaacagattagaaagacttatgccttttatagtctgagaccaaactcctctggccacataaccacacaaagtaatatccgaagaacctaggatggttataagatctcatgaacaattctgcttttttgaaatgtactttagagtcctggaatctttaattaatggattttcctgaccctattcaaagaaataaactcaaaagtaaaaagtaagacgcattacaaatattatgctgaggtgaggcagtcgctgagaaatcctgaacactccctaggagccaggtgtggtgctgaatggtttcagccagtctgttgtttctcatttgtgcatttgcagatagacacttttgcacataaaaaaatgaaacttgtagttgaagactaaagagtttctgctttcaactcagctcctaaccatagaaatcatcttacatttgatattcatctagacatgagagcatactacagagtttgggaagtgtgtgggctgggtttcaaaaccatgggggcaagtacattaactgtgttcactcgggttttcatatcctctttttttgggatataattaatggttaaatagtagtttaaattatatttttaaatgcaggtgtaaaattgaaaggacggacttaaaactacctatcttcccttaagatttaaaatgttcatatttatcagcatgaaaacattggaatcgcattcaaactaagtgtctctgccctcgtagggtagtatttctagttactctggaattgaggtgaaaacatacagaagatagttcttttgtaagatttccagcaaaacagtaggccgagttgatggttgaaatctcttaccctcatataatggcatttaaaaaatagcgtccccaaagcaagaaagggacagttccaggggacagaaataaaaaagagaggtcaagtctggaatcctcagtaggaacccaagttgaaatgcctctgggggctggggcttataaacatgctcagggatgggagaagcaggtgaggcttgagcctgatgagcagggaggccagaaactgaatccggaagctacagtgagctgttctacctgcaaaaggaaaacgcaaaagaaccgcagattcaccccccaagacgagaagaggaagatggctgtgggtggacattgtctcatgaagacgaaactggggcctcaagcctgctttctaggttcccacgaggtacccaaataagaaccttccttgccagcaggggccttaacaccaaatcttcgagtttgagagcgccctctagtgttcatgcccatggcagtgttctcagttctggatttggggctcttgtaaacacagcttcttggtgatggtgaactcaagtcaaagggtacccactaatgaaacaatgaatggaactaagcgcatcagcagaacaatcagtgacagaatttggaccctagatccgcaaaatagaccaactcccaacagacttgaaagtgtttaaagagatacataggtaaagagcaattacttttgcaccaacctagtagcatcaatatggtcagagcaaaagatcatgatgtggatgagacagagtatagacgtagtgagaaagagcattatgaggtggatgaaaatgctgaggaaatctcttagaaggtgatgcatagggaggaacagattaactcacatttaaacccagagtaagacatttattaagtatttatctagaactcacaacatataaaaatatatgtgactcagtcctacctcacagaaaaaatggcggtaatgctggtataattttcatcactttccctcctttctgtataacagaaccatgtctttgtcttatttttaaggaagaaagtatgtgatgctgcatagaattgagtttttgttgttgttgttgtttgcaattttttttttttttttgagacagagtctcgctttgttgcccaggctggagtgcagtggcatgatcttgcctcactgcaacctctgcctcctgggttcaagtgattctcgtgccacagcctcccgagtagctgggattacaggcgcccaccaacttgcccggctaattttcgtatttttagtagagacagcgttttaccatgttggccaggctggtctcgaactcttgacctcaggtggtctgcctgcctcggcctcccaaagtgctgggatatcaggcatgtgccactgcgcctggccagacttgagtttttaaagggcaagatttctgtcttatttattgttatgcccctaaaaaatactttatagatcttggtggagagaatgactatgtttttaatcctttgctgttaaagaacttaatactctctcccctaggatgaagaagatagaaaatcaggcattcaaaagataaatcacagactgataaagaaaattataaaatgaaaagaatcgtttgtgtttcttgcttttccttagagttctagttttcttgcatgaataatgtaagtactaatacatggcttcatggatttttcaaggattcaggaatgtgtatgtaaaatacccactgtgttgctcagcctagtgccgagaatattgtatgcacccagtgtgtcctattatgggtgtcattattttcattgcagttttattattttcaccatcatctgaaaaggtatttccaagagtgtgtactaaagcttcatttcttttgtaagctatcgtgttgttttaaaaagcaaggtactggacttaataaaaatttatttgctttgggggacacaattgagatagttctttcctgcatctctatctcataatctactctctctttagggtagtgtatattttctcaattatatgtattttgaaaaacacctttactgatttttagactattaaaatgtctcttttgtgatatatttaatctatccaatttcttaagaccctgactgctgtattccatcagtgtcacctacagaatcaaatcccatccctctggagaacactgtacacattatctctgcaggtgtgtgcatacctgatgctagcttttgattaatttactaacagtacagatgaagtaggatgacctactgcagaggttaatacctgcaaaggccagtggttcatctagtgagtagttcattgaacaacacaagagattcaaaggctattgctgagagataatgtcacagttgaaattcttgtttatcttgaatttaaaaactaaacaaaaccatgtctatatttctcattatatttccataaaacaaggatagcaaaaatttttaaatctattagacaaccttaggagaatcagccacctagtgttgtcaaaggaataattttatcattgcagttctgaattctaggtcattctccctcttctgccccagtggttcttaatcttcaaaactggatggacattttgcctttaaagggtaatttttttcatagttttttgtttctttgtttttcctctgcaaggaaatatttgagagttactctaatttgaatacttaattgcctaacaagccaacatggagtggtggcaaatataaagacggaattaattggaattggttaaattttgacttaaaaaccagcaaaatcagctgtaggggaatagttattataggtgcaaaagttacatcatgaccttcaggaaaggaaggactgactcatttcagattccatagatgtctaacctatcatcaactcagcttcagtctggttatgctaggaaattccttctctggccattcctttattctggccattatgttataaagggaatctactggataaacaccaagccaagctgagcatagcaatgtcaagttcaacaatgcctcacaatagcaatccaacaacaaatgcttactgagtgccttacatacagtatgccattcagtctttataaaattgtataaagtgactatttttccccttttatgtagctgaggaaaaaaactaaggaatttaattaactagtccatgaacccatggtgcttatggaacagagcagaggctagattcctggcctgttacactgcaaaggccaggttctcatattctgcagcctctagctggtggggggaggagctgctactgtggtattcctgctttgtgtgtgtgtccgtgagtgtgtatgtgtctggtttgggtgctgctgctgaggatctgggggcctgtctaggagaggaaatggactgagccctaattaacatgtatgtgctcacctttttcactttgagtttttccatagccccacatcctactgtctttgcaagagggtctgaaccagtgctttgctccttgaatcaaaaaattttgagagaaaattatctcatcatgtacctcaatgcctcaacctagagcctccttttctagattccaggcatatttgtcatagcatagaggacaggtatgctccaaatgtagttcaaagaactctctcctagcatcccaagctttgtcttattttccagcttcgtttctttcaacatagagggtgcactgaatgacttatgttcattcattcatcaatgtgtttgacatttattcattcagccactctttgaacccacatccattcattcattgaatcacatctttatcaagtgcctgcatcagggcagcctttgcattaggcactgggagtgtaggacatagcagcgcacctgccatttagtggaaagatggatgtgtcaatagacaaattgaacgctgcagcataggacctgagaggcaaggtctggacactgtgtgcacagggaagacccttcctcttgttgaaggagatgcacagagaggttctgtggcagctgtcatcccagctggagtcagaacgacaggcgtcagaccaccaggtaaggaaagggaagtcaagggagctctgggtggtccctggaccaaaagcactcactacagttagaaccaaaattgcacaagggacagcactgaaaatgggtttgaaggtaaaatggagccagtgtggttcttagtggctttggtcttattgaggtttcatgttagagatgctgactggagcgcccaggcaccaaggaacagacttggcataggtggacaaccagtgatggaatgagaggtatggagggtccaaacaaaaagcagtggggacagaagaaagtgtgttatagaagctggagcaacaggactctgaacatatgttggggagagaatcagtgctagatactccagatgatccactgtctcagtctagtgtgacaaaattcaacaatccctgtttcttagttgaatttcagcactggaaaatgcactgatcataattcctgtccaaataatgtttgttaaataactgtagtttaaagtgagagagaattttgtccatagttattcatccatactgtacgacatgacgtggagctaagtaagttttgccttatatatcttcagatgtgaaagatcccaatggcccctcatcttcacatggggctttggagtgctcactcctctctgtccaggagaggtgcctcacctggggcttcccgccttgatgttaccaggtaaagtttagcttgttggataatagttcctccaaccctctcttggcactctaatccttttaacagactcaacatttgcaaaaaggcttatgtctattcccagagtttgcagttatactgtcaggatctcctctccctgggtatttttaatggagtaatgtttatgtttggggaggagcaaaaatagaaatgtttataactggtggggaaaaaagaactaatgcaagctggagtcatgggcttggtcggttgtttgtgaaaacaattctcgctaattatagcccttctagaatgacagcattattatactgaccatatgcaattagcttgacttttcttcctctgtggatgaaaatagaatgcactgcagttttcccctttcatattcctaagcaaggactacacatcctttggtggacacagtccaatttgagtctttttttaaggagttctaaaatctctgtatggcattaaatttaataggtccagtatatcaaaaatagaattataattatgaaaagtcagttaaaaggaggttggatggtaaaatgaaatgagatttttaatggcttgccaagagttgtaattaatgagatggagatttggccatgcatgtgaccttcaggtaggaaacagtcaaagccctgtgtgaatgggctcaggaaggaaaatgatttttcagaaggaatgggttctctatgtcttgcaagctggtaattcctcatcgttcggggctttctcttgaagtcaggctcactgaatatgttcaggaggctgcttggagttcatatcaggtgcatgagcgtttcagtggaagagacaaagctagcaacacggtggaatcctggaagaaaggagctcttacttagacaataactgctttatttgatgggtcacttgtaattttgctcataacacagagctgcttgtcatgacaatgttaattcgtgggtatgatctacttcagtatctgttttgcacagtgaatttctttgaaccccggttgcaaacaaagaaagaagaaaataacacaaaagcatgctggcttgagtgcctaatgccatcctgctgcacaacttcctcacacaccacacgggctcccgaggctataaaaattgtttttgtctgattaaacacaagtccctttgaacttggtgggggttcttttccgcttgcactttcttctaactgtgtgcagccttttcttttttttctggtttgatttggaatccaaagtgtctacaagttggcccactccacctccttcatccttttcttaaagcaaaaaatgtgtgttactgtaacatctgttacattccattccctgaggcacagacaggcagaactaaacactcttcacttgtgtgtgtgcacgcacatgcacacacaccaaccctttcttcttctaatatacggaacgtgggttgactggaaggcagaagcagatcagaacaaattatgttcacaattatgttagtaaaccatctaatcataaccaacagagcctctgtctctcaaggtaaccctcagagaagaaatgcgtcttcagtgggggctggggacttacctggggctatcagctctcacttctggggaaagaattgaagggaaggagcaggttccaatttatatggatgtcagtagaaacagaatccaattgggaagtccttaaaagcctgtatgaagataaatgggttatgtatcagggatggcgttaaataatcaaattgattctaagatcaaaatcgtcatagccatcgctctgaaattctacagtgaactatagaggttgtagatagagaggaataagatgaccctcctaatgcagggatgtgggctttattcattcatttctgcatgcattcatttgttctaatgcagaacactccacacatctttcttccaactctcagtaatgagtggccattttcttctccttctgtcgttcctcacctcgatgtcacctctagcaccgtattaaatgacatctttatgttgagggctaccaaacctttatcttctgcccagcccctctgagctccaggacttctctgttcccaccttactcacctctccattgcaatttctagtgaagacctccgcgtagacatccaggaaagaactattggattgttccccaaatttactttttctccatctctcctgtctcagaaatcaccccatagattgagctgttctagtgaaaatctcgggtgttatcctcagtttctcacgtttccttatttccctaatcaattagttcaaaatgcttcccatatctgcctcctttcctccatcttctctagaccactgtggtctatcccatttcctgcattctccatcctctgcagaccattccccatgctacagtcctaagagtttttaaaaaatgccacgcagctcatgcctcccccttgactgttccatatacataccttggcttcctagtgccatagacaagggttggcaaaactatagctgcaagctgaatcagcctcccacttgtcgttgtgaatattgtcttagtggaacccagccacacccactcttgtctgtggtggcaaaggcagagttgagtagttatgacagagactatattcccacaaagcctaaaatactatccagacctttgcaacaagtttgccaacctctcccatagaataaaatccaaagctttttacctctacttgcaagataatgcatgcagtggccctacctccctcacacctctcctctcctgtctctcgttacactcctgtcctgcttctcttgcttaatttgccctggatcatcatcagcttagggcctttccccagacaactccctctcttggaatgccctttgcctagacctctatgtggctttttcttgtcattccagtctcagcttaaatgttacctgcacagactggccttcctcacagactctaccatgttgctctaagtcacactctacaaagttactctgttttagttacatcatggcactccttatttcattgattctgcctccctcattcggataagcattcaatgagaggaacagccttctctacttgttttcctgcagcgtctgtagtgtctacagcaggaccaggcacagagtaggtacacgtttgctgcccgaaggcttgaatgaacaaacagctgtcacgtgcctgggagcagacggtctagtgaagaaacattaatggggtcaagcaaataattaaagttcaccatgacaaacaccatgaaaactgggcccagagcaggaagggtctctgaagctgtttggcacacatcaggaaatgagaatataaacatgtcaagaaaaattggaaacaagattagaaatgagactgtgacattgaattcacaactctctcccaggaagtcagtggggctgtaaatacagctttctagtttgtccatgtgatggcttcgtcccacgctgggaaacaagagtgactattataccccctggcttatgggtcttggcaggttagtaccttgaaatgaaagcatgaagagattggccaaaatacaccaaaaagggcaaagccaatggaaggacatttattttcctcattgccttatgaacctgtctttgcagaggctggtgatttggaggtgtggcatgctgagctctctgggggttgctgggccgtggcagaaatccacctctgttggaaataaaaaccctgaaaccataaatgtcagcttttgtttctttttttttttttttaacacgtgctttttctttttttaaagtttaacatctttggtgtttgacttggggctgctgataccaaagcaagcctgggggtgaggccagtgactttatgggactgtagataatattaactaataggctgtgctaggaattccagaaggtttgctttttattttattttttccctcagaggaaatggaagtatagtaattagctggagtttcaaaacgattttgtgtgaaagtgtagaaaatactcaacttgtgaagagggtaatgatttcctgcatgtccttatcattttcaccggaagatattaaatgccatataaaactatgggatgcaatattgtggaagtgctcctccttattgatgccatgtgatatatgataaaccagatatatgatatctggtgaacgattaggggctctttctaagctaatccacattgatatctagctgggtgaatttcagcaagaccctctactcttctggagtcttagggaagaggtatgagtagatatgcccagaggtggttccttcttactttaaaattgtctttctttccttcctttccttcctttctttcccttcctttcctttcctttcctttcctttcctttcctttccttccctttcctttcctttcatttcctttcctttccttcctttcccttcccttcccttcccttcctttccctcctttcctttcctttcctttgcttcccttcccttcccttccctttccttcctttcctttcctttcctttcctttcctttcctttcctttcctttcccttcccttcctttcccttcctttccctcctttcctttcctttcctttcctttcctttcctttcctttcctttcctttcctttcctttccttccttcctttcctttcctttcctttcctttcctttccttcctttcctttccttccttcttcttttgttctttctttcatttctaaaacactatgcttagcatgtttaattatctgtaatacatatttgttgagccttttactctatgattttctagagcaggggttggtatagttttattctgtaaaaggtaagatagtaaatattttggcccttgcaggtcaaatagtctgaactcaactctgccagtgtagcacaaatccagccatagaacatatgtaaacaatgggcatggctgtgttctgataaaactttattaacaaaaacaggtgatgggatagattgggcccataggccatagtttgccaatccctcttttagagcctagagactaatacttatatttcataaatgttaaagatgacctctttcactaaattcacaatattatttggatataaacaatcccatgtaaaatgattagaagaatgatagaatatagttcataagtgcttctcgaacacaatcactagtcaaggtatatcaaattgggccaggtatggtggctcatgcctgtaattccagcactttgggaggcagaggccagtggatctcttgagcctgggaattcaagatcagcctgggcaacatagcaaaatcctgtttttacgaaaaatacaaaaattagccagcgccataaactgatctctagatagatagacgatagctagctagctagatagctagatagctagatagatggatagatagatacaaattaaaaaataaaataaaataaaaagatatatcagattggtagtgtctggtggcctggaaaggagggaggttagtgaggttattaaggaagaatacagatgacatgtaggactgcatgctgctttgatatgacccatgttccttttaacacatgcattgaagactatttcactagataagagaacacagatattagtaaacttataccctactcttaagtaacccccccgacctgttacattcattagaatttgagtaaacagggagtacataggaagataattcagacaggatggaatcctgatatcaacatggagaaatgagaatcagtgttatagcaaggctaagggggtctccttgaatgaacgatgagagagaagtgaaaagcagcggagtctgagaaagagtgaaggctaaaggtagagtgccttggtctctagacccttgcagacagagaaagccaatgcaagtagagtacagctttgagacttgagatttgattggcttccaaaagtttttagctagtccatatgtctggaagtccatggggacaccatagacgaagaatatgtcttcatctgtgtgggtgtatttcacaatgaactggggacactcatgatgtgggatctgacttttcttctgtcccactctgttgaaatatttatgcaaaccagattgcattttggctttcttcattgaataacagtgttaattgctcaataaaataatgaaaaatggaatggaatgtctattattttttcttaatttgttggtaatgtactggtttctgtgagacagtacaaagtaagaatacataaggcaataaacttcttatgttaattttgaaaaaaaaacggtgggggctataaaatatgtgaagaaagataacaatgaaatgcactaattatatcataagtggcatttgtctagtttctagccacatatctattacaactcatagaaagcttgattctaggaaggaatttaccctttggaaaaggtacaggctggctgcctaagagatttgatgctattggagggaactggatcatgagtggcatttgtctagtttctagccacatgcctattataactcatgtaaagaagtttcaagcttgatcctaggaaggaatttaccctttgtaaaagctaaagattgctgcctaagagattctgatgctattggagggaactggatctcttcctagataagcaggtaccataatgccctgataaagtgagacagtgatttctatatatttctgactcttccaaactaacacatctgtgtccagggatatttatacaggttttattattgtgtttactgtgcttatcatcacaagagggagaagctttgagttggtggtctccagtaccactgtcaggttcaatgattttctagaaggactcacagaactcagaaaagcatttatacttgcagttagggttgattacagtgatggggtagatgtagattaaagttagcacccataaaaggcatgtggggcaaagcttaggaaagactgtgtataaatcctgagctcagaaaagcttgggaaagattgttctctcccggtgcagtcataaggacagcactgtattctcccagaaatgacatttggcaaaatgaatggaatattgccaaccaaagaaatgcaatgtagccttggtgtccagggatttattgagggttgatcacaaaagcatggaatgcttgcatggctgaccttagttactcagactccagcccttcctgaagtcaaccagatgcagcctggccacaggtccccactgtaaactgcattgttagtgtagactatctggcatggatcaaagatctcaggtcaagagagagagacactcctatcaggcagaatattgtaagggcttagatattatttcccagcagccagtcaaagaccagacactctcttggaacatgcttggcttgaataccgcagacctgctgagtcaacccattattaaactactcacttatgaatacggttcccgagaaaaaagttctgcctgtgagattccaacctaaatcaaccaaattccaaggactgtgttactttcatcagtatatttggtaaatgcagggtagttttgttggaatcagtgcctgattaggttgcgctgacctctatggcagctggttctaagaagacaagttaatttgtttttccatccaacaaaggctccatgttaccaaggaagcctgttcttaatatcttgggtatgtgctgtccaatcgtgtagccactctccaggtatggcttcaaagtacttgaaaggtgtccagtgcagtaagtgtaaggatttcgaagacttagaatacacatacacaaagatacctcaatgaattttattttgatagcatgttttttttttgtttgtttgtttgttttgtttttttgagatggaatcttgctcagttgcccgggctggagtgcagtggcgcaatctcggcacactgcaacctctgcctcctgggttcaagcaattctcctgcctcagcttcccgagtagctgggattacaggtgcatgccaccatgcctgactaatttttttgtatttttagtggggacagggattcactgtgttagccaggatggtcttgatctcctgacctcaagtgaaccaccctcctcagcctcccaaaatgctgggattacagacgtgagccaccgtgcccaaccctctttaacagcattttaacatggctactgggacatacaaaattacatgtgcagcttacattacattttcattggatggtgctgctttagagcatttatcatctttatgcttttccctgggatcagatagtatttatcttcttcagtttaactctcttttgtgtgtatctcatcttcttagctaaattataaatgtcttgaaggcagaggtctgtcttatataactttgtattccaggcagtacctacagttggttcttctatgtagcaggtactcaataaataaatattacttgactacgtacatgaattattgtgctgccccagtatttttggtgcacatccacctaatgcttaaccctaaagttcctggaaaaaccttggtctgacttggcaaatatgttctagttccgatgtgtagatagaatctgtacttcggcaaagaggccaccttgggacttattagacctctcttcaagcaagaagccttccttgcatgaccctgtcttgtctcctgagttccacagctttcttcttcccttgaatcctaaggtctgaagaagtagtggcttagattagaagctaaagattttcctatagtgaggaggcagacaggaaacttacgtgtgaattgtgagaatgtgacagaaagagattttccttaagcaaatgatttattgtcttaaagctgaggtctggcaaattctgaatatgtagcagaactattctggatattttaaaaccacacaccctaaggctctaagaaatctctggcacgttcctctgcaatctctgtcgttatctggtggcgaatggctttctttgctgtcagtcttctggctatcactgtttacacagccagcactttggccacttctggaataatctaagtgcctattgaatagaaattgttcatttttgtaattttagtcatattaacatcatttgtaattctaaagttataaatctaagggaaattactttttgttgttctttgtcacaacatggagattttgcaattagattttatagcctaaaatcatatgctgcaggtcaggagtcaaaatgaaaacccttctgcactgggcaaagtttcctatgggtgactcaaagtactttgaagccacgtaaagttgaagggaggggcaggctgggcaccaacttcatagcctgaaggacaaagttaatcacagtccaggaatttgagggtcatgcttagtttgtgttataatatatgaatttgcataatcttataaatttaaaaaaaatctgtctttcctgatggatgagtagaaattgcttcttctaggagttatctagcaataaaacccaggcacttatcagcttgtttcttatcctaattaattgcttcagatggtttaatgaaataggaatttaccaagatcttgaaagttataaacaaaagggaaggcaactctagcctgtgaggcagattttgaactcagattacagacaacttttcactagtgtctctttgcacttgccaggtgggtctgaggcaacccttgaatgactcggaactccttgggctggagtagccagaccctcacctaacactggcatttagatcctgagatttgacaagttatttgtggtatggcctgaaaatcatgcaaagaattgaaaacgtggggtaacagtggaatttattaatcccacccctgtttcagaaaggtagtgcatttcaattggttacaagatggtaattggttccagtgaaattttgcttcctaagatttctctcaaaataccaaggaaaaatatgtttagttgttcagtattatcttgtgacgacgatctagcttagagaaacggtaggtctggaaagtcacacaggagtcccttctggacatgaagcctgtctgccgcctgccccagcagccttgatcaccagctgcctctccatgcaggtccctgctcctgccctcactgaaacagtgcacgcattttttcctacaatcacaggttggtggttagtatttaatgctgatttacattatggatacattttatgccatagattccaggatgtaaaaaaaaaagaaaagaaaaaaatgtgtgacacaagcttgtagttttcaaatggtgtttgaaggaagacccaatcaggaactcatcgagtaaaaaggagctatcacagctttttggtttctgagacatccaccaggaagcctgcccaagatgaaacagtgaacttcacaagaatccaaatccagagtgtagaccttttgcaaaagttgtagtttgtgaatatttttctacaatgaacatgtgagaaatgggttaggtatactatgtgttaatgcaacaaaatcatatgaagacttgatagaacacttgactcactttcaacagactgcaatagaaaccagaaaagattcgaaaaagcactgcttgcatttttaaaatgctgtgttttcagtgtcatatttacaaaggaaaatgcaaatgaaagatgctttatgcttcctgctattttgggtcttttttcgtgatacgaaatgttttaatttctctaattggttattattaaatatttttgttttttaaaagttctataaatgggacagactcatttcctgtagacattttttgagataatttttttctttctactgtagtctattaagtgtctataatatctatttgaatacacttaggcaaatacatatatatatatatacacacacacacacacacacacatatatatatacacaatgaccacattgatgcctatatttatatatctatgtgtgtatgaagccagatatttccctgaccccttcccaggacttgtgatagggatgcctcatttactcagccctcagctctcaactcctgtgggagggagtgtgcaaacgaggccggaaatggagtgcacacacgctggaaccagctggccactttggcactagcaggggtgagttccactgactcagaccctccgtgttccaccccatgctggagggagcatacaggtgagcagatgcaggagccagggtgagcaattttggatgctggcaggagccaactccctgtaggccccgcaccaacatctagtggggaacctgtgacccctgaaaccccagagggcatattacagtgctcttttagctctgctgcctgcagatagcttaaatgttaacagctcagcaggcccttttgtgtctgcccccatggtttccaagctcttgtctggtgtccaggaaaaatgaggttacatgagcgaactgaagggtggtaaatgtggaggtaaatggtgataaatgccaatgaaagtgggtctcagtggaaggggagctggaaaggggatggggcaggaaggttatcttcccctggagtccggacatctctggccagattcttcttcaaagttacaccatcaaactgtccctctgaagtcaagccaacttctctccaacatccagccatagtccacaatgtccagcagcttctcctctctgccagctgagtctggggtctttataggcacaggatggggtggggtgggaacatgggtggtttaggaaaaggtaacattcaagcaggaaaacagaatataagttgtcactttgggctgcagtctgtcaggcttttaagcttgagggtgattcttctccagggaccctcccatgtccacctagaatctctctgccttctctccctatcatgtatatgtgtgtctatatgtatacagatatatagaaataaatacatgtgtatacatatacactgcatacatatacacaaaatatgtattgtgttgtgtataatacagtatatgtattgtgtatatacttatatacaatatatctagatacaatatgactataatccacatttggaaagcttaatctacttcactaagtgcagtctgcaagagctttcttgttcttatactgggtagtttgaaggaggatgcttgctgagtgggatggccttgggactgagatatattgataactatagatacatataattttggtcatttaaaatactatcatttagaaattttcatgtgctcagataatgtggtcagcctggtacagaccacttttttttttttttttacatcctggaatccatgttataaatatatatccataatgtaaatcagcattaaatactaaccaccaatctgtgaaattgtaggaaagaatgcatgcattccagtgaaggcaggagcaggggcctgcatggggaggcagctggtgaccaaggctgccagggcaggtggtggacaggcttcatgtctggaagggactcccatgtgactttccaggcccatcatttctccaagttagattgttgaaggataatatagaacaactaaagaaacatgtttgatatttttcctggatattttaagaggaatgttaggaagcagaattccattggaaacaatgatcatcttgtaaccaattgaaatccactacctttctgaaacaggggtgggtttacctcatgttttcaattgtttgcatgattttcaggccataccataaatacttgtcaaatctcaggatctaaatgccggtgttaggtgaggttcagccatggtacttctacttagatattctactagtgctgtgatggggaagaaaatagaccagcaaaggaaccttaggacctgggattttccagctcactgcacatgcatagccttgggcaggtggtgtaacacacctgccctcaactataaagtcaagggctggactgaagtgcagctaatgtcatgccctgctgtaacctgctttgattcaactaagccctcaataggagttatactgaaaatagtagaggctcatatatttggagataaaaaattggcctcatattttccaacctttctacaaagcaaaagtaaggtttagcatatctgtacattttggagtttgctaatgtaaataggacttgtcttggaaagtcatttgagggagataaattctccaatattgagatcttctttcccctggacttcttgctgcctggggtgtgccctggtttctttctgtttttctctggggtactcctccttcacttatgtcctgctcagtgggcagccaagctggaacattcctgtctcctatctggaaattaccagcttcccttctttccaatttttctctcctttgctgggtacaactaccatttttgataaattaatccatgcgtatatgttactaggcagtaaggattcatgctctttatgcattccttggaaaattgatttttaatctgtgtcttatagaaatattgccttagccttattctggatgtaaattccagtttagctacttattccttatgtcatgtttggatatttaacttgtcaaaatttcagggtttaaaaaaattttataacaaaaatgatagctctcgcttcacaagattataaacataaaaatagttaatatgtaaaagtatctcatacaattcctgataccaagtcagtactgaaaatatagttagtaaataaagaagtataagtaagaaatgttggttattctgatatgtatgtttttcagcagcatattttaaacatctatgaatgtgcatgtttattcccttatgacgtgttttgcattcacacgctggcaccagacaagtgtgtgaagctttgggactgaaagctatgataatcactgaaaagatttgagggaaccaagttggttgaaagcctgatgtatcttattttgggggtacacgtggcatggggttgctgctgatttattgtccaaagtgagattaccttgttctgagtggttgttgaagtaacaggcctggtaacgcaaactgcaaaggaaagggaaggaaactggtagcaggcaagacacagcatagtaaaccagcacagacctgccgtgctcttcttctacttgtgttagcttttaaacattccactcccttgtttttctatcatagttttggctcagatttcattgataggatggtttatgtaatgcactgaaaccaaaaatgaagtccatagaagggagaagcatgccaactttaaggagtaataggtccctacctttgaggtaggatggatcttttcacaacttcaggaagaggtcagaaaaaagaacttccagaatttctccacagagaatatgccctgtacttcttttcctgtgctgctcacagaaggttcccatcttgaggaggtgaagacacagctctttcattttcaggacagtaccttgtccctgccccccaactcctgtattggagttgagtggtttagactgcttagaaactcaagcattccacagtgcttgtatcattcctacgttctgatttcagaatgttctttactccaataaagcagatcagtacatggttgtcattttcttcctccatacttacataaagacacttgggtaataaaaaatgatgaatggtttttgtgtagatcatcacccttattaacatgggcaaaaacaatcaatattttattcacaggttaaagtagtagctggttttgagagacccagctttctgttgtatttcatttttctctagtccatagttgaaaactgagtgcgtagtgattttgcttaacagtctatcaatgggaatagagtaactttcaaagtggagaggctgtcgatttttctttcttcctgtaattttccaaatgtgctgtataggaagctaaattttatatttgctgaagtttaataatatagcatagtggctagaaccacaaaaactatgctggttgggtttgtatcttaccagctattgatcttggcaacactcactcttacaatgcctcagtttcttcacctatgataaggcaggtgtgagaaatacaggaattaatagttataaagtggataagatagaacctactatttaaacattagctatttttgagctgtcttgctgataatcatattgttagcgttattttgtcatgatgcagactaaatcggttacataactacatgataaatagaagtaggctgtgatatgcacttgtatttctacatactgtacttatgtgtgttatgtaagttgctctccgtgcttttcaacaatctttacccaccgtcccctggccccacctagtttggcttgaatcttagtttccaatgtgggtttcaagtcacccatatagcttttgaaatcctgctttctcagccccttaattaactgaagtttgaaggtgtgaggaatgaaacaggtatccggagccagcccttagtgtgcctgggaggtttccctggtcagtgtttgctaacaaatcagattggtttctggacagttggcgctgcaggtgttagcatgtggagtggctctcagtcagattttggaatgactgtcatgtcttccacaagagctgccctttattgtttgtttgttgctgttgttgttttggtttacaaacatcattaccttggctatatttagagtgtctgctttttttaaaagagtagcttttacccctctttccctttctttttctttgcatttcttttttctttgatttttttttctttcttttttggaagggacattaacttgaatctatttagcttatctctagttatatttgtcaagtattttggaccaaattattaatactgacttgttcataaaataaatcgtttcttgaagttgtaagactggattattaaaaaaaatggaattatacttttgataaaatattttatacaccaatcacatgcgagcttatgtagctgtaagagaaggcaactaagaatcaatgaatgtaattttgcaataaaaaatcattgctggagaccatatttcaacaatcacgtaaatatatgtgtaaaaattggattatctaggatagttaacctcaaatattatgaattatctatcaagtgttcagttggaatttacaaattttatgttataacttaacttccaattttatatatatataatatatattatatatattatatatatatagtcatattggctgccatatttaagctccatttcatcatatggttatttcagcaatatcagaaaatagggataggaggaaaaaggtaaactcactgggggcaatgagcatcttaatgttattgaaaattgtatcccctcaattcaccacttgctgtggaccccctcctgctccctcactctccccgaacttcctctggcatctagtttgtgaccaattgccctgaactcttttagatcttctatttccaaaactgttcattttctgattccttagaaagcagtattgatgacgttttcctgctactactgaaatctgttattgtgatgatgaattatagtaataggttttctgttactaagcttgctgagccatccttgcgtttctgggctaagccctattccctatgaaatatagtgtatgtgtgtgtgtgtgtgtgtgtatgtgtgtgtgtgtgtttgtatgtgtgtgattttttttttgatatattgctatattgtacttggaagtttattatgcattttattggggtttttgaagctataataacaagggagtgtaataaaaatatgtaatgctttttgaaataggagaggatgtacatataggcagagggaaagggactaggtaacattggagattttagaggaaagcctaggtaattgagaagcgattaaaggggaaagaagagatgagagcaactggtctttgaaaagaggattgagtgccttttctctgatctgttgggaaagttgggaggataggtattggtgcaggcttctttttagttcaagaggtgagttggtgcagagactttcttgcaaggctctcttggtatcagtgagatagaagccaatgtaatatgcaaagttgagatggccaaccttctggaggaaagagaagggaatatgcagattactcaactttgatctatgttaaccataaaaatacacagttttattgggaaagttcattagaatttcaaataaggaaacttgaacaatattgacagaactacatgctgttaactcattttttcctctgtacatgactccttttattacttcagggtattttaggaagtagcaaaactgccttcccgttgttcagtatagggaccaaaacctgatgtatgtctctttagcctggttcctgttggccactttcttccaagtcttctaaataaaaagaaagatgaatgcatgggaaaagagtaacctgattttcttctatctttcgtagtcttttttcctcttagaggctcatctcttcactcccctagcaggaaggtcagcccttggccctctgttcttccctcatgtggtttgaagattggatgtgagcccagctctgggggctgtgagttgtggtgaacagagcccctgatattcactctggagcctggtcctggcagtgctccctggtcatgtgtttcccatctgaatgatgaacctcctgaactagaacatctttatggacatttctaggtcttagcgatgtttaacaatggctgtgggccaacctaccattggaaatttttcacctgaaacattcccattcttgcacctgaatttactatctttctctaaagccacctcaaactctgatgcctgtctcagtcatcactgttttcttcttcatttaatttggtaactgttttgttctttttaagttgtttaccttgacttcatctctaatcagtgatcccacatcttctttattcattttcaaggccaatacctaaattgtaggtttttaggtttttaaaaatatactacttttccttccattctctactctttccagaccattctttctatcaagggctcattgatattccaaagacatctgctcaaatgggtcaagagttttcctgaaaacgtttcaaagctttgctgtcacatatgaaatcaagtccaaaccttttaacctgaaagtgaatttttctacagtttgtatttaaatacacctttcagtttcctttcctagtagtttcttaagttgctattactttttcttttctcctttctctttttcttatttcctttctttttgattatttctctcttgaactcacttacttgttcttacttcatttcacatatttattatttcctatcgcattcaatgtgctgttttgtatgctgcatgcactgcagggagcaatgcagacgcaagagccattgggttctcttttgcccaggaatggaggcattgatggagtgaagatgagtgataccagttatggccacagggggcaccatggcctcccatgttgctgtcttgctttgcccctctaggacatctttcctgtcactctctggtcaaatctttcctcttgttttactgcagctctcaatcatctcttcttttcatataagaataattcctgtaaccccacaagcccctataaacacttgcattgatagacaccctgtttaaagatactagtgctgtttctttaactgaattataaagtcctggaaggattattaataacttttcatagttccattgccttgtacataccttgttctacgtattttaattgatttgcctataaaatgtagaaatttatatgaaaatccttaaaaaaatcaagctatcatatacattacaagtccctctctatatgactcacccctggtttcctttaagcagaagataaattttacttgatatcacttccccctcgtaactgttagtagagaaaagacatgtttattatacagaaccattcctgaaaaaatagtccctctcattcacatcaacaaagcgatttctttaggatatgagacggaatgggggcatatttccatatgcccccattaaaaacataacactgatgtgtttagcatcagcgtttgttggaggagattctttcctgtatcacacactttttcctcaaaccaacatcttcattgatttgacagttgttatgtgcctggttagtcagggtggtgttattcaaaatactaaatccaagaaaaaacgacaatcagatgttatggttaattgtcaatgataatgataaggtatcccacgtttggtgggcaactcactgaatattttttagtgttaaaaatgagctaatgaaagttgcaaaaatggctcattgaagcagcatcctatctctcctcaaatactgtcattttataattatcggactctgggctggaggctgtctaataggagttaaccgtgcttgtaaaagcctgtctctatagagtggctattttctgatttcccttagaaaaaaaaatgcaaatgaagcctagaagtaactgtggatttctcatctagaaaggtcggaatgtgtttaacaagtctaatcatggggccaaaatagaaacccaaaggacagggaaatggaacatctaatttgaaagaaggcaaatgatgcttgtgtgcttggtccttgctcctaaggaggcttttgtaatatttaaaaatctgcagctcttttgagtcaagttgcacaggaaatggtcttgtttgcattcagtattcctctgatgaatcatgtgaatgctgtgttattttctgcccagcccaaagccaaaaggaaaatgcacatctggcttgtaaatcacaaccaagcattgatgcctcgcttgctctttattgggtggctgccctctgtgctttacaagttcttagtatggcttatggggcatcctgagggaaacctccagtggcctctgaaagatggcatagagggacctccgaatcctctctgaaatgtaacgtctgctacctgatgtgcactatctgtggtccccagaggaaaaataattcatttttatctttttatttatttattttttctatttagaaattggcccctggttacgggagttcagagcgaagaatgctgtggatttctcgcagttaacatttgacccaggacagaaagaacttgttgtaggagcaaggtgagagatattgtattttgccaccacagatatttttggacttcattttacatctgtgcagttacatgtgaccttcactgacaaaactgaagaatgctgaataatattatttcttataagaatgaaatacagtatgagtgtcataaaatatactactgctaataagatgttgatggctgcccgttagagtaagcattgatcgggccctcaccctgtgccagtaactgttctaacatgaattaactcatttgttcctccattcaaacctaagaggtaggtactatcaacattgctgttttagagatgtggaaactgaggaaggaagtagataaataagttgtccggggcatatgcctaagaaaagatggacctgggttccaaacccagtcagtttgactcctgaaaacatgttcctgacttcccactatattcttcagtaggattctagagatccagagatcttgatgtgtaccccaaggcccaccaccacctttctttgttaccttgattaggccatataccagtaaattgagattcaacgaagttatttttatctttatctcttaagggtgtgagtgttcccgtatctaggtcaacatctgcatcccagtttgacaatgaggccactggaacacaatccaaacaaatttgagttctttcccctgttttcactatcacttccttagaaaacctgcataatccttgcatttaaattacctattttgggattatatatccatcttttaggaaaattgacattaaagtttaagaaagggtccatttgtagaattgggttcctctggcatctaaggatggcacattgggcagtggagagttcattatattttttgtccaaatgtaccagagtataaagcatgcctgccatagctacagaggttttgcagtctctctataaacacgagtgcagctaaatctagcttatagtctgggcactctagataaacattgaacagtttctaggatcgttgcttttgctcttggatcttgaggtgtccttgtacatccactcaacacttgaagtgatgaatggttgtaattttacatgagtaggaagaagttggcatagtttattgcacctagcaagttaccttcacctcttttgacgtttgtgaggaggcggtgagtatggattggacaaggctacttggtgttctcttccttaccttagtccagtagcaatactgggggatttctgatgctcacttccaacaaatttcatcacttggagttcggcctgtgttttgcagtggtgttaaatcagtctcctggcctccagatgttctcctccttctgcataccacagccaacatcatcttttaaaaatgcccaccttcagtagctcccattggatataagctgtctccctggtgtggtacgccagcccttctgccctgcattcccacttcccttccagacttgcctgttttcattctcacatggtccaggcatgtggaattatttattctgcctacacttatggaatatgctctttcttgcctctgggctttttcccttctgacctctttctcattttctggaatactggctgccaccaacccccactccaaattatctgcttggtaaactcccacttgtagtaaggacctggctcaagggtccaccagcagtcctgaaccaccacattctctgtcctgtgtggccctagtaacatactggacatctactttttttttttaactgcacttaatgtacaatattgcattatttcttgacaagtcacccttatcagatggtgacttaccagaaggcaagggaagtgcctgtcttttctttatttctccagcatatagcacagatttttcctgcttatagaagctcaaagatacctgttgattcaacacatttatttccagagttgaatttgtctatgttcccctctgcatccaggtgaacacttagggaaaagggggttgggattataacaatttatctcagacacctacatctggcaagggcatgagccagtggcaggctgtatacaccaaagctcaccctgagggaaaatgagctttcactctgagtcaagggaacagaccccttaccggggtggggcaggtacaaatgtgaccccaattagtgttttgagtcttgcatccctcattcatctctaaagaactttggaaaggcttttctatgactttgactcatgagattctcttgttgtctctggaggtcctgggtgctgtgtgaacagaccagcgcttcattctctgcaagtggttggcttttggtcagtgactcaagattttcctaagggatgtgagaagccacagagcaaattagggtattttgaagagatgtcttatgctcctgttctggctgtggatggcagctgggaattgttttcaaggggtacctgtcccaggaggtcttcatcccagagtccctggagttctctattccagtgtcagtggggtgtctctctctctctcagtatccctagaggtctctgtccaatatctccaatggtttccatctcagcattcctggaagtctctatctctgtgtcttctagtttccctggagcttccaccccagcatccctgtcgtctccatcccaatgtctctagagtgtccatcccagcgtccctagagtctccatcccaatgtgtcttgtggcttccatcccagggcccctggaatctgcaattcaatatccctggagtcctcatcccagacctcattcctggaggtctccatccattgcatatcaacatggtctgctgggaaggatcggatgggccgctgagtcaacctagcatgctgtatggcatggtggacatgaatacataggattgccagacttagcaaataaaaatccatgatgcccagttaaatttgaattccaaataacaaccttttatatgtttatcataagtatgttccaaaggtttggtgaccccgggagcatgggctgtagttttttattctagagcagtgtgtggtacattatagacacttgataaataataacagaaaaaaaaagaggctggcccctacctaagtgactctaagccagtttcagagcctgattttatcacctgtaaagatgatgcaacaatttctacccctttcagctgttgcgaagatgaaataaaataacccgtgagaagttactgtcacattaacaggcaggctggtgagcgcgcagccctagggaagctctgagggtcttcatgggtttcgcatacgtgtgcatatgcctttcaggcagacgctacctaaagaagagaataggaatttcacctgggaaatttcatgggattaggctcagaaagtttgagagggcatatgagtaagatataaaactttaaaaataacccagccctcagattcctgtttggcaaagcttgatttagcaagagtaagtttagataacaggtgtatatttcagaaatcagtaatggtttaaaaatatgagttgtgaaaaaatagaataatagtcgatttttttttctcatagcactaggcattgtggaaccatttattggatggtttcactttatactagtgatactgtatgttcctgaaattgaaacagttaaagattctttgtactctttgataaaggaagttcgttaggctgcaaaagaaaagcctctctttcagccatttgtggttatggagaatcggaaggtacttggatctgaattcagggaatttctggaagaagtcatacattttcatttccaggatgcacatgaactttcgtattatgttaaatgcatcaacagtcatatcttgttttcccccagtctctttaaaagttaataatatttgtgttttcagtaatgaaacttaggtatcttcatttacaaaatgtagaatatacagtaaagcataaagaaaaaaacaatttcagagataatcacagtgaagcatttcagttatttccttgcattatttgatttctatttgttcctactcttgggataatatttgttgaatgattgcatacttctttgtcacaaatcctactaagatcagtttcttggtataaaaaattcaaaatgaaagaatatattatgactggtttttgtatagaagattataaaaggaatggcagtgataacactccacacacttgatacaagtgtaagtttcactgcagattgaattgttgcaacagatacaagggagggtgattacatttttatttcccaaatgaattagttcgtctttagtgtttcaggttcattctaagggtggcaagtgattccatcccgaattactctgatatgtattctgtgctgaatccaagtattattccaaatgccaactaacttggttgacacataaggcagtgtttgaatgctgttggacatttacaaattggccatatttttataatgcataaagacctacagtgctaatgaaaaagagtttattatcaaagcatctgtagcatgagtctttgccactgaactgtggggaagatgtggagtcactctttctggctatttaggtgcttttcttcaaaatgtgatttttctaaatgaaaacattttttaacatctatctcagtttctaaaatgtgaattttcttcaggtttttaaatgtgtttcttggtctttaagttattttcatccaattactcaattctgattctcttacttttcccaaaaagcttgagtgtaatataaacataaatcaaagggtacagtcttacaaactgtggtattttagtaagaaagttcgtctgtaagctctcaaacaaatacctgtgagtccacatggcctaaacatctgccatgggtaaggtggtgggattgaggcccacagacccaatacttggatcaggtaatgatcataattcatagcagatataatgatttatgtccttggaaatgtttgattttaattctatacaaaataacatcacaaaatgagaacattaagtcaccaagggaacaaaaggcactagagatgcatgagtcttcttgcacacctggcccaatgtgagtagcagcccatagctgcatgcctcacatacctgatgtaatgtgagtaccagcccatagctgcacacattgcacacctgacccaatgtgagtagcagcccacaacttcacacgttgcacacctgacccaatgtgagtagcagcccatagctgcatgccttgcacacctgacccaatgtgagtgccagcccatagctgcatgccttgtacacctggcccaatgtgagtaccagcctatagctgcatgcctcacacacctgacccaatgtgagtactagcctaaagctgcaagcctcacatacctgacctaatgtgagtaccaacccatagctgcatgcattgcacatctgaccccatgtgagtaccagcccacaactgcacacgttgcacacctgacccaatgtgagtagcagcccatagttgcacaccttgcacacctgacccaatgtaccagcccatagctgcatacctcacacacctgacgcaatgtgagtaccagcccagagctgcatgccttgcacatctgacatgatgtaagcaccagtccatactgcacactttgcacacctgacccagtgtgagtaccagtctataactacacaccttgtacttctgacccgatgtgagtaccagcccataactgcacgccttgcacacctgacccaatgtgagtatcagcccatagctgcctgaataccttgcactaaaccccttgacttaccattacagtatttctagatatcagaagatatgtctgtataaatgtatgtgcaacaaatagtatggatttctgatccttttcgtttattattttgaaccatttgtttggctaatggtttgaatttacaaaactacagataaaaaaggaaagattaacttgctgtttttatgctctggctgaatttgctgtaagtattcaaaacccttaaacgataaacttaggtgcattaaaattttaacaagtttatttgaacatttagagatttaggaatcaagcatcaccagacttccagcagctctccacttgtgggtgggggtggcaagggaggaaacttttataatattcttcccagaaacaagacaaagaaaatgcctctagttggttaaagtggaaactccctagttagaggttagttggtggtttctaattggttaagtctgaagttagactttagttagggttttgtttctgattggttaagcttaagtttccttttactatttacattgagttgaattttggtttgtttacataggaacccaagacagtgaagcctcctcaatctaatggcctcccaattattttaacatagcatatattcttatgagacgcataaaataaacggtaggcttctatttaatgagtttcttctttacaaaatgactttatcacactggttctaaacaagggggattaattttaaattcacataaaatttattttaaacaactggccaatatcattatttttcggtgattataattcttatttttacttgaaaattttaccttggaattactcttttggaggcaatatataattaacaggaaaactgaagatgtttatcagatcagcgattctgcttccagtagccacacttattcgtcttttccaaagagtatattttagtcaagttgacacaattaaagggaatacatgctgagcggtatgaaatcagagattagcagtgaatgcaaaaaggagtagaaccccattgtgggaagagatcccaggtaatgctgattttcatgttgtgtttacattaattatgacttaagacaagcagctggtgatggaaaaggaacagtgcttttcactgcagtcttttttgtcctcttccaatcaaatctttatgaacctccactttagggtttaaaggtttccccttctctgtccctttccttctcagggctggcccctatgcacaggtatgtcctttatgattctctgggcttatctctctctttcttctacttgttctcccctttcttctaattcgcttatttgattaatttacccaatatatgttaaaaagtctccttgttgtctgctggctttgttaccttttgtccaacatttgccaaacattaatgttcttaagtattagctaggacatttgttcaaaattaagatgcccctcccagctctgctgatttagctggctcagggtgtgtgcttttaacaaactggtggccaactgacatgcctgggaaagatttctaaccattctgttccttctgctattgtaaaaaaacaaaacaaaacaaaaacaaaaacaaaaacaaaaaaaactaatctgtacttttttttttttttttgagacagagtctcgctctgtcgcccaggctggagtgcagtggtgtgatctcagctcactgcaagctccgcctcccgggttcacgccattcttctgcctcagcctcccgagtagctgggactacaggcgcccgctaccacgcccggctaattttttgtatttttagtagaggcggggtttcaccatgttagccaggatggtctcaatctcctgacctggcgatccgcccacctcggcctcccatctgtattttttttttccctgcttgagttgggagaatatcagcctagtacaacagttatctatttagttataagcaagtaagtacatacagttggtcctccctgggttctgcatctgcagatttaaccacaagcctaaaatatttggaaaaattaaaaacaaacaatacaacaataaaaatgataccaataaaaacaatatggcataacgactatttacatttataatgtgctcgatataagtaatctagagatgatttaaagtatatgggaagatgtgcataggttataggcaaataccaatccatttgatatcagggactggagcatccatggattttggcactcgaggtggtcttggagccaatgctctggggataccaagggacagccgtaaataaataaataaatgtacaaaggcttcctatttcccagatcccatgagcaaaccaacaaagggctgtgataataattgaataacttatttgcatgtacatgtgctacagactgagtattgagagcttttctcctaccaggtccacatggggttcatccaaatgtattagttcatgtagttcttctttcaagactctgtgttactcaaatatttattgaacctactttatgccaggaagcttcttaggcattagagaaacaaagatgaagcatcttctctacctgatgaggactttctagtccagcgcaagggttggcaagctggggccccagagttgcctcctgtttttgtaaatatgcttttattggcacacagccacacccactcattcacacatcttctgtggctgcttttgagctaaaactgcagagacgagtagttggcacatagaccacaaaagcaaactatctgctctctggccccaaaacaaaaagtatgatgatcttggcctagtgggtgagacgggcacaagcaattagattctccaagggaagcctgagtaaagggtcctgaaaacaccaagagtaaagggatatgatggtgcatcgatctgaagaggctgcatagagaaggtgttcctccaacggggcctgagagatgcttgaggaatctggcagggaagacagagagtcacatgggaaaagtcagagattctgatgaggctgaaaagtgcttggctccgtggcacctgttggtgacagagagggggaagtaattataggtgaagctctgagcattagctggggccagattataaagaagtttagacttagtcctctagaccagtgactccaactgggccagtcttaggttcacctgacaggcctttcaagagtgtagatgtccaggcctgtcctcaagtcctctgaattccactttccggaagtaatgccagaatcttttttgtgagagagagcatcactcttgttgcccaggctggagtgcagtggtgcaatggtatgatctcggctcactgcaacctctgattccttggttcaagcaattctcctgcctcagcctcccgagtagctgagattgcaggcacccaccaccatatccggctaattgtatttttagtggagacagggttttactatgttggccaggctggtctcgaactcctgacctcaagtgatccacccaccttggcctctcaaagtgctaggattacaggcatgagccactgtgcccggccagaatctttgatttaatcaagctcccattgctctgctggcttggtaaatttgagaacctctgctaaaggcattgaggagcccaggagatttctacatttatatgttcacataatcatatttgcattaggaagatacgtccaccatattgtgtgcaggatgcactaggcactagaacttgcagaatttggagcgaggcatggcagttgcgggttgtggatcaggtgagagtagagggtgcttagacttaggcagtgatgatggcaatggagatgagaagccagatttgagacacgtttcagttctgattttgacagcaattgatggccaacagagtgggttggctggtgggaagcatcaaaccattcagtgagttttgggagtgtgactgggatagagcatatgggaggatgagctgtaattctttgattattagaagatacatgagaaaaaagatctcagatttgtatgaatactgaagataacctagaaaattaattgtatatggagataatttaaagcatgaatagtcctaggaaatcacaggttaaaggaaccatagaaatattcagttggcattttttttcaaatgaaaaattatctctgttaactgaaaaacagaaaggaacaaatcagatacccagaggacccacaaaggcaaaagtcgcgagttaaatttagagcaataaatcatcatctgtaatcctcacagcacttagagatttgcaagtaataattaaagcataataaaatgtaaactattagtgtaattattaacaatattgattaataacttttaccctaaatatatttgtgggaaaatattttcctgattttatatctctaagatttgctggcggcattgtttagttactgcatgccattaaaatgtatctttgttatttcattctacttgctaaataataagagactatccatctatttttgcaccttttaatcttggtatttaaatatataagaatgctattaaaatggtttgatctcagttttagtgtgttctttgaaatttatttctaataaccaagacttttaaggagctcaaaatgctctttctgggatagggaatgaaagaagttaatatgattctgggagaatgggtaccagacacacgtaacagtattaacagcaacaaaaattaaattacagttatcttgaaatttgcatagcccgaagaatacatatttactatttttgaggagggtagagaaaattctgactgaggagatagctaatcacatgaccatattataaatttgtcaccatattttaaaatattttagaaaaaaactcacaaaagaattaaaaactgtgatttaaatgtgatctaactatttaaatataatgtgatactatttggaaaggctttgtaattttgaaatttaattatcttctgagaaacccatgaaaaaaatacatgaagcagacattttttaggatagttataaccacaaaataaaaagtctcctagaatttacttagagtcgaccagcataatgaaaagtcttggaaatcacaattatagacatgctggtgaattggtgaattatatgagttggttacatgattaaattaaatcattatatttaaatttactgatatgatcacgatattaaatatttacacttagataatcaaactaattttacaacactttatgttttaaaggatatagttactatttttccttattttatttatttattgagactcgctctgtagcccaggctggagtgcagtggcaggatctctgctcagtgcaacctccaccttgcacattcagggattctcgtgcctcagcctcccaggtagataggattacagttgtgcaccactacgcccagctaatttttttgtatatttagtaggggtaggttcccgccatgttggccaggctagtctcgaactactgacctcaggtgatctgtctgcttcggcctccctcatgcctgtaatcccagcactttgggaggcccaggcagggggatcacctgaggtcaggagttcaagaccagcctggccaacacagcgaaaccccatctctactaaaaacacacaaaaaattagctgggcatggtggcgcgcacctgtaatctcagctaccctggaggctgaggcacaagaattgctgaatgcctgcgatggaggttgcagtgagccgagatgctgccactgcacatccagcctgggcaacagagcgagactccatctcaaacataacttgttatcttcaaaagtctaccagtgcaattgaaaatgtgcgtatcatgtaggatgtcactatacttgaaaagttctgtgccagttagatgttgacagcagtgaggatggaaggaaacttgcagtgaggaaagtattgtgtgcaggaagctggtgcagggacaggagagactggtcagctctcagccttccccaactggctcatgggcagtgtctgttttgtctttggattgtttcgtgatcagccttggtctaaacttttattaatcagcaacaaacgtttctgtcaacattgttaaaatgtctttatacattttatcggcttctgccttcatttgctctagtacaaaatacaaatctaccttccttaattcttcttttctcagttgtaagcaaacctctaactcatacgttcaataggaacttgtaattttttctttgattttatagtcatattcatcagaggccaattgagttattctaagagaatgtccttttaaaacacctgtgtctttcataatttatggaggtcaaagttaagttttatagtgtctctagatgaaatgagtcatttagttaatatgctcatgatggctcaaccttttctttaatgccggctgcattttactactttacatgaagatacaaatgaacttcatctattaaggtccccactgctccctccgagaatatattgttatgcttagtgatttgtttctaataggccactgggggaagtgatgggacccaggaatgagttattcaatcctagagtcagtaagcaagaaactttggtgaagacgtagaaaacgcactcaggtgtctagtggggaaacgaagaatgggcttcaatattgtgattttgcatctgccaaacttaatagctttgtgatttgaattattcagcccattggatctgtgtactcctcatatgttattactcctaaaaggaatctggtttattgcacgtgaatgtgcaatgtcaaattttattccatggcatttgagaaaaaaaaaaaaaagtagatccataccacaggcagaaaaaactcatgtttttatttgctatagccataacactgaactgttacactttggcaaactcttgcttttcattttggtaatgacaggagaaaaatagaagtatagaatcattcctccaagctatacaactaatgcattcaaagaatctaatctcttaacctcttgcaccactgcctttttccctgaagaatggcaatattccttattactacctatttacatctaggggtgttatgaagattaatgagatcacttaaatgctttgggttgctcaaagcattgccctgttagggagactgaccctacttgcaacatttggttagcatttccagttggccaggggccagaagcattattccttcatgttggaaaggctggtggcctttctcatgaacctcacgcatattgttttccctcctctgtgctcacacaattgcaagataaagtggttgcctcttctgtaataccttggaggacagccacttgcagggttctgtagatcttactttagtttgtgagtggcccaacacctgggaatatcaattttttatcccctttagaaggttttctctctttttgtaacctttaactttgtaggtcattgacctaaactgtgatggatcaagctgtcttgagagatttcaagtccctcatgttgccagctggcttggaatttttcctacagcaaaaatgcatttggagttgtatgtggggccaaatagttcaaggaaagagatttgagaatagcagaatccacactgtgttttatcagattcttaggttcttgggatgtgattagggaattccacaaatgttttacttatggttcaccttttaaaatattgtttaggccaggcacggtggctcacgcctgtaatcccagcactttgggaggctgatgtgggtggatcatgaggtcaggagatagagaccatcctggctaacacggtgaaaccccgtctctactaaaaatacaaaaaattagccaggtgtggtggcgggcgcctgtagtcccagctactcgggaggctgaggcaggagaatggcgtgaacccaggaggcagagcttgcagtgagccaagatagcaccactgcgctctggcctgggcggaagagcgagactccatctcaaaaaaaaaaaataaaataaaatattgtttaaaatagctgaaaattgtaataaggtgaatactaaactgtttgtgtagtgaggtatttgactacttgggttttccatggaccatagtcatttattaaactaatatttaggccaggcgtggtggctcacacctgtaatcccagcactttgggaggatcacttgaggtcaggagttcaagaccagcctggctaacatggtgaaaccctgtctctaccagaaatataaaaattagtcaggcgtggtggcatgtcagtgtaatcctggctactggggaggctgaggcaggagaattgcatgaacccaggaagtggaggttgcagtgagtcgagatcatgccattgcactccagcctgggcgaagaagcaagactccatctcagaaaaaaaaaaaaaaaaaaaaggaaaaaaagaaacatttaaaagcacctaccaactctgtgccttaaaaatcaaacaaataaaaaatcaacaaaaatataaccaatcaactggcatgaatatacacattaaatagatgttgatctgtgtaagatgataaatagttctgataagtggagttttaatttttttaagaaagcttcatcaactgattttattaacaaatacataagtacttattacatcaatttatactattaaagaattattgtatctattttatatgttgagatttcttttaagattattttgaaataagttactcagttgtgaaaaataacacatgaaaaacacttctcaggaaatgatttaaatttgccataataaaaatacttttgttgaatggccatttattcgtagaacttagttaggcaatgtgtatatctaaacatggtcacagtcttttgggaatttgtattatttaaatacattgagataattgtatagtttatctctttcattttataagttaagaaatagggatattcttagaattaggtatgggcagggagttgttcaggcaaaataaaaagagagaaaagaggtgccatttaaacagccagacccgtaggctcaaactgttctcctcaaggggagacatacatcacagccagatcacagtcccagaggtgaaaattgatggcctaggatcaaaagtttgttattagcagaactaagacttgaattttcttaaaatgatttgtaaatgttgctgtaaatgaccagtgaagttatgaaatggtagtagcataagagctgttactgtgtttgtttctgtgtgtgtgcatgtttggtgcaggtgaaattaggaaggtgacattgaataactaataggtggggccttgaggcataatgggacaaaggacaccaagacacggggggcttgtttctaatcccaggactttctctgaaaccttacagtattggacaaatctcactgcagctgttaatttatagaagttttctcatctataaattgaagggtatatactctttagtgactcttagttcttgatttcttagactctatattattagattaaaaatatggaatggggtaaaataatcaccaatttttatcttgcaacccagaaaatactacaaaaagaaaagttcaaatcctctggtgctttccttcctggggtattggatgtggtgatggtgatggtgctggtgctggtgatggtatttcatagtaactgtgctatttttcctagtaagcatgcccctccctcctctttgccccttcctttcccctattgaatacctctgccatattgatttgttattactgatgagatgattggaagggcaccatagctctcaggtatttggaaggagaagaggtagatggttaaactccactagcaatgtttctggagaggaggggtacctttacagcccattggaacttgagaagcagaaaaataatgatcagaagagttatatttgcttatggaggtgtggactgagaaagtggcgtattttttattataagccattatcttcttctatggaaaacacctgaaaaccggaagcaggtgttgtggatggcgatctctgtgtctcctccactcccctctccaagtagacagagagctctctgcttgatctgcacagagctctacagagcactgcagactgtgctatcgtcttttctcaaggccctgatgcacttccagctcttcctttgtgtatgaaagcttcttttcaagaaagtttctggagacagataccatagtgtgaacatacatgtgcacgtgtatgtgtgtgagtaagcaagaaagaatgaaccatgagatatcaccaaagctcttaggtaattcatttactaaatgaatgagtttcttttattggaaatatttactgaagaagtccttcttaaaattgccagtgggttgaaaaggagtagggtgactggattccaggaccaatgacaaaattaacatagaagttggcaccattaattgatgcttacaatgggtcagacttcattccaagtgtttttcttagatttaaacctcacaacaaccctagggaatgggtttgattattagctccattttacagatgaaaagactaaggcatagaaagaaatgctttcttcctgagattgtatagaggcagaactctggtttttgcatgaatattcttaattgctaggtaatgctgactcccatagcagaggggcagcctcctgaaaccagaaagacagtgggaaatatgtgagggtggggagctgagctgctcatagaggcaacgggtgtacaatggctagtaatttccctggtgccgctatgtactagtttgttctcacactactataaagaaatagctgagactgggtaatttataaaggaaataagtttaattgattcacagttatacatggctgggagggctcagaaaacttgtaatcatggtggaaggtgaaggggaagcaagcttgggccttctcacatggtggcaggagagagaaatgcaagcaggggaaatgccagatgcttataaaaccatcagatctcatgagactcactcagtatcatgagaacaacatgaagtaacccgcccccatgatccaatcacctcctactaggcccctccctggacacatggggattatggggattaaaattcaagatgagatttgggtggggacacagccaaactatatcacactggtaagccccgcttctgaaagacttgtctgtgtgtgtgtgtagatttcttgcttcccttagaggaggtgtgctggtttcaaggtcacactgggtgaaagcttggctaatgttgaaatgcgagtcaccctccagtgccacctaccttggctgcttcaacatactcttctgtatgtgcaccaagttcacatttgttcctctgaaaaggactttttgttgttgttgagacaggatctctctctgtcacccaggctggagtgcagtgacaggatcgtggctcactggagccttgacctcccaggctcaatggatcctcccacttcagcctcctgagtagctgggactccaagcatgcaccatgccacctgactaatttttgtattttttctttttttgtagagatagggtctccctatgttgcctaggcctgtctagaactccaggactcaagtgattggcccaccttggcctcccacagtgctgggattacggggcaatgtgcctggcctgcagatgacatttctgttggagtcctagtcttctcatggcactgactaaatcaaaagactttcctgtaatattccctcccctcagaggtatccttaacctggttctacatagagggctgtagcattataataaaggacaggggaatgtttcctgaaatggctttgtgatggaggtggcatgtgccaagcagtgcttctgggagcttctcttggggtatatcagaggtgagatttgaaaggtggaaagagtgtggtaaggagactattgctgtggtttgggtgaggctgttttcactcggtttagagaggtggtacccccatgtgaggaggcaaactgtgtgaaacctgaatgcccaggaggcaatgcctggactcatgagactacctgaatgtgagcctagtcctctttcatccttcagctgtgtgtgtacatgtgcttctgagtgccggcttccatgggggctttgtcctccctaactctgtccataactcatagggatgtttcttggtcatctcaaggctatgcccttgggcctctttggctgtcacttgtcacttctactgggatatatgtccagtttatatacctacccccaccccccgcccacgatagtgaaaatagtcaacatttatgtcttataggtgttgtaaaaccaataagaagtgaccttggaccagcccattataacagcatccttggcttcttggagatcccacctcgtgctcatttgcatcttagagtttgcttaccattatgtgccagcatgttcttgacattattatttgcacttaggctggctttctcctcccttcctctttggggtgctgctggtgcacatccccgccccatcttcccatttacatgatgccaggatttcagttagaggctgaagcaaagaatactgaggtaggttaatgagttgtttctaaaacctacaacactagagtccaaagcccagtgtaactaatctatcttttttctgtgtcctctactgatctccactgcatgtttcactattcttccccttctttgttgaaattgatattttacttttctctaatttcctattttatacttgggcagtgaaacttgactctttgaagcccttgatgtcatcagtttcctttgggcagaccaccaagttcatgtttcttttcttttctttttaaaccaaatcctatataatgcaagttatatttatgtatttattatttatttatttatttttgagacagggtctcgccctgtcaccctggctgaactgcagtggtgtgatcacagcttactgcaacctccacctcccaggaccaaagcatcctcctgcctcagcctcctgagtagctgggactataggcataagccaatatgcctggataacttttgtattttttgtagagacagattttgccatggttcccaggagcctggcaacctctgcctctcaggatcaaaatatcctcctgcctcagcctcccaaagtgctgggattacaggtgtgaaccaccatgccgggcccaagttcatatttctaaacgtttattacgtactgaatccatcttacaaggtagagtactgtgaacctcagagcattgcttgaattcaaaatcttaattataaaacatggtgaatttaggtgataattataaaggaagacctatgaggaatagttgtacatcatcttaagtaaaagagtttcagaatggaatgcccatgtccttttatttattccatatagatcaagagatccagttaatgacttacacttaccgtaagtatgtacagacacaccccacttattcgttagctttctcaccaatctctaatgtgtatttgttgacctcttgaattcctctttgtactctaagatccaaggaaagtagtgctgaacatattcttagaaagaagatgcttttgaagtcaaaattattattttctttgttcttgaaatttttataaactcttaactttctgtgatctattaaaaataaaactgctctgtttttgtattttgcagaaactacctcttcaggttacagcttgaggatctgtctcttatccaggtaggtgcaatttatttttctcaagctttcattttccatcccaattaactcactgtttgaggggatgaagacagatgcatgtaaaggtgttaatccagcctgagcaggggctcgtttcctcagcaggtcaggccacgggactaaggcggccctacttgttacgagtcattacctcccttaattcctgattagccttttcctcctgtcaggtggccctgtttgttccgtggatgtgatcctgatttgtccttccttagatgacagaccattcaaggaacattgcttcaaagcctggacacattccttcccccacagttacagcaatcatcgattatttagtttgatgcatccgggcatcaatttcttgtaaaacagctttgtttcctctttataatttatattaacataaatatgaatacttgggttaaaagctatctataacaaagaataaagggaaatagatcaaaatgaaatttacctacttctgttgttgcggtttgaacaatggacctgagatcttgtacttaaatgaagtatttattttagtagcagatctgagtcacaaaagcccacttttccctctagtctttaaaaagtgtctcctagaaaataagagagttaagacacaaatatcttcttcaccaagattctggaactccctacagactatgccagaatcttcgggctgtgtagagtttggaaaaagttcttcaaccaattttcgtctcactctcatgtgctagagctctaagaggtgattggagaggattttatattattttattctctctttaatgctgctgcttgtgaacatttagggaacttcagagctaggttttaatattaaatctatcttttacttagcaaggtgttaaaatcagccaatcccctgatcaaagctaatattgataaaaagcaagggctttgaagacacatcaacctgatttgtgatctagttccatgacttctaggaattattggttcctcatctgtgaaatggtcacaaatcactgccaactccatactagcatggcgaaaaataagtaagacgttcaaaagagataaaacattgcaatttatcaagaattttctattattcttgattttttaaagtgatgataataaataataaatctccattataatagttttatcacaattgacaataaattgtctttccactgcaatttagtacataactggagtctttcattgagctaattgagtggtaaaattatgaatttattattaaggaatcagaatgatcagcaatttgaagacattaccttcagtgaaataatccaggcacagaaagacaaaactgcaagatctcacttatgtgtgaaatctaaaaagacaaactcttaggagcagagagtggactggtggtttccaggggcccagaaggtcagggaaggtgttagggagatgttggccacagaacaagaaattccagttagacaaaggaataagttaaagagatccattgtatgacatggtgactataactactaacaatgtactatgtgcttgaaaattgctaacagagtagatttcaagtgttctcaacaccaaaataaataaataaataaataaagtatgtgagatacctgcatattaattagcttgatttagccattccacaacgtatacgtatatcaaagtgacatgttgtacactatcaatatatataatttttatttgctaattaaaaaaagaatgatcaacaatttaatcataatgccattttaaagattgttttagataaccttttctaaaatatatatcgtttagtagatagaaactacatattatactcattttgattctcatggtatactctctggcatatcacttgtgttaaaaagtgaggttttgtaggtctgtgtgtgcacaaacatatatttacatatacgcattcatttctttttaaatttgctagctccgtcagctgagagggtttagaagtattcttagtagcagtgaacacacttgatacatgttactttgtttctaaacttaattctccatgaaaacaaacgaaggatttttttgagaagtgacttaatctagaattgggcaaggagaactcagataagactggaagagcttgttgtttcagaaattaaggaaaatatttaaagaatgatgagggtgtgtcataagaaactaggagccagcttgaagtgggctcgctgaagaaatctggggcaatttgattgtcaaaatagataatgccagaggtagattataacacattgaataacataagaatccatgagtagatgctaacataaaacataaataaatgagtaaacaaatgccaactaatgaatattgaaggaataatttgattaggagattatgatttggcaaccattatactaaaaatcgatttaggcaaaagtgatcaatagatgctaatttatgggtcagagtttgatgacagccaggatatttattcatggtagtcttaaagtacttacctatatgatacttattaattacaacaggaaaacttataacttgatagtaaagaaatctggcaaatagcccatgaccaaatagtcaaaggtcaaggggaacttcaccagcaatgggacagagttcagtgatttgatgcacagaggacgcagcaagatgtccttgatatttcagccaaaaattataaccaaaattataactaataactttatcatgaggaaccatcagatacactgagggacatcctacaaaaaactggcctctacccttcagatatcacgaagtcatgaaaggtatgaaaaaagaagaaataataaagagctcttccatcataaagctcaacaaatagacatggggatcaaatgcaatacttgacccaaattgaatcttgcagcagatatattttttcttactataaaggacattatttggacaactggagaaattcaaatgtctggataagatagtagaaatgtattaatattaatttgttgattttgataactgtaatataggagaatgtcattgttttttggaaaagcatgctaaaagatatagggataatggatatcatttctgtaacttatatcaaaatagcttttaaaattgttatacacatacatacatagaagctatacacatgtgcagaggcaaatataataaagcaaatatgatacagtgttaacaggggaatctaggtgaagggcttatgagagtctattgtgatatttttgcaaattttactgacatgatgtccaaataaatagatgcaaaaaagtgaggagatgtatttccattaactcatgtgtatatatttttgtgaggtcaaggaaactgattgtacttttctcatcattgcctccttggtcttggctgccttcggtggaaatcaggttgcaattattgatgggattgatgagctgttactgaagtataggatgcccatcagtaccaccacgtggtgagagcttagtctactgacatagcaccaagcaagaagacgtgactttttgaactgtggttttaaaaatgcggctctaatgatagaggtcagactgctgtaccattggtgcaaagcagggcaattctgctttttcatattatgtggctgtgtacggagttctgtagcctactgtttacttagtctggagagagaaggctggcaattcatgacacactttttttttttatatcacgtgtctccagcaaagaggccttgttggtttctatgaatattttattttaatttacatgacagttcccaagtataacagaaaggaataagcacactggtagacaaagggtcttataacagtgccgtctgatagaagcaccatgtgagccaaataggtaatttaagatgatctgctaggcacactgaaaaaagtacaaagaagcaagggaaatgactactaacagtatattttactacctcaatatatccaaaatattttaatttcagcatagaatcattgtaagaaattaatgatctgttgcactttttttttttttttctggaactcagtcttcaaactccagtgtgtgttttatatttccatcacatttggatttggaccagctagagttgaagtgttctggatcgctggtgcgccccattggaaaacacagttttagataataagtgacagaacgtttgacttgtgtgctttcaattattacatagaaagatggttttctaccacaaatcatgggggttgatttgtatatctcaggttaatatttttctccttttctctctccaaagttaaaaattattgtttaaatgtagaaaaatgatgaaacagatcaaggaggacaaccaatttcaagaaaactggagacaatgagaaatgaatgtagttcaccagtaacctttatttaacactagacaaggcatccttgggtcctgcccctatgcaggacagaggttcacctccaggtggcagtttgcattacctgtgactctcctgatcacctgagggcagtttctaccttgtctggtcatgtcatgctgcatattgttttccaaactgtaggctattttccaacttgaagcatttgctcttgctgtcctgtctcaatcaccttcaccctatttatcttcttcctgaagaaaaagactgcccatccttgagtttcactggagacaacacctctttgtaacccattctgtgcctgcttggctggtgaccctctgaggcatttcacagcctcatagcctttacttctgactagtacttattgtttcatgttgaaattcattctctgtgttgtaagaagtgttttctttctttttatatgttcagaattagatgatattattagattaggttacctggaaggtggtagagtcaaaacagatggcttacaagtttctgtcccttagtatttaatatgcttactcttccctaacctttttaaacataactttaatggagtgggaggtaaacatcatatttttgtccctaaattcaagaaaagaaaagtaacgttaacccagaagctagagttataagaaatgctttcagaagagacatcctaaaacacacatgtgcatactgtcaccccaggggacaattcgtggatgagacaggcaactcctgactgatatattcattccttacatactaaccacttgtcttctcaatactgttttacaattttcctctctcccaaattttttctcctgctttgacattggtttagcaacaatgatgagaaagcggatgttgaataatgattcttcttttttcctacttagtgacattcatagaattctggagaccccactgcattgtcccttgtcaattgccctgaaatccagggtggtattttccatccagcagccagcacacttcctggctacagtaggagcacggggacaccaccttagtgcaccctctccactcctctcccaccattctgtgaccttatgatatctatcaaagcactgtcacacatggcggctcagctctgtagaaccatactgaaattgagtgatgagaaaaataggcttttgtggggtggctcccaaaggagaaaactcacttccaagacaggttgcctgataaatctggtgtaaggaatattttggacatggagtcaacagtacttcaaatcggaagtctcttcccttttgccaaaaaaaatcttgtctttttgacaaactagaaacatcactggtggaattgctaaagccgtgaagatttgagcaggaattgggatacaagtactctgttaccctgagtgaatgttatctgtatgaggtaaatctcttggcatgaccatatgaatattcacatacaaatgtactatgaagtaaaatggctatatttggaatatttcttatgattttcagacaggtatgccttaacatattaagagaagatgtctcttaacatttaaagaccaagagttgcttttaatttaagaaaataaaacctgtttatcatcaatgactagagaatcaaatgttaacttattttcacttataaggcacctgtttgctcagagactgtgataattttttttttttttttttttgcaactcactgcatgctgaagtttagccatcccctattgaaaaccagtcattttcaggcatagtgatggttggccataatttgtttcttttacctcatgtcataataacagattcaaatcttcagtataagttttcttcttgccttaatcatggagattattttataagaacaaagctttttgaaaaatataaaaatggagctggcctcagactaattcacagcatttgcccatctgggatcctaccgcagatggctggaggtagatgctcactgaacagagttcaaaaaacacaaaggggctggagctcatttaacctcactgtcttactaaaattcttttgggaaatagctccaaatccatttttatattgttttgtttctaacggaaataaattcactgcttgtttctcactcacaaatgctgggataagcagaaaaaatgaaatctgtgttccaatttgccacctgcctctctatggtttctaaattgaaaacttaaatctctctgactacatgatcaatatcggtagagaattctctccaaagttaaagtggatattaacttctttcttctttttattttattttattttattatcattatactttaagttttagggtacatgggcacaatgtgcaggtttgttacatatgtatacatgtgccttgttggtgtgctgtacccattaactcatcatttagctttaggtatatctcctaatgttatccctcccccctcccccgaccccacaacagtccccggagtgtgatgttccccttcctgtgtccatgtgttctccttgttcaattcccacctatgagtgagaacatgtggtgtttgtttttttgtccttgcgatagtttactgggaatgatgatttccaatttcatccatgtccctacaaaggacataaactcatcatttttatggctgcatagtattccatggtgtatatgtgccacattattaacttctttcctgtatatctgggttggggggattgagtttcaacgtgagtcaatttttagactagaagttctcaacttccgacaatttcaccttctgggaatatttggcaatatctggggacattattagttgtcacaactggtgggggaagctttgactggcatctagcgtgtagagaccaggggtggtaccaaaccttctacaatgcacagagcaggacccccccgttgagcgaaatttacctgactctgaatgctaacagtgccaacgttgagaaaccctatgttccttgattgttgcctcagtttccacatgttttaaagaagccattttctaatctgtgatattaagattacttgattgaacatataagatctttgatgtgcttagggaatttttcggtttagatttctatgtatatatgttgaatatatatgtctccacatatgaagaaatctaaacactaaagattcatatgtgtgttcatgtatatatatattatatatgcaatatatatattgtgtgtatatatatacacatatacatatgtgtgttcatatatatatatatgtatatatgcaaactatgaatctttagttgccagttctaaagaagctgctgggattcttgtgtttaaattacttccttttattaatatgaaattaaatttaaaaataaattgaggcaatttataataccctctctaatgggtcataacactataatataactaccctctgttggaattcttctgtataatttaaagcatgatatattaattaataatttagaataactattccaatgagatattcacaatgattaattttttaaattatgttttatatttattgggcaaggagagactggtctcccccacagctctcaaaaatcatgattctgagctcatttatttttttgcctatctttgtcatatgttcttattgtcatagaagtggattttaaagattatttttattaaaatctttcaggagttaacaactaaggtatgttgatcatagtaaaggtattattggaacatagccattcatttgcatgtcgttggcctataataatagttaatgaagttttatttggaatccagacatattgttcatttttttttaacataacatctatggctgctgttcagctaacttgaccagtagccacagagactgcctggcctaccaagcctaaaatataaactatgtgactctctcttcctttaagaaaaagtttgtcacctattatggtacctagtactcggcaagttctcaatgaatatttcctgaattgatgagtgaacacaatatgactcagtatttttttttagtttatcaatgtttgattgctgtgtttatttggactcgctgtgtaataattacatgatccccagttgatcttgacccagaagttggtaacctgagacagcgttaccaacggtcctcctcagattctaggctcttatatctgttcccttggtgaagattttctgtcagatgctgttttatataccgatttattcaaacatatttactctactttttaaataacgttctggaagatttatagttgattatgtatattttatgtagatgaggactaagattttactagtttcagagaatatgaaccaagttaactgccattaaaacaactgcgccctcctagaagctgaacattcacatgcagaagacttattcctccctcgcaagtgagtccagtgcagtctgtggggcttggttccatgctgccgttcaggatcccacagtgttctcttatggtatcccgtcttcaatccatgcctccagaggcagtagggaagaaagacaaattcgagtggaggatcatgcaaaggatcatgccatgccaggaagtgcatcccttgtgcccaaattccactggccataactcagtcacataacttcaagaaatcacaaggcaggttgggatatgtggtttgtatgcattcagacattgacagatattagcattttctcctagtctgtgctagggaaaacaagaccggcccctggggatacacttaactgttccctgttctaccctcatcccaccccgccataccattctaatttttttgctacgtaccaacagatttcttcatgattctaacatttctgtaaataacaagcaggaatactttgagcaagccacttaacctctctttacctcaattttctctatagtacattttggagaggacagccaggaagaagagtacactggatttatccctgaattctctgccaggattaaatttttaatatgcatcatccttccacttactctttcttctgtcttgcttaagtaatgcctgaactcctgtttaaggaaaacattccctactaatttgaaacttggcattatgcttatttgatgtaactttaatgacctaatttgtcatgaaatcatgatgacagcaacaaaaataatagcaggcatcactcatcctgcccttactctgttcttggcactttgcaagcatcatctcatcgagttctccagcagcactaaagtgggggtattattttcaatattcaacagcagaggagttgaggtctacaagtttatgtgatttagccaagatcagccatctgataggtggtagagctaggatttggacctgggtgtgtagggctccagaggacaattgctgctttattgtactcatttgtactggccagcatacgacctatagttgacatctggcttacagtgaatataaccgttaatttttaattgaaattcaaatatgggttttaggtttggtaccctggaaacacagtctgagataggggttctcaagcatgtgatttacttaaggcatgctctcaaaaggtagggagtgtgtgacatagcaaagaaaggaagtaggcaaaaatttcctgtcagctggagtatagcctcaacccgatcccagatgcagctctagagcatatatagaaccgctgttaatcccatttgaggcaagggctgtggcgatttataaccaactctcccttgttcttcggctgccacatttggagtgtttggtgacataacttcctggtgaggtggctctcattaaccaggagcaattctccagagagttgggaagctatgaaccaggatcagctaacagtgacagcagccagggatacagtgtcctgtttcataagagctggatggggtgccgatagcacccactatgattgataatactcaatacttttaggtatcttacttagagttttcttgatgttcctgactctgaccgaacagacactagtctctgccactgaaatgaagtgtttttatgtctttgacaaaaaagtacatactttattattgaattcattcttttgtgttgtgcatatcttaatttctaataactctctttatccatttctaaattgttgctttgcttgtggcctcaaaaactaaattgaagatgcatgaatatatttgttagtcatgtatatcatttagtttcatgaaacgaagtcaggcaatttatgtaatccaatagcaaacactgtctgacaatcacaagctgctagataaatggaggagttcatttcatttatctaaaatgcatttctccttctatgtcaaaaatggcccccataagtgccatgactgctgagtgatgggcatgctcagaattctctgccctgtgttcatttcccttatctgtatgtcccttccaaaatgctaacaaaaataaataagccaacataccaggaaaactcattgctccaaattttagtaatgatttcttgtttgagtaagagataatgtgttctgtaagctgtctcccaattacctaagaacaaagtgaaaataaaaagcaaaggagaaacataaatgaaaaaaaaaaaagtcacattggctgaccactctctggagtggatggattggaacccttaatttgttgactctttaacatgtaagccatttgtcatccagaatttattgataactgtcacagagatgggtagagtcattgtggatagggctgcaatggacaacacccttgtttaacatatgtttgacaaacaatccttttgctgtgctctcatagctaacctttaagagtttatataatacttcttcattagaacacaatgtttaatctgcttgtatcaattcttactgttgtgggggctattgccactttttcaagtgatactacatgatcccttcaatgattttatatgggttggttgctcagtttaatttttgaaattcaattctactttcaatttttggcaatactcagttattatttacatgcatcttagatcgcagaggcaagttgcccatgcagaaattccctactaagaataggctgctttatacgaaattaggcatgactatacatgtaattttggtaatatctggagtccgaagacctcatgcaattcattgcctaagaattgccaagcaccatttgaataaaggagcatcaaaatcaaatgcaattttaaaccatagccattagtttctgattcaagatgaagggaacctatgtactgttctttcattgatttaaaataaagcatttaagtgacaataaaggtacatcaaaggaaaatctctatgaacacaagagacaccctacccagctctccttatagaacagggcaccctatccctggctattgtgagggttgtttgatactggttcatagctgccccttcctctggagagttgctcttggctgatgaaagtgacagatgatacagttagtaaagttagcagaaggtaactttaaataattatgattaatataaggaagaaagtagaggataatttagacagattaattaaagagtggagaattttaccagaacattagaataaaaaagaatcaaataaattttctataattttttaaaaacaaataatatctgacatatggaactatatgaattattttaacagcagattagacatagcagaaaaaaaatattgtattagtgaactggaagaccagtctgtggaaaatattcaaactgaaatacagagaggaattggaaagggtagataaaagagtattagacacacatgacaccttgaaaactctaactcacatacaacttgagtctcaaaaggagaaggaagaggacaaggcagaagctatgtgcctggtaattatcactgaaacttttccaaagtgatgaaaggtatcaactcacagactaagaagctctgcaaacctcaaatacaatagataaccacaccagcacgttatagtcagacttctgaaaactcgtggaaaagggataaatcttaaaaataatcaagtaacagaaaaagacataaccttcagaggagtaaaaataagatccatagccagtttttcaagagaaaccacaaactcaggagacaatggaagaagcagttagaacccagatcttcctgctcgctcactttgtgtctcaacacagttgttcctctgccatgctggaagaagacagtagtgcaattctggaagatgacaaagctgctgatatattggaccaggggaccaagatttcccctgagaacttcccttaaaaaagaaggggagaattcagtatatatgtatatgtatgtatgtgtatatatgtgtgtgtgtgtgtgtgtgtgcgtgtaaatatatatatatatatatacgcacacacacacagtatatatactgtatattgagatcctagcccttctccccggtgttggtgtttctctttgcatatattttatatgggttttggcgtacacttttgttggtatctaatcagcttacaactagaaccttaaggatagtgacatcggtggtcactctaatacaaaaaaatcccacccagattaagcaatgatggctggtctacaaagcaatgtgggtgcccagctctaatgttcttgcagttcccagttacgaaaaacacagagtgaaccaaattaaataagaaacttggaagacagagagacaagaaattatgatgaatgtcttctgaaattagagaagatattactaccatgaaacaaggagaaaagaaatattcagtgtatttcaaaaggcttcatagattattttgaaaatatatgatcatagaaataaaaatatccatggaaaattagtaaataaatttgataaaaatttcccagaaagttgaataaagactaagagatgaaaaatcaagggaaatatatgaatggttaacacactaggcccaggaaatagaggctccaatacaggcgagagggagaaaaatattcctgggatgagggcaaagggagataattgtggaactgttgtgcggcgggccttgggagccaccagtccaggttggagtagatgatacagttaccgaaggcatctttccaggaggatatcaataatgggatatctgaggtgtttgaatgcatttagacaaaaaggagacttacatttcggtgtgggggacaaaaagataataactacatagaaaaacaagagacaattattaactctaagaaacgtataattgttttgagaaacaagatgtagtaaaatcttatttcatggcccatctgtgaagagtatttgcatagttatgtaggtactgcatattcctacagaatcatcataaatcaatactgagaaagtgggggagggagcatgcatctatgttgatggaggaagagggataaagtaaaaaggagccagtgaataatatttctaactgaaaatatcaagaaacagcagtaaaatattattagttacaaatttggagaaaaatacataaataaaccagttaaagagttgaaagtttttgctttaagcaaactatataggctgtatgacatagagggctttctttattattttagatcttgcagatttctttatgaattgagtgtatgtttaactttaaaaataatataaagatgatattatattcataaagtatgaaaagactgacatgaaaaggacaaatcagatcgataaagaattcacaaaaaataaggatatgttctttcatagacatagttcatcgaaaattattaaggaacaaattagaagattctataaaaatgactttatgagaaaagtagatttttttacacaaatcacaagtttaacaaagagaaagtgttaattatatgaagattatttttatcactaagaaaaatggaaatactattggaaattatatagacaacaaagataaataggtatacaagagaaaacaggcatccaagaaaactgctccaattataaaacaaatagggttattttgagtagttgagtctaagaaatgaaaacaacaaattttggtggaacataaacaccacagtctacttgtgtgtaatttctcaggctttattatagttcatgataaaatcaattttccatgtctattttgtttttcttcaacaagtgatctatcttttacaaaagggaatattttgctggagaaatgctcattgtttcccttctgtatgtctttgagggtaatgctaaaagcaagctcaaatttcaaaatatgttatttttaaaatattttatataggatttgttaaacttatagttttcaaggattgtcttttgtttctttggattctgattaagtgatttttaatgtattcctttaaaaatatttattggcacattgtatttgtacatattgatgggataaaattgatgcttctgtacatatatatttggcataatcatcaaatttgggtatttagcttattcatcacctcattcatttatcatttctttatggtgagaacattcgaaagtctctcttccagctattttataatatattatacctcctagaaacataaatgtatgctacaaagaaacatgtatctatgtgtgtaaacttaaaaaaaattaatggtatcttttgggaagtttttaggagttgatatttatggtgaagaaatatgaagttcaggcattctttgaatctatcctcaagttctttttaaaatatattcaagttcccagcactttgggaggccgaggcaggtggatcacgaggttaggagattgagaccatcctggctaacacggtgaaaccccacctctactgaaaatacaaaaaattagccgggcatggtggtgggcgcctgtattcccagctactggggaggctgaggcaggagaatggcatgaacctaggaggcggagattgcagtaagccgagatggcgccactgcactctagcctgggcaacagagcgagactctgtctcaaaaaaaaaaaaaaattatatatatatatgtgtgtgtatgtgtgtgtgtgtgtgtatttaagttaaatttactatttgaaataagtaaattagcaagtggttgtttccatgtggtgagtggtttggatttttcattttatactttaccataatttcccaaattgtctgtcatatatatgcatgacttatagcactagcaaaggctaataaatttagattgattcataaagaaaacaggcaaaattaaaaaatctggctttgaaatttctatctacattataattagtatttgtcaagcggcctctttttcttcctgctgtttagagcctaagatgagtcagggaaaacacattgaactaatggatatgtatcttctttctcaccgtcagcagagttccctactctgctagcatgtgacagtaggtggttctatgtcaatttctaaaggtttatctttgtctagatgtgttcaatatcgatattatagcatcttaggtgcttgtgctctgagatcatgccttgatgaacattgcatatttgcactgagaaacagctgtgaattatccaggttcatgagcataatgaacacatgaatgagagcatgaaatgaaatgtgctgtttctaccactatctgttgtttagccccaccataaatgtaaagcaagtatgagattgagtttggcttatgtgatggctcagttctgtaatgacgtcattgtatttagcagacagctgagagatgatccatgcgttagcctgtaaggtgcatctgtcagtgccttatttatttttctgggattgccaggactctactccctgtgacttgagcagtattgtcagtgatatcatgcagtaggctgaaaaatggccctccaaaagatatctaattcctgaaacttctaaatgtgaccttacatggcaaagatgtgattatattaaggatcttgaaatgggaagatttttctggattatctgggtgcctcttagatacaatcacatgtgtttttagaagagagatgcagaagaagattacacacacacagaggagcaagccatgtgaagatggatttgagagagatttgaagagatgggctttgaaaattagagtgatgcaactacagctaaggaaagctggcagccactcagagctgcaaggggcgatggattctcccctaggccctcctaggggagcatagctctgctaccaccttgagtttggcccattgatactgatttctgacttctctccagaactgtgagagaataaagtcatattgatttaagccaccaaattgctggccatttgttacagcagccacaggaagctaatatgcatggctcctctttctcatatattgcaggtgggcaggtctcccaggaagcccaacaagagaataatatcctctgggtcctgagtgctgtaaatgacccaagtgcccttaatcagtggcctttaatgacattgcactgtgcctgagagctgcaagaccaatttcttctttgcaatcatgagctcaaagagtgacgtcaagtgcaggctacttgcagccatcttgtcaccatatggagtctttccaagaagaaggcccaacagaggccattgtaactaggagtaagaaccatggaattcttacagcatactttgactccctgagtttatgcttgaatctgtgcttttgtttttggcgtaacctagttggcattgagtttttatcacttgccagagagcctgaagggcttgcgtaatacgattttactcctgtctgctgctcacattaaaacttctcgaaacagatttcaatgacgttgcacattttgagacacctgatgcttatgaattcgctgcctaaaatttatcaactctgagataagaggctgtctttagaaagttgtctgtgatacaaataccaagtgtgactttcttctgtttaaaatactaaacattacctttggtgaaggaagtcatttagctcatgtaactcatgagaaacacttagcttgttaatatagttgtcaaagtttttctgaagtcacatttaaaccagtcagttctggccattagagagaatataagttgtctgaacatattatctgtttagtagtgtattagctttctagggatgcaataacaaattaccacaaatttggtggcttaaaaacaactaaaatctatccttttacagtgctggagcctggaagtcagaaactgagatatcagcagggctccactccctttgaagactctaggggagaaagcttcatcgccttttccagttctagtggctccaggtgttctttgatttcaaactccaatctctgcctccatcttcacatggcttcctttgtgtgtctatgtgtctaatatagccctgaactttcttttataaggatacttgcaactggatttaggattcaccaggattatccaggatgatgtcatcttgggattcttaattacatttgctaagatcctttctccaaataaggttaccattacaggttccaaatagatatatgttttgggaggccaccattcaacccaattcaggtagtattcaggagatcttcagaagaaaatattcctgggtttatgcctctttgtttggaagagattctacctacccatggtgacataaggctactcctgtattatggctgtaagatttgttccaaattactatcctctttttctccttctcagagtttcttcatctcagcactatggaaatgtaggtcagataattctgtgttgtaggggactatcctgttcagcacccaggacatggcattagaaatgaggagaaatggccgggcgcagtggctcacgcctgcagtcccaacacttttggaggctaagacgggtggatcacttgaacccaggagtttgagaccagcctgggtaacatggcgaaaccctgtctctacaaaaattacaaaaattagtcaggtgtggtggggtgtgcctgtaggtccagctacatgggaggccaaggcaggaggatcactggagactggggagctcgatgctgcagtgagccatgatagtgccagtgcaccccagtctaacagagcaagacctgccccccgccccccaaaaaagtgaggagaaacaagagggcagaatttcagttttctttttgttcgtgttttggatgtcatttcagtactgtaataatatcttgaggtggcagcattgggaacttctggctctcattagagcagggccactgaggggccttaaaactcttctgttacatctcagctacatttggatatctgaggcctggccccatcagggaaggagacgtgaagtatggcttttgtctgtgccatttggagtaagcacactatgttttcctgaaaatattctttggcattttagagtttcagttgggagagcagagaaaggtgttaacatttatggcctccttcccaaaacctgttcaaatgacaggtgtttgtaaatgatcaaattctgcctaagtttatgcctcaagggatgcttaaagttgacatctgagcccaacgctggcaaggttgacttgggtcactagtgaagattttctgccaagtcttcctctcccactccactggtcagcaccccacccaagattggaagctggtaaaaatacaaggtcagctcagagaaagtcccctgcaggagataggtgtgaactcatcatccccaacttgcctttctcctgggtgtttgcttgatttcctccaactgaattcaaaccttccaggcccatctccacttgctatttcttttgctcgacactgaacatcttctgtctatactctccatccacatcaattcctgccaggtattattttaatagtctcccctctaatgccaggctccttcttcacctactctcttacccgcagttctaatatgagattccccattccaacaggattagaccagatgaatagatgatctctaagggccctttcagctctaagactgttgagatttgcgcgcacattaggtaaagatgcccccttcttctgaacagtgatgcccaccatcaatgtttaattaatactgaggatgccacaaatctaactcactctgcttttaatggcaggttgactgtgggcttagtttatcaagcctgtccaaatgactaactggatggatattatgcccctaaaagctccataagggaagtatgcatctagactgattacttctcttcaacagtgggcagagctgaaggctgtgagagttcattactgaaatgctgtgataatggtatttcaaaatcttataacaatggggtattttaaaatgtttgacgattaccttccttctttactaaggatgtgactcagtatatatttaaagctgcaaaaatgtcagctaccatcacagtcttgaaaaagaaccttaatctacagatattttccatcaaactccttattcaaaactctatgtcaaagacagaactgaccttatagtcaatattcttaacaattgaaccaatcagtacagcactagaaacttaacctatgtaagttttaaagattacttatgtatttttgtttatttaggagagaacttttaaaaaaacttagaagataaaaaaaggactgggttgtgatacttctgttctacgcatgtgtattagtttcttagacctgctataacagagaaacaaaagctaggtggcttaacacaacagaaatggatgacctcacagttctggaggcctgaaatctaaaatcaagtgttggcagggccatattcttccctaaggctctaggggagtcttcttcctcacctcgttagctgcaggtggttgccagcaatccttggcattctcagcttgtacacacatcaccactcaagccttttggccatcttctcctgcatgtcttcacatcctctttcctctatgcttgtctggctcagcatccaaatttccctttttcataggacacatatggattatggcccaccctaatgatctcattttaacttgattacctctgtaaaaacctaatttccaaatgagattatttgttaggtactgggggttaggacttcaccgtatcttttggggaggacacagttcaagtcataatgacattagtataatttttgatgactagaggacattttggtcacctaactttatagctatatattctttaactctatgtgtatttgtgtgtgttttagtttatataggctgttttcccaaataccctaggctgggtaacttgtaaacaacagaaattggccaggcatggtggttcacacctgtaatcccagtgattcacacctgtaaccccagtgatttgggtggccaaggtaggcaggtggcttgagcccaggagttcaagaccagtctgggcaacatggaaaaaccctgtctttactaaaaatacaaaaaaaaaaaaatagcttgacatggtggcatgtacctgtagtcccagctactcgggagactgaggtgggaggatcatttgagcctgggaggttgaggctgtagtgagccaagatcatgccactacactccagcctgggcaattggagtgagatactctctcaaaaacaagtaaacaaaaaaaacagaaatttattgctcacagttctgaaggcctgaaagtccaggaacaaggcacctgaaggttcagtgtctgctgagggcacacacatagtggaagtggcgactgactgagttctctgattccttttttatcagggcactaatctcaatcagaaggtgtcaccctcgtgacctaatcaccacctgcaggccttgagaggttaggatttcaacatatgaatttctcagaggacacagtcattcacaccacagctatgtgctcctgcaggcgtaattccccctttgtgaaatatttgagtcgatagaaaaaaaacttaggaaaaagtatgtgtgtatgtatgtgtatatacatatgtatgtgtatatacatatgtatatgtatatatatatgtatttttttaggttgaatttgtcactttccaacattcagctattattgcattttcttgggtgaccaccatccaatactgttttcatgtattttctcataatggaagctcagccatgctgattttcttctctgagctttagctgcacctttttggttgtctcccagaaagagatcaagaagtttccgcccatagtaactcagtaatccattaaagctccctaaggaaatgtttttatatctttttttttttttttttttgagatcacagtttggagcataatgtctcacctgtaggaaatatgctgtttctccttccccttaccctcctttcctgcctgttactactgcctgtacaaatcctgaaatttaaaaattgtaaaatactacagaagacattttttcataaagaaatcctgaaatttagaaaccataagcttttactttttgaccggcctgctttctgaatgatgttttatatttggtccaagactttcttaaatgaagattcctttttgtaattagagaataacaggtaaccaaattaagcttgagcataaaggtatgaaatacataattaaaaaacattttggcattataagatttgaccacattaattgttaagcaatgcatttgtgaaaagtacagtatttcaaatagaatacagagacttttctatttacatataaaatgtatatttatagttataaattatgtcacatcatgtacttatagctgatgcaagaagggctcattataaatatattacatttagctgctttaaaaagaaaacagtgttttaccagtttttgacaaatcgcagtttaccacagctggttaaatataattaatatatttgaagatttatagatcaacctcaaagatatgataagcctgtaaacggatatacagatagtaaattaattatacattttatacactaatagcctttattgaacttttaaaataactgatatttttagattctatttctttccttctgtggggttcaactctctattttcttgccccaattacacatccctttaaaaattggcatgattgtatttgtgattttaagtccttagttatcatgcatcacattaaaataccccttagttgataagtaattatctggttgttccactggctgattggggctgttatttggcatatggagacaaagtgtcttttttgattattctacctagaattaaagaaagcattgggtgatatttggatgagaacaatgatttccactcaggtcgtctggatgtgtacaatgtaattctctgaagatatataacaaaataaagaggttaagttttcctaaatcttatgcatataatgatgatcatagctaatattgagttattattttatatccagctttatggtaagagctcagcatgcattattccatttaatcttatcagtgcttatatttgataggtatcatctttatcctgattttgcatgaggaaatcaggtcagcatcaagtatctgcagccttggtgcattccagattagctctcagaccacctggctccagctcacatgctgataactttctgccataagctctgaagagtagaaaatcctcctcctcctcctccttccccatcactcgtccttctccccagtcactcccatgtaccacctagacaactatcaaattctgcccagcctaagattcaaacattcagtgtgaattatttggcttcccatctttctctttgttcacttaattttgaaaagtagatggagtttgcaaaccagaattccaactcacaaaggggagtttaatcctaggcactgcctctgtcaatagcatcagcattacaaaaggcagttaggatgagaggcttactgtcttttgagcacaggagttctagaatctgttgatcatcagattcacccaaatggacttttaataatggaaatccccaaatcctttttatgcttactgaataagaatttggggtagcgggaatccctactttgaacatgaaccctgggaaactagagctctggagcctgttgtgagtcatactttgtgggaatggaccctgacaggggctatgaaaatagtgtatccgatcccagaagcactggagagtagcagggagagtgggttttgagggtctggatgtgtaggccagttatagggatggaagacaggaagttgtgctttggcgctagtgaccttgagtgatggtgaggattacagtgggactttcttgtgggtatttgaaaggctaattgagaattctggtggtggaagagaaggaggggagggatgaaggaggaaaacagaccaagtgaaagtgaatgagtgagagacataatgaatgaatgaatgaattgttgaatcaggtagatgtgaaaatggggctggattattggctggtttggaagccatttcttcattgagacctctcagtgtaaaggaagagtggattatcttctccatgggggaagtgtttagaagtccaattccctggacaaagcagatgacatatgttgtgtttggattctgagtggttaagcaagtagagtgctcagtaaatctagggagagttttcgtcaaggtataaggacagcactaggtattgagacattccaagtgtagagttcagcacaataggtgttgacatgaaagaggcatgacatccatatttgtgtgaggagcaggcaggggaatccaggaaggaacagggttttagcatccatctcgtggcatctggcagaactgtaatttttgaaacgaaggccagggtcccctgccccatttttggacagctttgatgatgtggatggaaagtggcccatggttgtgtgcaagtccacagagtgaggcaggttgggggtgctggggcttatactgtaggcttaatgcctatgaggagtcatggcactttgaagtcccaaaccttgagtggctgcagccgagctgagaggggaggtgacgatgtaccggaaggccaaatgctgtctggtcttatttcaaagacagggagacaagatttggagatcacccattgctgtatgtgacctgagcttttgttccctgtttcattttcatgtctctctttttcctttaattaaatgattaattaaaatgtaatgtgttttcaattcacttataccactattggcagagggactaccctgtgataagtcatggagaataactgtatggactgcaattgggatcttacaaagaaaggaaccaattgctcattatttcttttctctatgttagtttacagctaatgtggccaccaacagtattactattttttatttaattatgtattcacttttgcaaaaagtacctacccaatatcccctccacctctagcctaaacattattactaatttggtttaacagtttctctagttcaagtactggacatagggctaaattagacatatggcagatcaataattgatgtaaataagcctccattttggaggaggagaaagaaaagtaaaagagaaattagatgatcaaataacacaagtgcaacaggcatgaaaggaaaattacacaaacacaaactgtgacaaaatatgcagaatttaataacatgtattagatttattcctactgttaaaaagcagcaattactgattgtccatacagtgagtataaaagctggaatgttgaccattccatgttcaaaagttcaagtttgtgtcccttggtgataacttcctcttggaaattaaaacaaagggaagtttatttttcatatggccctgggtgaggagatggcttcttaaacccttaagaagtaaaagacactcaaggaagacattttctcagaaggaggcagttacctggatggctttgagtatttcatttcaagtattcaagaaattagaaattataaaccgtgttgacaaaaagatatcagatgccacctccttgcactacattcttccaggagagagagagagagagacctgagagctctctagcagctcacgttccagttgacaagataagatttatggacctgaaaaatgaacagtggtagtggcagtgccatcacaaggtattcagtgtgggatatgaaacagtgctaccaaggctcagagcagggagaggagatgaccacaagaaaggatgatcagggcagaagaaacgcctcgatcacgtttcgcatcagggtttctgcacctgcacactattgatgttttgggccagataattcttggtcatgggggttctgtcctgtgcagtgtaggatgtttaacagcatccttggcctgtacccctagatgccagtagcacaccccacacatactagtaatgacaaccaaagctgtctctagacacttccacgtgttccctggggtgcaaaatcgcacctggttgagaaaccctggtctacacaatagaaactgcttcaccttttgaattactcatataatctaaacagttgatttttttctttgtatggacttgagtgtgtattttcaaacaaacatggttttttttgcagcttttattgaataaatcaccatgaaaattgattgtttaaacttggaaagaattttagaatagttaatatttctgtaaattccctttggtttatggaaattcaccatttatttacctgacatcctaactacaatttctgtattaataactgaagacagtaatgaagagggtttggggatatatgatctgagtagccactgcctcaacttactgggtgtgtgtcctcgggcaagttacttaatctcactgtatttcagttccctctcaggaataatagtaatgttttccttaaggttttagattgagtaaacgagttaacatattgttataactgtgaattttataaatcaagtatatactggtaactaccgtgtttgaaattatttgatgcaatttaagttatggaccataaatgggctggaggattcacagaattgatttacaaacgtgggatgtcaggcattcaacaaagggaaaggagggttaaatacttgtataagtccaagaagtcattatttccatgtttgacatcttctaaacgccactgttgcttctgcttcagttatagtgttgaccaaaagtagcctcgaggactcctgaggcaggggtgacagccagccatctttctagggctgcagcctcaccgcaaatcccaggtaggggaatggggcttcctgtatggagacttgggatgggcagggagagaatcttgactagacatccttacttgtagcaaaataatgacttcttgtttcagttattaattgctacctaatcagcaccacaaaacatagtgatttaaaacaaccgttttattttgctcacaattttgttgatcaggaattccaaaattccaaaattccaaaagtcaaaaaaaaaaaaaaaaagaacttggctgagaagtttgtttatgattgtgttggcatcagatgaggctgcttggactggaggttccatattcaaggtggttgatccactcacagggactgcatgccattgctccttggtatctgtctctgtctcctttctctctctctctctctttctctctctctctctctttcctgcttctacatcctcctttcttctccatttgtcattttgcccaccatgtcatctctttattctctcctaacatggtggtctctggatggctgaacttcttacatggcacctgccttcaagagactggaaatgaagcttccaggccagttaaggccatgcctggaactggcaaaggagctcttcggtcatattttattggtcaaaggagttaggctttccagaatccaaggtggtagagaaatagactccagttgtggatggatgaccagcaggttgcatgcaggagagcctgtgggggacatgctgctgggaccatccgcgaagtgcaaaatctgccgcatccagaacttgtttaaactctgggttttgtgactccacttctcattgattctgactccagtggccaagaacgaccatttttagcaaacatctaaatgtgattctgaagcaggtagtctagagtcaatagcagtgatctcaagagacggatggaaagaaaatgggaaattctgtttctagaatgtttataccacagcaatgtaaaatgtactaatattaaaatgtaagttgatgctggtgcctcacttgctcaatatgtcaagctctgacacatgccaaagtgagtttctaaggcatcctgagggaatcagggaaatattggaagggttttgacttacaagttccagtaaagtgcatttttgtgttatgttatttaacatgggagagtatttataatgttttgaaatgaggtgggaaagaaccattattttctgttttatagggagggtctctggatacctagtggcaacatatttaaagagctgtcattaatttaagatattgaaaaattgtgaagcttaacgtcaatggatgtgtatgtatatacacatatatcaatgtttctgtatatctagcgctatcatctctatgtacctatttctccttttttaagatataagggatctaaatttgctgaacttcctgttatttttaatagtatgatgaatagtaggtacctgtagaaaagaaattgtcttgtttcacaattaatgagaccgtaattgctttccaaaagaaactcatgcaatatagcagcacaatactcaactgcaaaaatattgaaccaatccaaatgcccatcagtcaacaagtagataaagaaaatgtagtgtatatatatgtatatcataaaaatgaatgaaataatggcatttacagcaagctgcatggacctggaaaccattattctaagtgaagtaactcaggaatggaaaaccaaacatcatatgttctcactcataatgggagtgcttaactataattattcaaaggcataagaacgatacaatggactttgaggactaagaggaaagggtgggagggggtgagggataaaagactacacattgggtacagtgtagcctgcttgggtgataggtgcccccaaaatctcagaaatcaccacgaaaaaacttattcatataaccaaacaccacctgtttccaaaaaacctattgaaataaaaaaattaaaagtaatttttaaatcagatacctcagaagatttctgtccttatgtgaattggttgttaatgatgatgctcaacaatcactataataacaatcttacctgatttttaaatatataaatttagaaaattcacttttgaaatgtcttatgtgtacttttaacccttttttaaaactcccaaaagggaagtttcagtggactttaagctcattttttaatctttctgataaatttttgagcacaagatattgacatcagtgaagatgaaaatgtgcttggcaaatttcaacaaaaaacattgtctaattggcagatgaagttgaaaaagtagtatatcaaaatttattaaaaacagccaatgatgtaattggatttttttttttttatttttgagacagtcttgctctgtcacccaggctggaatgcagtggcgcaatctcgtctcactgtaacctccacctcctgggttcaagtgattctcctgcctcagcctcctgaattgctgggactaccggcacgtgccaccacgcctggctaattttttgtattttttgtagagacggggtttcaccgtgtcagccaggatgttctcaatctcctgacctcgcgatctgcctcagcctcccaagaaattggatttatatatctgtttgagttgtccacttcagttatagaagtttttaaactaaaaattaatataaattgaatgtagaaaacagaattttaattcattctatcataaattattgcactaagtttaaaaagttttgttaaatcagactataacataatatttactttataatatcaatcattttatcttgatgtcattattttcagatgtgtatactgtatttaaaatatacttatatacatgcacagctgtatgtgtttataatatataaatgaagacatatacactgattggaagtaaatgccagatctcattgatgaggatgtgggagaaaaacatttgtgaaaatactgttagagtcctattcaacatgtttcgtgagcaacacaggtctctaataggcttaaaccatcaatggcaatgtcactacgctaggattcactttctgacaaaagaagcatttaatttaaaaatcattttgggagaaaaaatacttttgtttttgtttgaaggatgaggtaaaaatgctttccttttttttgtgtgtcctcatttctacttctttcaaatatcaacatgatatgaatgagatatagtttacaacttgtacattagctactgtgggcttaatcttaccaagactacattttggttccagccacttcattatgcaaccattttttggtaaatttatttttattttaatgttggagaaaagacttattcttagcattgccctaattttagaaaatgaatttcattcatgagagtgttcttggctagaaatataaacactgtagagaacagtttcacatttattttctcctgttttatcatcttcgaaagaaagtgaactcctgctggctattttctcttgcccctcccagcgtctgtttctgcctctgtactgggaagcttctatgactgctgtcatgcccctgtgccctctcgcggccagctggatagggccatggaaaaggtccttggaaggcctgtgggagaaaggggagggaagtccgagctgcgattcccaccactggctgccactgggttacctgggactggctgtggccctggcctcacaccgcagcagccacacccacctggctctccctttatgaccctttatcccccagcattcctttgggccccttagtagccactgggaactcttgtgtttgcctcttccacacctgtgtctttgttgatagttgtcttgtcaagccttcttcaaattatcttatgtgatggtgtcacgtaattcctatagaacccttgattcataaagtatcctaaaacatattttaatattttcccagttttgtgaagtgcttttaattctattttagatatgtcatgtgtctcttttacatttatcttatacatttgcttgcttatcctcttaatccataagtgtttttgaagacagcaatattcagaatctactattctggtattcagaatattcagaatatctggaaggatattcagaatctattgagtttggttgaacatgatgacattttattttttaaaaattagggcttgagggaaataatttttaagttactttgccataattggctagagcaagactttgcaaacattttctgtacagggccagatagtaaatgcagagactttgcaggccacgtgatctctggtatggctcatcaactctgccatgatggtacaaagccggctatagacaataagtatatgaatatggatggctgagttttaataaaactttatttataataataggtggtaggcctgatttggcctgctgactatagtttgccaagtcctgtactagggtaacataacattagaaaattgatataatttatttcagaagaatataatttttaaaggtttataaattataaattcttgcaatggataagattaaaatatttttgacatttaaattattatttaaatcatatttagggaaaagttttagttacgttcctctaaaaataattgcaatgtacaaagaaatactcagctttaggaattatgtatatatgaaaggatgtagtgtctattctgcttaaactgaataatatctattgtattatgtgatgtctaaaaatagaatttgatacttttgctgacaccaaagttacttaacagatattcaattaaccctagctgatgatgttaatatagatggcatttttcggatcatgctgctgcctgggttaatataaagatgaatgtctgtatccatcgtacacatgtgtgcatgtacttgtgctcaagtgcacacttgcctatgtctctggaggaagtgcaggtggacgggggagggttagtggctaattgacccattcgcttctggtcctctgcattcctggccaccccaggagtgtatgttatctccctcaatgcattgggtacatgtaggaaaacagtgacggacagcatttgcttatgattgttttgcctgcaactaaaaaaggaaatgtgttcaaagattgaagagtccaaagccagttctggtccaaggtgcagaaggagcccggcccaaggccaagatctcaggggactctcagctatcttatcactcagtgtttcttattctctgctgatgggctttactttgggtatttgccaagatgaatttgccatttttcagtctttatatacttaattataaaaattcacgtgtgtgtgtgtgtgtgtatgtgtgtataagtgtgtgtaagggagagagagattatgaaaatatgaatgaatgattgaataaaaacatatgaataaggaacatattatttggactggaggagtgagttaactgtccagccctggtcagtcagctcttgaaggggtagtttcctggcagtgaggtggtgagccaaggagaggaccacatttctctgcatgcaaatatccgttgcccaaagcattacatgggaagtcaaactcaatcagcaaacaatgattgctgaaccttattaatatggtccgggagatagaaaaaagagtacggaggggtgtcagagtctgggggaaaaaatcaatggtaggaaaaaagttcatataatataaattttaaaaattagcttattaaaacattgcaattacttgaaaatttgcctttatgttgttaaaatcagttaaaagtaacccaactatatataatacacatggcatattatcaaatagaggctcataagaagtctcccgggtgtttctttttattataatgttaaagatggaatcgttacaccttatcttagcaagtatatttagtcaatatggtggaacgaactcctagcattctgcagcgttatacaaagatataaatatcacttagtgcagtttgcctcagtttttcaggaagcatccttttaaaaaaaagttttatggatatattatagttgtacctatgtatggaacacatgcagtattttgatacaagcatatacaatatataatgatcaaatctggctaattggggtatgcatcacctcaaccatttatcattactttgtgtcagaaacattataaatctatttttctgcgtattttgaaatagacaataaattattattaagacagtattccttttgctccccatgaagcagccatcaccagaacatttgggtcaaggtcattataggaggtcaccctcatggcttgaaaagggcttttcatctccttgagagtgtgttctccatcctatgctcctgagatcagtccttgaagcttcaaaaggcacctttgcctgcctgtggaggaatgattggcagggagatagatcaagcatctagaaacagatgttgtgggaacttgtgagctggtgtttaagtctggcttggagaagaaccaagcctggctagttctgagtcttttgactgatagttttaatggggcaagtatagtttgtgttaaacaatgtgtttaatttgtatgttagtatgttgagagactaaagagtttcttgtcaatcccatgtttctttggggaggaagggctctaggcatttttgttctttcaaactgactcaaaggccactgtcttggcgggttcacggcccagtgattgaagcttgagattttctccagaagaaggaaagggggatatttacggagaataacaagatggtgtttgcagaatcctacactgcactgtggagttgggtcagttgcatcatgaaatattagcattttccacacaggaacattttgtaacaagaaatgttagaaatcatttgtagagtagaagacatactagacgatagttggaaggaaaaagagactgtggaatgacgcataaatgcttctaattaaagggaggggactcaaaaagtgtaggaggcttgaggaatttagcacacaactacagatgtttcttcctcccttcctctagtttggttctattattagaataggaggatgtgagaattttcttgctgggaagtctgcctcagactggtagagtttatctggctggctaagggggtgcccccttcctgtgttatcatcacattttcttgggcagggttctggctgccaggacggatccttccctcccccagtactagaatagaactataattgaagcaatgtgtgctacattatcacaaggagagctatttattaaagcttatcctttttgtgctggtaggcttcttccagctaaaaactgcaagaagaaatacgaaggctgttcttaattttatacaaaaacatcttaggtctgcattagcccatgatcagggattttgtttcatttgtgatttcctcaaaattttaccccccaaaagaattactgagttagcaaataaagggaaaaataccatcacttgtgattgttaaaaaaaaaattgatgaaatatgttgaatttgaatcagcccaatccattatagaaaaggaatggaagtaattatgttgccatctttccttatatgctggctcattgttaactcccaaacggttgccttctctacataattcattcaggatgtgcctacattgatacttttcaggcaagcaaatctgagtttgagtttacattatgaaactgaaggtcttttgctttctccttgtcactattagtttctctcagaattctgtattagctactgttttatagtctactgcaaattgctactgtgttagatattcattatgatatgctttcatttggaacccttgattgcctacctgtggaggaatgattggcagggaaattgatcaagcaatctcctaatttggaattagagtattcaatcaagaaaaaaatttggcacagacagcatctatctcttatctctctctctctctctctctctctctaatatctatctatctattacctgttatctatcatctatcatctgttatctatcatttgatatttatttatcatctgttatctatcatctgcctattatctgttatctatctatctatctatctattttttagtaagaccatgtatcacatgcgtggagatgtacagtgattaagtccatgtacctcgggttctgtgttatgtcctgcaatcatgaaaataaggtgaagtttgggaacagtcactggagagagaggaacatgctagcatttgcatatgttctatgtatctaatactgaacatgtccaggacagtggacaaaccttactaacttgcctgtgttggggcatttggttaaaaattaacgggcagaggcaaactggtacagtagctactttgcccagccaaggagtgtggtaggtggaattctaagatggccccaggattctgccccctggtggacctaccctatatcatcccctccccttgaatgtgagcaggaccataattaatttaccttatatggtaagagtaaggggattttacagatggaattaagaaccctaatcagttgagtataggttagtcaaaagggagatcatcctgagtggatttgacctaacaggcaagtctttaaaagggccacagcaggtgcccttctgttgtctttgaagaagcaaaattccatgttgtggagagaaccacagggcagacaggggtgggcattccctagtatcaagaggtctcagtcctacagtcacaaagaactgaatttttccagcaaccaatgagtttagaagactctcacaagcctaaaaagacatctcagtgtcaggacaatgagcttctaaacagaggatctggttaaaccacgaatggactcctgactcatgagaactgagagataattcataggtattgcttcagggctctaggtttatggcaatttattagacagcaaaaggaaactaaaacgagttgtatcagttttgtgatactgctgcaacaaattatcctatactcagtggcttaaaacaatgcacattgattatcttaccgttttggatgccagaagttcaaaattggtcttactgtgcttaggccagggtgttggcaggtctggttccctcttggaggctcttctatggagagtcaggttccttgccttttccagcttctacaagctacctgattgtcatggctcaatcgattaacagccttcattctgccagcaatctaaactttcccccttgccatgaagcataacatggtcacaggttttaaggattagaaagtgggactctactttgcctaccactaggaatttaggattgatgctgtgggatggggaggtgcacatgtgagaagatggaattacgtattttagagcaatctgatgacacgggaggcggctgtttgggggtccctttatccgtctggtcagctacaactgccagaaagtgcatgatgcctccgtgaacctctgagattatactgtttttttcttattttctagaaaaagtatttaggatttaggtataaatatacgtcatataatgctcattttccttaatattcatttttcagagaggagtgtgtcattttgtacatgtgcattacattggttgaaagttttaggaatgggcaagttattgcttttccaggattctgcctttagaaatcccacatcctcttctctttcattactgaaaaccgcagagacaaatatgtggcccatacccatgttcacaggactcaccgcttgaatcagttttggcctcatgtctttccaatcaacttcctctttgcttcatttgttttaaattttgctttcttctatttggtgtgtttttgtaattttatttttattcattttttaagtgtttggccttcatatttttgctccaagatttgaactaatctgccatgatgctcttgtgttaaaggtggaaggaaacgaggactgaactgtctctcgctttacttaaaaggtgcctgggctgggcacggtggctcacgtctgtaatcccagcactttaggaggctctgatgggtggatcacgaggtcaggagttcaagaccagcctggccaagatggtaaaaccctgtctctactaaaaatacaaaaattagctgggcgtggtggcaagtgcctgtaatcccagctacgtgacaggctgaggcagaacccaggcagcagaggttgcagtgagccaagattgcaccactgcactccagcctgggtgacagagcaaggctctgtctcaaaaaaaaaaaaaaaaaaagtgcctgtatcccaaagaggttatgaaattattgactgatgtccattagtcacagcatgccgtcttctccccggtcttggacagcagtatctcttggttcctgttaatcagtttgtatgatttgccttacccgatttgccttaccctatttggtgatctgggggtctataagaatccagataattctcattgtccctgaagaaccctgttagtccataagtcaagagataatcaataaaataatatggatatgggatttgcttttcatataaactagggtttctccgtcttggcacagttgactttttacgctagataattcactgttgtgtaggctgccctgggcagcataggacatttagcagcatcctggactctatccactagacgccagtagcaaacccttcccagctgtctccagacactgctgaatgtcccctgggggggcaaaactatccctatttggggaccactgttataaatatatacaaaaattatagggaaaacattttggatgggagttcttggctggattgaattaggtatttgcatgaagtgaaggtatttacattatagaagagaaaaattctgtgctagagggaaaatggaaattttattcctatagaagtaaagatacattatcaaagtacagtaactgatgtatcatttttgtgtattttccatcctaccaggatcattaaatattagaaatgaaattctgataactcatcttaattcagtaatataaatatatttggtttctcatctataaagtaagaatgataatggtttgtaactcatagggttattatgaagcttaaatgagacttttaaagtggtttttctcaagcctagaagttcttaattcatgctaatattattaatgaagaattgggttaaattaacggaggaattatttaaattgtatacacacagatacacatacacatacaattatttattgttatttgctaaaacgttacattttattcataattggaacaatttccttccaggtctgaggaagacaattgggtgagtattgctgttgtcagtgatgttctcatcttagcaagcctggttaacttgagagtcctccatgtaaaaattttggttggtttttcaaattcttgtttctgttaatttcagaggtatccaatttgcctatgtaccaaaataactgaagtattgaacactgcatatttttaatgtaggaaactggacttcaaatgtcatttttagattgtcatccttgatataatttgaggctggccaagtgagagcttctcctatgaatagtaaccctggtcctgttgagggacataggcactaacacggggtcaggctgagggagtcctggttctgcaagggctgtgtgacctgggccaagtcctgtgtccagatgtgcttcactttctcacctgtgaagaatgatgctgctcaggtggtcttgaaggacctttcccactttcatctttgcctttcttttctttacttttctattattcattgacaagatcaatagggatcatgtgctttttgtagtgattggtccatttattaacaaatggaatctgttgaatacagagatatctgctgcagtaaatgtaaagtaaaaatcagaatctgtaattagggatcctggatctgtcagtgtacaaagccctggtattagatttgcttttgacatcggtatttttttcctactcctaggatggaattcctccaagaaaaaatacatgttaaaagaaattgctctaaaatcctgtccctcagacactcatcattctgcatcagggttcagtcacctctttcttggaaagggctggatagttaatattttagccagtgacaaaatggtcatatgcaagttgatattagtcagttattacactgctgtcaagaactacctgagactgaggctgggtaatttatgaagaaaagaggtttaattgactcatagttccatgggcttaacaggaagcatggcttggaggcctcaggaaacttacaatcatggcaaaaggcaaagggaaagcaagcatgtctttccatggtgggcaggagagagagagagagggagagtcaagggggaagtgccacatgttgttaaaccatcagatctcatgagaactcactcactatcatgagaacagcaagggggaaatctgcccctgtgatccaatcaccttccactaggcccctccactgacatgcagggattataattcaacatgaagtttgggtgggacacagagctaagccatatcattctgccccagcccctcccaaatcttatgtccttttcacatttccaaaacaatcagggcttcccaacaatcccccatactcttatctcattctagcattaactcaaaaatccaggtccaaagtcacatctgacacaagccaagtcccttccacctatgatcctgtaaaatcaacaccaagttagttacttccaagaaacagtaggggtacaggcattgggcaaatattcacatcccaaatgggagaaattggccaaaacaaagggtctagaggtcccatgcaagtccaaaacccagcagggccatcattcaatcttaaagctccaaaataatctcctttgactctatgtcttgcatccaggccacactaacacaagggctggactcccaaggcctttggcagctctgcccctgtggctttgcagggtacacgccccttggctgctttcatgggctggcgttgagttcctgtgggttttccagacacacagtgcaagttgttggtggatctataattctacggtctggaggatggtggccctcttctgccagctccactaggcagtgttccaatggggagtccatactggggctccaaccccacattcccactctgcactgccctactgtaggttccccatgaggggtccacccctgcagcagacttctgcctggacatcaaggtgtttacatacatcttctgaaatctaggtggaggttcccaaacctcaactctcaccttctgtgcacctgcaggcccagcaccacgtagatgctactgaggcttggggcttgcaccctctgaagcctcagcctgagctgtaccttggcccctttagccatagctggagctggggcatgtgtgatacagggcactgtgttctgaggctgcacagagcagcagggccctgggcctcgcccacaaaaccatttttccctcctagacctgcaggcctgtgatgagagggcttccctgaaggtctctgaaatgctctggagatatattccccattgccttggtgattaacatttagctgttctttacttatgcacatttctgcagcaggcttgatttttctccccagaaaatgggtttttcttttctacgacatggccatactgcaaattttccaaacttttatgctttgctttccttttaagttccaatttcagataatctctttgttcatgcatatgaacatacacttttagaaacaatcagatcacctcttgaatgctttgctgcttagaaatgtcttccaccagataccctaagtaatctctctcaagttcaaagttccacagatctctagggcaggaacaaaatgtcaccagtctctttgcttaagcatagcaagggttgccatcactccacttcccagtatgttcctcattaccagctgagacctcatcagctgggacttctttttttttttttttaagtttacatgactttaataacatttagtaaatacggctgattttaaaactactgataaagtaaaataaacacatctccaaaatttaatttaaacattttttctgggtctattgataagtcaatactgtctctactagatgtgttcttttttattattatactttaagttctggggtacatgtgcggaacatgcaagtctgttacatacatatacacgtgccacggtggtttgctgcacccatcaacctatcatctacattaggaatttctcctaatgctatccctcccctagccccgcacccccctgacagtgcgtgatattcccctccctgtgtccatgtgttctcattgttcaactcccacttatgagtgagaacatgtggtgtttggttttctgttcttgtgttagtttactgagaatgatggtttccagcatcatccatgtccctgtacaggacaggaactcatccttttatatggcttcatagtattccatggtgtatatgtgccacattttctttatccagtctatcattgatgggcatttgagtaggttccaagtctttgctattgtgaacagtgccacaataaatatatgtgtgcatgtgtctttatagtagaatgatttataatcctttggctatatacccagtgatgagattgctgggtcaaatggtatttctagttctagatccttcaggaattgccacactgtcctccaccattgttgaactaatttacactctcaccaacagtgtaaaagcattcctatttctcaacatcctctccagcatctgttgtttcctgactttttaatgatcaccattctaactggcatgacatgttatctcattgtggttttgatttgcattactctaatggccagtgatgatgagcatttttttcatatgtttgttggtggcataaatgtcttcttttgagaagtgtctgttcatatcctttgcccactttttgatggggttgtttgtttttttccgtgtaaatttgtttgagttctttgtagattctggaaattagccctttgtcagatggatagattgcaaaaattttctccctttctttgggttgcctgttcactctgatgatagtttcttttgctgtgcagaagctctttagtttaattagatcccatttgtctcttttggcttttgttgccattgcttttggtgttttagtcatgaagtctttgcccatgcctatgtcctgcatggtattgcctaggttttcttctagggtttttatggttttaggtcttatgtttaagtgtttaatatatgttgggttaatttttgtataaggtgtaaggaagggatccagtttcagttttctgcacatggctagccagttttcccaacaccatttattaaagagggaatcctttccccattgtttgttgttggcaggtttgtcaaagatcagatggttgtaaatgtgtggtgatatttctgaggcctttgttctgttccattggtatatatatatgtgttttggtaccagtaccatactgttttactgtagccttgtattatagtttgaattcaggtaactccagtgttgcctccagctttgttctttttgcttaggattgtcttggttatgtgggctcttttttggttccatatgaaatttaaagtagatttttccaattctgtgaggaaagtcaatggtagcttgatgggaatagctttaaatctataaattactttgggcagtatggccattttcacaatattgattcttcctatccatgagcatggaatgtttttccatttgtttgtgtcctctcttatttccttgagcagtggtttgttgttccccttgaagaggcccttcacatccattgtaagttgtattcctaggtattttattctttgtagcaattgtgaatgggagttcactcatgatgtggctctctgtttgtctgttattggtgtataggaatgcttgtgatttttgcacattgattttgtatcctgagactttgctgaagttgcttatcagcttaaggagattttgggctgagatgatgggattttctaaatatgcaatcatatcatctgcaaacagagacaatttgacttcctgttttcctaattgaataacctttatttctttctcttgcctgattgccctggccagaacttccaatattatgttgagttggagtggtgagagagggcatccctgtcttgtgccagtttttcgcccattcagtatgatgttggctgtgggtttgtcataaatagctcttattatttgagatatgttccatcaatacctagtttattgaaagtttttagcatgaacattgttgaattttgttgaaggccttttctgtatctattgagataatcatgtgttttttctcattggttttgtttatgtgatggattaccttgactgatttgtgtatgttgaaccagactgcatccctgggatgaagctgacttgattgtggtggacaagctttttgatgtgctgctggatttggtttgccagtattttattgaggattttcacatcgatgatcatcagggatattggcctgaaattttcctttttttttattgtgtctctgcaggttttggtattaggatgatgctggcctcatgaaatgagttagggaggattccctctttttctattgttttgaatagttttagaaggaatggtaccagcttctctttgtacctttggtataattaggctgggagtccatctggtcccggactttttttggttggtaggttattaattgctgcctcaattttagaacttgttattggtctactcaaggattcgacttcttcctggtttagtcttgggagggtgtatgtgtccaggaacttttccatttcttctagattttctagtttatttgagtagaggtgattataatattttctgatggtagtttgcatttctgtgggatcggtagtgatataccctttatcattttttattgcatctacttgattcttctctctttttttctttattagtctggctagaagtctatctattttgttgatcttttcaataaaccagctcctggattcattgatttttttgaggggttttcatgtgtctgtctccttcagctctgctctgatcttagttatttcttgccttctgctggcttttgaatgtgtttgctcttgcttctctagttctattaattttgatgtaagtgtgttgattttagatctttcctgctttctcttttgggcatttagtgccataaatttccctctacccactgctttaaatgtgtcccagagattctggtacattgtgtctttgttctcattggtttcaaagaacatctttatttctgccatcatttcgttatttacccagtggtcattcaggagcaggttgttcactttccatgtagttgtgtggttttgagtgcgtttcttaatcctgagttctaatttgattgcactgtggtctgagagacagttttttatgatttccattcttttgcatttgctgaggagtgttttacatccacttacgtggtcaattttagaataagtgtgatatggtgctgaaaataatgtatattctgttgatttggtgtggagagttctgtagatgtctattaggtccacttggtccagagctgagttcaagtcctggatatccttggtaattttctgtctcattgatctaatattgactgtggggtgttaaaatatcccactatcgtgtaggagtctaagtctctttgtaggtctctaagaacttgctttatgaatctgggtgctcctgtattgcatgtatatatatttaggataattagcttttcttgttgcattgatccctttactattatgtaatgtccttgtctcttttgatctttattggtttaaagtctgtttttatcagagactagcattgcaacccctgctttatttttgctgtccatttgcttggtaaattttcctccatccctttattttgagcctatgtgtgtctttgcacatgagatgggtctcctgaatacagcacaccgatgggtcttgactctttatccaatttgccagtctttgtcttttaattggggcatttaacccatttacatttaaggttaatattgttatgtgtgaatttgatcctgtcattatgatgctagctggttattttgcccgttagttgaggccgtttcttcatagcatcaatggtctttacaatttggtatgtttttgcagtggctggtactggttgttcctttccatgtttagtgcttccttcaggagctcttgtagggcaggcctggtggtgacaaaatctctcagcatttgcttgtctgtaaaggattttatttctcattcacttatgaagcttagtttggctggatatgaaattctgggttgaaaattcttttctttatgaatgttgaatattggcccccactccttctggcttgtagagtttctgctgcgagatctgctgttagtctgatgggattccctttgtgggtaacctgacctttctctcttggctgcctttaatattttttccttcattttgaccttggtgaatctgacatttatgtgtcttggggttgctcttttcgaggagtatctttgtggtgttctctgtatttcctgaatttgaatgttggcctgccttgctaggttggggaagttctcctagataatatcctgcagagtgttttccaacttgatttcattctccttgtcactttaaggtagcccaatcaaacatagatttagtcttttcacatagtcccatatttcttgggggctttgttcatttcttttcacttcttttttctctaatcttgtcttcacctttatttcattgagttgatcttcaatctctgatatcctttcttctgcttaattgattcagctattgatacttgtgtatgcttcacgaatttctcttgctgtgtttttcagctccatcagatcatttatgttcttctctaactttcaagaacttttttcaaggttcttagcttccttgcattgggttagaacatgctcctttaccttagaggagtttgttattacccaccttctgaagcctacttctgtcaattcatcaaactcattctccgtccagttttgttcccttgctggtgaggagttgtgaacctttggagaagaggcattctggtttttggaatttttagtatttttgcactggtttcccccatcttcgtggatttatctacctttggtctttgaagtcagtgacctttggctggtgtctctgagtgggcatccttttggttgatgttgataccattcctttgtttgttagtgttccttctaacattcaggcccctcttctgcaggcgtgttggagtttgctggaggtccactccagaccctgtttgcctgggtatcaccagcgaaggctgcagaatagcaaagattgctgcctgttccttcctctggaagctttgtcccacaggggcacccaccagatgccagccagagctctcctgtatgaggtgtctgtcggcccctactgggaggtgtctcacattcacgatacaccgggatcagggacccacttaaggaggcagtctgtcccttatcagagctcaaatgctgtgctgggagatctctgttctcttcagagccatcaggcagggatgtttcagcctgctgaagctctgccaaaaacctccccttcccccaggtgctctgtcccagggaggtgggggttttatctataagtccctgactggggctgctgcatgtttttcagagatgccctgcccagagaggagagatggtctggcttcagtggccttgctgagctgcggtggtgggctccactcagttcgaacttcccagtggctttgtttacactgtgagggtaaaaccacctactcaagcctaagcaatggcagacactcccctacacccccaccaagctccagcgtcccacatctagctcagacagctgtgctagcagtgaaaatttccagccagtagatcttaggttgctgagctctgtggggttgaaacctgccaagccagaccacttggctcccaggcttcagccccctttccaggggagtgaatgattctgtctcgctggtgctccaggtgccactggggtatgaaaaaacaactcctgtggctagcttggtatctgctcaaacagccgcccagttttgtgctggaaccccagggtcctggtagtgtgggcactggagggaatctcctggtctgtgggttgtgaagagcgtgagaaaagtgcagtatctgggccggagtgcatggtacaatccctaatggcttcccttggctagagggagttccctgacccattgtgcttcccgggtgaagtgatgccccaccctgctttggcttgccctccttgggttgcacccactgtccaacaagtcccaatgagatgcactaggtacctcagttgggaaagcagaaatcacccaccttctgcattgatcttgctgggagctgcagttcctattctgccatcttgccagcagtccccttctttgtttttattactatcagccttttggtcaaaaaccattcagtaagtctctagcaagttctaaatttttccacattttcctatcttcttctgtgccctccaaactgttctagcccctaactgttactcagttccaaagtcgctttcacattttcagttatgtttatagccgtacctcactcctgttaccaattttctttattagttcattctcatagtgctataaagaactacctgagaatgggtaatttatgaagaaaagagatttaatggactcacagtttcacaggcttaacaggaagcatggcctggaggcctcaggaaacttacaattatggtggaaggcaaagggtaagcaagcacgttttaccatggaggagcagaagagagagcaagtaaacgggggagtgccacatgcttttaaaccatcagatctcatgagaattcagtcactatcaggagaacagcatgggggaaatctgtcactatgatccaaagacctcccaccaggcccctccccgatatgtggaggttacaatttaacgtgagatttgggtggggacagagaacaaaaccgtatcaagttccttatgttaaaaaggagaaagcaaacattcacaaattctttcttcaatatgtgaaaatataaaacctatttttagcaagcaagtgatcagaaaataggcaatgggctggatttgacccacaggctgtagtttgctactctgatgtacattggagaagtctgcctcttagatctcaataacattatggcttatatttaatctatttttttttcttttttgaccagaagttccaggtaaagcaaagctccttaaccttgtcctggggaaaccctcctccccctgcccccacccgctgccccaacatcagagtatgccaaatctgggctgctgctttctaggtatattggaagcatctctagtcagttctcaggcaacctgagaatgtgctcccaaagtgaatgctgtgtttccaaccagactcgactttcccccgctctcagtacctttcatacttccttttctggccagaatctagaaagagttgttattgtttcctatgggacttgctcaagttttgggtcatctatctctgaaaattgtcatttccatatagatttgtaatgctattgaattgaggttctcgtagatcaccccaggttcaataattctccgggactcaaggactcaatatgtagtcatgcatggctgtgatttattacagtgaaggaaaaaaaaattagcaaagacaagaggtgcatggatagatcatgaagaaaacaaggtgtgatcttccaagagtcttcttccagtggaatcacactggatgcacttaatccttccatcagcaaattgtgacaacacgaggagagtgttgtctaccagagaggctcaatgccctgggtttctcctgcgggcagatcacacaggacctctctgcctggaatgtattaaaattgcagactcctggaaggaaagcagatgcttgcgtaaaccaccttgcatgtattaataattgaggcacagtgagccgtttttaacagggaattgtggaaaccctcctgatatctgagctcccagaaaccagctaaggggccaattttgcaagcaggcccttctaggatgacagtctcaggcctactctactaagtcttctctgtgcagctgtaaaaaggggactggatggagttcattgtcatacggaatttaataacactggcttcctaactcagaagtgagtgttagaactaattcttatgttttgcatatgcagatttattacatttcatactatgtatatagacatagagaatataaatagatattttataaaaatttatagaagccttaaggtcaccaccatgtataatcttacattttatattttatgtctcttttgctactcttacaacagcagttgtaattacaatgtttctattctattttagtgttaacaagaatattttcatgaacattatctccttcaagctctacctcaccattttttggtaattagggcatttattattttctccccatattttcaagtgagtacgctaacttagacaggtgaggccatttgctcaaggttgcatagctaatcaaaaccaagccagaacacaaatactgttcttgtactttttaggaattccatagccatctccattgtctttctactgagtcagatacaagtcacagctccaacacaataggtgattattattaatatctatttctactgcttccatgcctacaggagatcctgtattatctgcctggccatctcctgcctgccatctggcgccaaggtgtctctcacagagctggggaagggagtaagcagggtgctagtctcagtaatttgttgtaggtgaggatgttggatgattcagcgtgatgacaaattagaggcatgaggctcccagtctccatcccgcggattttctctcagttcattcccccaccacatgtgctgtgtgttgttgcagagggatgcatttctatcagcctatagatcttgcaacctggagaaacaaaaatgtgttttgtccttagcatccagaaggtaattgtacgatgtaaatgttgtatgccttcctagctcttgatctggaaattgtcatcatttctaaaacaaatagaaatatacttactttaaaaataaattagtatgtttaaaacacagataataatttatccccaaattattaagcaattacaaattcaagcagttggtgctgattaattatatatatacaaggtagcattttaaaaatttatgataaattacagcaatctgttgaagtgttgaaggtgattatttatgaagtgtgatgtaaatgaaatttgccacagtgcggggaaaataaattctttattaacatctaattatcttttgctcacttatggattcaatatttcctacctctgtatcaactcttatggcctgggggcagtagtatttattaagatggcatttttagttccatcataatttagctttattcaaattccagatcagtgctatcacattactatttactgaaaaattctgaactgtgttgccaaaaaaggataaaaagtaagctttacatttccttccctgggagtctcatgacgccgttttctgtgttttcctcagtgaatgggtggtcttatcactgtttgttcagtcatccttccagactgaactgctagctgtgcacatcttccacacacagaaaatgtcttggaagttgattctctaggtttctaaactcagcctgtctctgtatttttatcgatgtgttaaaaatatttgaggatcatcccaagtgaatcagctgattgacagctttagggtccatagattcttaacagatgaaatctaccaataaaaaattttcaagggcaaataagaagccctacaattgtgctaaatgcactacctacaagaacaacaagaaccaactactataggtataaccaatactataggtgtttcagaaggcacaaattagcatatttacatggctcaaatttttaatcatatttttattactcaatttatattattatgatacaggatgtgataacttagcttcctctaacagatcctgtcatatgcatgtttttgcatgctacacttttgaaaaaagctttttatcatgaaaaatttcaatcatagacaaaggtaaagagaatagtataataaaaccctttgtacccagctgccaatttaaaaagttatccacgtgttctgtaaatcttttctcatctctttccttatccacttcgcccatgcccaccccggccagagatgattctgaagtcgatctcagatgtgtctttttatctttaactattttagttgaattctatacttttgaggtctagctaatcagaaagaagagtgaagaaagagaccagggcagtcagaggaatcagatgccttttatctgagaaatgagagaaggaatactctctttcagaaacactggtctagaagacccaggaggaagatttcagggtctgtaaataagaaaagcacaataatgtggaaaccagttaagaatttatctctgtgtcattaaggcatagacccagaactaaagagtacaaggtatggggtgattgatgtcactcagtttaaggaagaacttcctaaagtaaagtggaccaaagattcaatgaactgtcacaaggaattgatggtttcagctcagcagagttttcaagtggatcgggcaacagcttgatagcgcgatatagaggcaaagtacaggagattcagatgagattttatgttgtgagtttttccaaacccagaagcctgcaaagtgtggcgggcttctcagctgaaattcttcctggctcatatattaaataagaatctaatcttttctgaatgtgaacatcaggtaagagcctcatcctgctgtttgcaatgtggactcagagagctgttcgaaggttttgagccagcaacctagaaatccaccttgattctgctactttctagctgggcagagctctgtaaggtatatcacgtcttcactgaatctcaggcttctaatctgtacaatgggattttaagggagtcttctgagaattaaattaggtgcatacttaaaatctctctccttcattttgtacctagttaggtattttgtattaggtgttcatatttactcttccaatatccagagcttgctgaactttccatattgatactgctttggtaaagttgagtttgtattgatttattcagcagtctgaacttggggttcagtagtgagttacacagggtctggccacaagttggctagagtttcatgggctttctgagctggacaagttacctttattactgtaggataaataagttaatcatgcttactttgtcccatcaaaagagaatagttataattatttcattgctataatcttcctacattctttctcatgagggtgagaagaagttgcttagaagataaaatattgttttctaacactatcttacgggaccagataaaagtttctaatttagcctgaaattacattaaataataatggtgtattcaacttagcattttatcattagattgatagagacttttaaaatgtgtagtatctcgtcatttaaggagccatggccctctaaagattgtcacgaataacaggaaaccctccagatcatttatttccattcattctcattaataatagtatttaaaagcagaagtttgccagaagactctatttataagatacttagcacagaagctcacttgtgctttaaaatgtgccctggataactctggcatcttgtgttatctgatatatcaaactaaaacacagaaccatggatagactgttctctcctttggaaacatcaacctgtattcagagactcgaaccattccctgctctcctaaaatgccctcaaggcagacgtagcaccagcagtatttggagctcatacagtgcggcattgaggacggatgccttttgttcacaaacagattgggaaatgtgagataaatggattttttcgcggtaagtgggagaaaatgtgggagagatttggaagcagggcagccgtggggcaaggaatgttgaaatgtagcaattactctttggtcttcctccgcaaaacactgcccttctccgcctagcatttttcagatgccaggccctgaacatgaaaacacggtgtgcctgctgagcccttaacattctcaagagcgcctgctggagagccagccagggcttgctgaatcctgtgtctggaacccagacttgcagggtagggagaaagcagccttgcagtggcctaaacagacgctaagtggacagctcacttgaacttggtttagcagacctcagaagttgcttgttttaatttccttttgtttgtcttattcgtgagggagggatcccttgccctagagttatggggatagctgaacatgggacgccaggcactggacagatgagatcagcagcagtttatgagtcacatatactcacagcctggagcaggaggaccgcacacaccacacaaagccacatgggagtcccgcggcagaagagttgaacatcacagggctgtgggaggcaggccttacagtggaaggaaggtaggatgcctgtggtttccatagaaggatgggattgacttgttagataaattatatggtctggtagggagctgaagcccacacctcatggataggcaggaactgggcctgtccttctaataaggaggttatttgtctagagcacctcatccacaagaggagcctcaggaggggaatatgtaattaggccgttggagaccctcctggttcctcccagatgctgagctagcacacgaccgtggagctgaattttactctcacaccaaaatgtctcgcggtggtttggggctatggggaatgtccttatttcatccacaacagaccattcactcacagtttcagtcattcaatccacatagtaagaattttccctaacttttattcctaaatgcatgtgcattataatgaaggctcccaaagtaagattagaaggaatttcagatcaaagtcaatctctgttcacgtctttggggtttgaaacaagggataatgtacttagtaggtaaagaaacttgattcttccccactgcaccctcgccccatgtttcttcccaccccgaagtcagccagcccctcacacttttgagagtgatgaatgttgttgttacttaagaactagattcattttacttggaaagatatatttttgtcctcaaatatgatacataaaattataaaacagagatgtgcttccttttttatgttgccattcctggttgccaggatctaccaagggcaaactgaacattaacccgctggtgacctcagggtgggaggtgtcactatgacctcagggtgggaggtgtcactatgagaatgccacacccccagcaacctggaaccccgaagctgagaactgtagggcattttcttctcaagtggttcagctgacatcagttctgccttcatttctttgtaaaatcattcccggagcatatggctgtattttaatttcaagtgcctggtacgttattctaggatttgctttgacatattgaaataaaatgcgttatttacttggagcctagatggtttaatgtttttttcacttcctctttgtccttgccatcctctttcctttgactattcccactttccctcaccttcctggccttctttttcctttcttttcctccttctgggctcctgcttttttctgtctttattctagctctaaaaatttggttcttcttggcttatagaaatgtatttggcaaatgtaaaatgttcttaaatagtaaataataggtctaaatgaaaactaatgtgatctatttgaaggctatgttttattctcttcttatcttaccatatggtttccaaaattaaacttgaatttggattcacttatatctttcatcacagactcatgtttcctaaaaagaaggtaggcacatagtgaccatatatgtgagtttccaatcctaaaattagtttaatggcaacaacaaaactagattttctagagaaattcacttcttatcaatttctgcaggggagatggggagagatgaggggaatgtgtgtttgagaaaagatacgtcatcagagcactttgagatttatttctaaatgcagtgcacattgagaaatacccaagagacacagggaaaactcagccatgagaacatcttctttagagtagctcatgtggttaaactctaaatgtgatcgatgaggataacttgcctcccaccatggaatcacatggcaaagtacagatcataggcatttaatcacaggcatgaaaacctatgttctctttcttttgcaagaacctaaattcatgtcataggtaaaggttgaatggtagaatacaagagttctaacgacttagatcagtggtccccagtcttcttgacaccagagaccagtttcgtggaagacaatttttccacgagcattggggcagtggggaaagggtgggtgttgattttgggatgaaactgttccacctcagattatcaggcactagagtcccataaagagtagataacctagatccctcactgcagtgcgcagttcacaatagggctcatgctcctaagagaatctaatgccactgctgatctgacaggcagaggaactcaggcagtaacgctcacttgtctgctgctcacctcatgctgtgcggcctggttcctaacaggccatggaccaggaccagtccgtggcttgggtgttggggacccctgacttagatgacctggaggacggagtaaaaaagaatggggaatgggaatttttctttctttcaatgataacaaattctcaaaaattcttaatgcacagaaccattgtgggtttcttcaaatacaaatattgcaataaacaacctaatattctgaaccgattttttgttggcagagacatctgtatctttttttttttttctattgacagaatggatttagcttgccaaatcatttggaattccttaggcatttatttaaaattttatttttatttttattttttcgaaaatattttattttataagaaatatattttctttttttttttaattttttttttttattataatctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccagtttcatccatgtccctacaaaggacatgaactcatcattttttatggctgcatagtattccatggtgtatatgtgccacattttcttaatccagtctatcattgttggacatttggcttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagagttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaaatgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctcttgagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgcagatatgcggcattatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagagttccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaatgccctttatttccttctcctgcctgattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgaaatacgtcccaccaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgacgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatatgtcgaggaatgtatccatttcttctagattttctagtttatttgcgtagaggtgtttgtagtattctctgatggtagtttgtatttctgtgggatcagtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcattggtttcaaagaacatctttatttctgccttcatttcgttatgtacccagtagtcattcaggagcagggagacagaaagtcaacaaggatacccaggaattgaactcagctctgcaccaagcagacctaatagacatctacagaactctccaccccaaatcaacagaatatacatttttttcagcaccacaccacacctattccaagattgaccacatagttggaagtaaagctctcctcagcaaatgtaaaagaacagaaattataacaaactatctctcagaccacagtgcaatcaaactagaactcaggattaagaatctcactcaaagccactcaactacatggaaactaaaattttatttttaaatctcccccaaagtgaagaataatttcaagtgaacatgtggggaaaaatttggtactacaaaccttttgagaatattaaaagcaaattttgcccagaagcagtttgcatttctctcttccattgtagctgtatttccaagtgaaaggcagatagcaaaagaattagaatgggattaaaaaggctttttgtaaaaaataatggggccgggcctggtggctcatgcctgtaatcccagcactttgggaggccaaggcaggcagatcacccgaggtcaggagttccagactaacctcgccaacatggtgaaaccccacctctaccaaaaatacaaaattagccaggtatggtggcaggcccctgtggttgcaggtacttgggaggctgaggcacgagaattgcttgaacgcttgaacccaggaggcagaggttccagtgagcagagatcatgacattgcactccagcctgggctatagagcaaaactccatctcagggaaaaaaaaaaaaaaaaaaaaaaaaagaaagaaagaagaaaagacaaataatagtggaagtaattatgtagttaacaatatcacaggcttactatgtgcagacactggattaaatgctatttgtaagcactccttaatactcaccaagaccctttgaggttgctatttttattatatccagcaagcaatgaggaaaaatgagggatagggaaataaaaagacttgagtaaatctcatcaccaggattcagcccagctctttgttcccctggataacctaagggtgattagggcaagacttcttccattgtcttgtacacttaaggagagagagagagccagtgcattgaggccttggcatttgagcctgcgagtggagaagacagaatgagataggcctgtggtctcttgccacctcactgaaagacagcacgcctggttggctaccagtcttcaataggtaacctaaatccaatcccaagacaaagtaagtttgatcaattcatttgtaacccaatggccaagatgttcattgcatagtaaaattttggttccctgagcctcttaatttaagaacttacatgaaaatatagagttaggactgaagctagcatttgataacctatttgaaggggcgatggtaaggcttctagcttctcttgatattcttttcaaatcaacaggaatgcttctttttttatgttagtaatatgccatgccatttgacagttcttcccccttgtgtttcttctcagcgacttttcagtattcagtccaaatgtgtattcagcaggtcaaaatctcagcatgtttgcactaggtgctggcagctagttgtagggtgtagtggtatcatctatagcctcgaaggaaggaaacaaaacaccctaacaccctccttgccctttacttggcttctctctgccttctgaggcctcagttactgggtacagagctgtctaggggctgacttgccctgcacacccctgtgtaccctgttcctgggctttgctgaaccctcccatggatgccccttggtagagttgtaataaaacatctgcaagccctgaccaccaccttgatgcatgtaatggtggttgtaatgctgggggttctgaaccactagtggtgccttatgaccaaggggaagggtaagaagtaaggggacgtcatctattttaaacattattcactgacctcatctgtcaggagaaattatagtcttttttttttagagcaaaatagaatctcagtccctagtataaaccacacattttgtgttaatgctgactgttttcatggacattttccaggatgacatgggagcttgcacttcatttgatctactttcagtgacatttaatgtagaatggaaaaaaaaaagatctatgtgggtagtatacagatgtgtagagctttacttttccacttagaatagttgtgcagccatttcccaacgtaatggcacatgtaccatgtgtcctgctgacagtaaaaggtgagctactttccatccaaggaacaattgaaatgtctccaatacaagacgctgtgagaaggtcatagagatgataggtaaagagttttctctgtgtttattacctctcagtggagtcattctctggattattgccagatgcaaaactcttcaagggccaggtggcaactcccaccgccccagttaagccacactcactcaatgtaccagcaaattcctccatgccatgaataagctctccagttggtgatgcagacagaagactacagacccaactatttctactaaattactttgcctgagagtttatacagtgcctctgtaactatctcattaaatctcacaacaattttatgaaccaagaaggtcagagattattattcacatcacatagatatgcaagatgaatttgaaaactaaatgcaaactgattttttcactcttcatgctaatcttgaacttatactcttaaaaccaggttcacctgatgacaaatgtgatgaggctctcgccttgaaattcctaccttcagacagaagtttgcaaaagtaaactcatttcaaactcctagattattccttccttcagcacatatttaatcagggtctcttatggggcagtcagacttccaagtacaggaaataaagtgttgaaccaagggaaggacttctcttacagtgttattatagttggaggagatatttaatcaattaatagttaggaaaagtgttagaaactggtaagtgtgctgccaagaattcaaatgcagtgatgtgatagaaagtatttatgaagttcttgtagatagggtggcaaagaatggtctactcttatagagtggcagttgagtcaatatctgaatattgaggagtcaggcacaggtgagggaaagcacctttgggaaagagagctcagtgaatacaaaggtttggaagagggaacagtggataaggctaaaggaacctacagaggtttagagttgctggatcacagggctcaaggagtagaggaatggtgacacacggggtcagagaattggaggcagaaacacctcaagctttgtgaaccaggcccaagactttgaattgtgttttaggtacctaaatggcaagccactcgaaggtattaaacatcatctatttttcttattaaaaagatacttttgggtgagtcatagaggaaagggttataatgggacaaagttataggaaggacatccattaggaaattgcattagaatttaggcaagagttactggtagagaaatggacgcatttggaaagttttgtttgttagttccagtcaacatgatttgttggtggattggatgttggcagtgaggaaacaagaagactcaaggatgacttgtatacctttgaccagagcaactaagtgggtagtgtatgggcaacactaggggagaagcaagttgggaggcagagagggaaatcatggctggtgatttacatgtattacgtttgagatgcttttggatatgccaaggaatatacccaggagagaggtggaagaattaatactttccagtaatggacaggaatgcaggtgtgttgtactgatggtgtttgctgtcataaaacaaggtaatattacccaaggaggaaggaagagtggaaagtgaaggatccgaagcagatgccagggccatgccaccattggaggaaacacagcttagtctgctaaaggagactgagaaggagcagctagtgatgaggaagaaaacctggacaggatgagccatgggcagaaggtggtcccagaaggaatgcttagattgtcaaatgctataatggatactttgttctgttctttaggaaaaagagctgtagtgaattgttgtgatccccacttcatggtgatcaagccgtatgtctttgtgttagggcacattgtttctcacgctcaacaaagctatttcacatgagggtcctcatccttaatcatacccataatgtggtcagcaccttggtgtggaccctgcatgttgaccagctatgacaaatgcagatggatgattgtgtgagcaattgtaggtgacttcttgttccattcctttcccctcaaaagaagcaaagtcaaaataaacaaaacatctgagccacacttacatcactgtatctcctttgttcccaagcaaagacatacaaaaatcaagataaggaatgttttgtctttacctccaaactaacttctttcctgaacagtagaatagtttttcatactatcatcatttggatggagctctttaaactgacctcagagatcagattcataaccttttgtccagagcaatggatgcctttgctggttccccgttctcattgatggtccctaaatgtgtacttatactgttctgtctagtctacagcttacagtgcattcagccttattcaagcttattgaattcagcctcgttgccttatcaccacgggcttaaactagctaatcttttattaattgtattctatcctcacatacattctatccctttttcctcaagtcatccttctaaactgcgcatctgatcacatttgaatcttagctcctttacttgctttctggccttgggcagttgtttataatgctctgtgtcctccattcctcctgcctcctactgtggttcatggcttaatatatgtaaactatggcattaccttactgcttaaaactcttaaatttaaaaaaaaaatcctattttcaaacaatatcctgtatgaaacaccatggtctgacctttcctgtttttccagcttcaagatctgcttattcctcaacattccttgtggcattcagccatacacatttcttgcagtttcatgaatgtgagatgtttttccacttctcacagactttgcacatcctggtacctgttttcagcaagcatacgtctctcttatctctcaagaacttctatcttcccttcattcctgctcaggtggctgctgggctgggcatcgctgtgtaatcctccatcttctctacaaacgtgtttttctctctgtgttcttacagtatatacctttacttctcaacttgtattacaattactttttttctcttgcctttactaggctgggaatttctaaaatacagcaggctttagaaaagctcatattatatcccaaattctgttacataataggtgctcagtaaatattagttgaatacatttacaagttccactgactatgtaggaatattactggagagttaacacttcctgttttgtggcattttcttggtagagaaccaatcaagtgattttatatagttgataatgtttctatttctattttgtatgttgtgaatctattgatattaaacattactgaacctcaaggaatgtccttaatgatgttaggcatggaggagcaaagttaactgttttatcttaggatgatcatgctataatagttttgtttgttattcatgtaaaggcaatatagaagctccttcctaatgttgagtttctttctcttgaggctcatcattatttaaagggaaagtagaggctggtgtagatggcacaggaaggaattattttggtaataaccagattcaggtttcttgaaaggatgagattttgtaccacatttggactagttacatttgtatttttataggttctattaaaattggataacgaaacactatatgtttgttaaatcacctggatagtgtattagtaggaacataaatctaacagattataataatatttgtcaaaacaccataggaggtagaccaatcaaaatggttatgaagactgataaagtctttgaatatgcaaatataatgatgagcatattggggccagagatagcttccaaaaccagaaataatttctaaattaaaaagcaattcaatatttttaattgctgtttgaatgtatgtgtatgtggcttgattttcacagctacaataatcctaagagaataattaagagacttaattatccgtcatcacaacccattaaatcagctgtccttgagtaaaagcttatatagacatgtatggaagaaagttatcatacttggaaaaacaaagaagaaaaaatagttttcttaattattcagcctaataagagcttgaagcattaggaaatgaggcagacaactctgttagcattacttgtttcagacatattagagctcttttggggtatgattgtcctagaaagcactaaatttaaaatgcagtacttacccattgcctgtgtgatagcatagggaggaatgtttagctcttccataaattgttgtgttattgtcagccctgagaccatttaaggagactctaatgaggtggatactccaattagaggagagtagggggatagtgaggctggggatgaggaagagctgtgttctggtagggagcaggtcagaaagcagggagctagcccatgcaaaagggtgagagcccaagagtgcactaggccctcatcttcatctcttccacggttcttcacacctccccagggtgtccctgctctgagctgtataagaaagggcttggccattatattccatatgggaaacttggaacccatcttttaccataaaggaagaatatggaatcttagaatcttagattggaacttcaagtgcactttcttggctgtgcttgaataatggatggatctgtcctaccatctccagtacataaggcttgatgacctccatgcttaccagtttgcataatgtctccatgggatagtttttgctgtattctcctaattcaacgtataaactcgcttaggaaatataacccagtttgaattttctttgtatagtgtaaagatcttaacccacatataatgtgtcaggttatggaacaatatccatgtttatccgtgcatgttctttgtcttgacctctgttattatttcaagtgggtttggataattacacaaaattgcagaataataagactattcacaattaagtttacttttgtgttttccatgtactttcagagttcagattacagggtgggaatgggggaagctttcgaatcgatgactttgtgaaatcagcactgaaatcataacaactgggttgaaatctcagtagtgaagatgtggagtagtgttctctctccagccaaaccatttcattccccgctttcccaccaagggcctttcaaaagcaccacattttattttgtctgacaagttcaaagcaaacaaactcaatctgtcaatagaactctggtgagacaggaaggaattaggaatctgggagatcctgccaactcattcactgaaagagtccatcgcacgtgggttaagattgtggaccctggagccagccagggtggcctgacttcataatcccaggccatccatttaaaagctcagtaatctttggcaagttgttaagctcctttctacctactgtgtaagatgaatgtaatactggtacctataccctagattgttgggagggtagagttagttatgatgggcagaagagtaccagccatcttccccatcaggagttgattcattcttatctcttgagcatggatgtgctcctttggactaactttcccaatatgtcttgccggcagctcttttaggctgttgtactgtcacacattgtctgattccaggattctgtttttgctttgctcctctattatagttacacttggaaacattgtgtccactccagattgattgatggctttctgccgtatacatttacatattggttctggttaatctcatagtgctgatctaaatgttggtagtcatgactcatagtcatagtcaaaacttgagaaatcagagtcatacctaaagtatttttagaaaatagcattgaatttttgctgttgatattgtgaattataattgagacacagtacagctgaaactttagtgtgaattctaaagttggctgattaaggaagaaatgccctccctcttctaggttggagacaattaatatcagcatttaatagcatggctcttttcagaatttttctcagatgtgatgtctagcactttttctgctgttagattaccataggctgggtaatttatataaaatattaggttatttgactcatggttctggaggctgtgaggtccaagagtttggtgccagcttctgactagagtcatcctagtatggaaggcatcatatgaagaaagctcatgagacagagggagaacactagcccaaatttatccttttctcagaaacccactccagttataactaacccactcctgagacaatggcattagtcccatttagtaggacagagctctcaagacctagttgtcccctaaaggtcttacctcttaatacttacaacagcaattaaatttcaacataaattttggtggagcattaaaaccatagcatgtgaaaatctaagaaaaatgtaatactaatagatatgaaaatcttaatttgttagtctatttttcttatgtttttccacttttaaattccaacttctttagctttgctaaatgtcttggaagtcaagagttgtaagttttctctcattttgaaatttatgtttgtgtaattttttatatcttatttgcttgacttaggacacagaattccaaacaaataaatcattattgtattactttgaaaaagaagttcttgtactgaattactttgaattcctacagttttaaaggtaactttcatgtgattcataagattttctttggttggttttccatttgttttaaaaatccagaatgtattaccaatgaactaaagtgtgtttgatttaaaagtgtgatgatcaaaacattgtatgaattcggtcttttttcttgaactactttgctattttggaagatttactgtcttattgtgttttctttaaacaggatcgtataggtagttttatttgtctaaggttaaagttacttatgggggtggaaagaaagcagttcagaattgtgtgtggcattcagtccaaacccagcttaaggaatgggtgggaattagtttcatactgtagattaggcagacttgtgctactgctgtccacccacacatctacatgatcaaaagacagtgcccttcccactactaaattgctggttacccatcccttcttctatccctattgtccctgctaatttcaggttcccaatgcctacctgctggttgcctgcaatgacctctacatcactctccttgtattcaccactacagccacactgctttccaggtcttatacccacagagaagtctttctcaactacttgtctctcaccatgccaatatcttgcttaaaattttattcatggcttttcttcaactcatgaaaaataaatctgaactaacttcttttagcatggttcaggaggcctgtcctgagctgcatatcagcgtgtagccagagacctctccaatccccaccctggggtccagttctccagcttagatgtcctttcttcccatttcaggcctttgcaccagcttattcatttgcttttcttgaacatctactcttccacttattcactcactggtcaattgcttcaagatccagctcaagccttgacctccctaagaaatgttccttcatccatctccagatccctacatctgggttgagtgttccccttcaagacgcccaagatcacagcatgttttccttaagaggtcttttatatcaacaactacatctttcatatatattgtagggcaggaagaaataattttccctctactcttctaaattctcagctgggcccttgtaacaaaagacatattaacaatagaaaaacaagttataaaaatatgtttatgtcttacacacacgggagatacccagggaaatgagtcactctcaaagagatatcttagaattcaagcttaaataccatcttcagctagattaaagaaagaagtgtgtgggagaggtaagtaatggcaacgtgaccagaaatggcatggttagccggagtaaggtttgttgtgcacatttaagtcagtggcttctccattgacttatctcctgaccaggatcatatttctcttcctggtacagtaggggagacacccttacaaatagagatttcctttatagatgtaagcttaccttacacaaacacaatttctactctgttttcagagcttctcctgtgtctaggctttctcaaaataatcagctcaaaataatcccatgacaaaggcatattttgggatgacatgttccaatttcgtacaatgggcctggcccagatgtttggtagatggacacacagatactaacatgtccaccccatgctcctaaactcgcttgagtgtgactgtgttcatgtgtgtaattcatgtgtatgtatgtatgtattagttttgtatggctgctgtgacaaattatcatgaacttggtgggttagagcaacagaaattttttctctcacagttctggaggctaggagtccaaattaattcttatgcgactaaaataaaggggtcccccgggccacactttctccagaagtttgggggaaataatttgttctttttctcttttggcttcgggtggctgccggcctccttgacttgaggctccttcatcactatctctgcctccacggtcatatttccttctcctctgtatgctccgcatcttcctctgcctgcttcatatgagaatgttttcagtgatgttgagatgctccctgaataatagattaatgtctccatctcaagatccttaatttaattatcttcagtccttttcttttttcttttttttttttgccgtatgagttaacttcacaggttgcagagatgatgatggatatcttttaagggaccagtgttcatcctactccaatgctccaccctcagatatacacaaagttgtgtttcaaggccctaattggtgtaggcaattaatttatttcaaaatcaaattcctttagtaggaaattgagtgaagttgtaacatttggcaattagttgccaaccctggctaatcacataacaaaaggaatgatttaaatagatggaagggaaggagtgcctcatgttctcttcattttgttgtaaaattataacaaaaggcatcaattttccatcaacatatcccagatgttacagacattaaaaattcaccaactcttattctcacacttgaaatgcttttggacttttttcttagatggagctcttatcaaacatcttaataatagtaatgacaatattttaggacatctctggcatgtaaatgaacaaattatagaagagagaaaaatgtttggagaaataaatggcaaaaccacacaattgctgtttaatgctaaattatttatttgatttaatacgtttaagcagatattcattaagttatgagagtgttcaatattaactaggacatgaatgtatcagtcatgttcactaagtgctcatttaccattgtgataatatagtaaataatgtgtttcttgaacagagtatattatcctgttacacattttatttaaaatgagagtaaacaatgactaccaaacttacactagaaaacaaattttcgtgttcatttttttgtagctgaaaacaaaagcttatggaaataatgctgaataaggttcataaggagggttttgcatatatcttgagatctggaaaatagatcaatatgttctcaagctggaagtaaagtcaatctttgttgactttgataggatatatctcaggaagcaagcatttttaacttgaataatgaataaattctgagttgttccatgagtataaaacaattccccaggaaacattcataatctgggttttgtaagtgctccagtgagtctagtgcatagatattaacccagaactctagagaaagtaatcaggtatgaagtgttgtttgttttcatgaagccagtttcagaagactagaaaaatagaaaagatttatggagaaactgaaagcaaacatccatatatttacatcaatattggctattaggctgacagttcatacagaatgtcttcattaagatttggccagaatacacaataataggactcaaaccaatgatgccaatataggtggctttacattttaagcaagagaaatctaacacacaaaatcacaaatgggatattcctcttgaaaatataaaaatatttcattcacatcagtaaaataaaattctaagccaaacaacaaagagttgcgtggtttctgcaccttcatttgcattcatgctgtggttgctggcgtcgttttctacatctgtttcatgttgcctcaaaataaaaagattggtacttcttcttacttgctacatgcagtcccttttgaaccctttaactatattcccagatgaaaccttggcatataactgtgaaatttctttttgttttagggacaggatggttaatcttcacttttaccaatagtgctagaatattattgtcagtagttaactggcgtgtgaaagaaagatttggtcaaagccacaccacaaacttagccttgtaaaagtattttcaaggcaggcttcattatatcaagttgtgttttcctagtgttggtcaaggttttacagagaatcccatgctaacatgctgcttctcatattgtttaaaattttatcttgtgaattcatattggtgtcccatacaatcttcagatagtcttactaagctcggttggtgtgacatttttcataactttctataatcaacttattccttttggaatatctctacatatgcagaataaatgttacatcagataaaacatctaattctaatttgcttgtgatatatctaattgctagcaaacatttctgttgaacagtatacagatattgtggtacttggatggcatcatccatgtgatgtaagatataattgtatgttgtaaaagagagaaaatataacattagatgcaatcaattttccaccaaatgcatttgggaaatattaaactaggcaagccagtccttgggaattcaatccactccgatgtcaatacttttatccctgcttgattgactttgaattgggttccttatactaatacttttaggaaattcatgtataaaaatagccatccctccagtgatttgatttttttcgctacatttagtcttgcaaatttgacgatgcaccattttttaaaccaatcctacttgcattcatgaaaataatttctgtaaaaccctgcaaccaagaagtaaggctcttatgagccttaccttagaaatatttttgaagtgcaccagtcgtttgatgcttcaaggtctgacaatcatggttttaaattttataccagatattataatgtccttgatactgtttttcttctctctctctaatgttcttctttcaaaagatcatcccagcagggttcattcgtgttcaggagtagggtcattggaactcatcttccatcactttgtttttctctgtctgaccccaggtccagccccaaaatttcttatcagataaatttggttccttaaaatagtgacttgccaactgtgttactcagaaccctcagattctagaggtgcttctgagatttgagatattatattgctttaatcccattatttaagaaacacttataccaaaaatgtataccatgtacagaattttaagactttagaatccttcactcagtaaattaacttttactgtgacattacttggcctccctggtttattatagagtacggaataaggtgtccgctgtcatttcaatttgtactgccaatttactgagattcaaagtggtcttatttataactattaatttttataaatttgtgtttttttcaaaagcaggcaaccaaaacaaaatacagaaatgcttggataccgagggtgttatgactcagcagtcacttggtctcacatttttctaatgacttagtataattttgcacttaaagcatgactttgacataatatggtagtccctctcttatctacgggggataggttccaagacccccagggaatgcctgaaccttctgatagtactgaacactgtgtgtgctatgtttttttgatctgataactgagagggctcctaagtgactaataggcagggaacatagacatgtgaatactccagacaaagggatcctttatttccgcaggcaggatggagcagggtggcttgagatttcaccatgctactcagaattgtccacaatttaaaacttaggaattgtttgtttctggaatgttccatttcatatttttgaacttcagttgactgcggtatcaagaagtaaaactgcagagaaggggaatactataccacttttatctccttttgtttgagattaggctgaagatgttacttaaaaaaacgttgtctactgctgaaaaagtagtaaaatctttgttctgatccttccctttctgtcttcccagagcggatgcattcatattcttcttcccagtgtcagggcaaattgaagtgtggaagagaaattcttgtgggatgtttttgccacagaggtgcaacacgtggtaggctcacccaaccagctcaagggctgccaagcctcatgtgcccattctacaaggggtctctagaaggacacctgagcgacttccaagggcatgggtgcagggcattctattaacacatccgttaatttgtttaacagctagatattgagtgcttgtgtatgtggcactgtcctaggtgctgcagatacagacgtgtaccaagcagccaagctgcctgcccaagtgcagtttgctttctagtgagaaaggaggaagcaaatggcagtttcacatatacatatatggctacatagggtccagcgaggagctcacacttgaacaaaggtatgtaggaggcacagccattatctaggtgggcatctggaggaaagtattccaggtagtggggccagtaagtccacaggccatagggaatgtgtctgctttgttcagagaccatgctgagaaacccatgccacccgtaaaagaatggggtgggggcactaggaaataagtacctggacatggcagaattttctagatgactttggctcttaatccaggaggtgtgggaagccccggtagggcttaatagaagtgatgggtcttcagactgaattttgaaagcaggacattgctgctgtgtcaagaacaaactgtgttcttatacagaagatgtttaatttcacaaaaccaacccaagattcttatatcataccctggctgcacctttcttgactttagagtttcattaggcaaatcatggtccttttaaaatcgattctagggctgtgaatgggcccagaggctttagacatgaatacattctatgacaagggaatcaatggcttttttgattaatatttactgaatgccaacagctctgaacttagacatgcacaaatttctctgcttcagatatgtatttttctaaattacggggtggaaaacaaagaaactgtaaaaatcaggtaagaaggggcacttaatttggcaatttaaatagcaggagagtagttcagataacaggctccagatccaagttataaagtgccaatcctggggctgccacttaatactctgtggcctttggcaagttatttaccctaagtcctcatccaaaatcttattataatagtacctctcacattaaacgaggtaagtgtatagaaagcatttagcactgtagctagcacatcacacatttaataaattgttaccattattttgcttgagaattggcaactaatttgtggcaaagcaatgaccctaatttgtgactatgaattgtttctccaaatctcttatgccatgctgtttgtactgggttgtagagtatcaccccaaaactcatgtccatgcagattcccagaatatgaccttatttgaaaaaagagtctttctagatgtcattagttaagatgagctcattgctggaatacagtgggccttaatccagtggccggtgtccttataagaagaggaacatttggacaaagaaaaacacaaggagaacaccatgcgatgagtgaggcagaggttccagtgatgccctgtaagccaagtcgtaccacaggtcagcggcagaccccaggggctgggagaggggcccagacagattgtccctcaaagttttcagtcggattcaaccctgccaacgagcctccagaactgtaagaataaatttctgtccttaaagccacctggtttgtggtagtttctcacaacagctctagggaatgaatacattgtcaactcccaattagagaacagaacgcccagtgagcattcaacaggctgggagcaccactctgcagttccttatcaatgtaagtttaatgtggtgttattatgtgaaagaaaatcttgggcattagcataagggctttaaaaattattataacacattttcataggtatttctaaagttaagatatttcttctaattttagatgatggcagtgtatgagaatcaaaaaatagtgggatgatatgactctaatgcgattccagtcttttttaagttaatttctaaattttgaaattgatcatttaaaaaaaaatttattttcccatatgttattggggtagagaaggtatgtggttacatgagtaagttcttcagtggagatttgtgagatcctggtgcacccatcgcccgagcagtatacactgcaccacgttggttgtcttttatgccttgccccgctcccactcttccccataagtcctcaaagtctagtgtatcattcttttgcctttgcatactcatagcttagctcccacataccagtgagaacataagatgtttggctagtcttttgattttgaggttataattgtacttgcttgtatttgacatggacggaaatgaaagtatactgaaaattaatgtgaaaaaataacaaacacattgaatatccactaggaagtaaaggcagaggaacatcgaacaaatccttccaaattgactgaaatgtttactgccttttttcgttcaatgcacgccattctagctcaagtgacacttgtgtgaccctgacacgtgtgaccatgaaggtattataattagcaaagatgtcctctctcaaagttactgttataggttgacattttattcaagtcaaatcacagttgtttctagttccaactcatttgcatttgtttcagttttgaacaaagatatagtcttgcataccctgacgatttgtttataattgccatggcaatgtaacatttcccagcgcatcgcagaatacatgacataagaatatgaatgtaaacatatgaaaaaagaaagccctcaggtggttgttaatttttggcgttgtgtaattaaactagttttgtttaatgttatcttttgccagtatctaattagcaaagccatctgctgaaagagtagtagcccatttgcctagaatgttgttctcttcatttttatgaagtgtctgcctttgctggtccctatctaattaacttatctggcggtggagtgtgataatacacagctttgtttatatacttctgagaactgtggatttatatgtatgtaacacatacataaaaagagccaatctctttttcttttctctatctgatttactcttgagatcacagctccatttatcctaaccgtagtatgtctgtgtgcaacacggtccaatggatgctgtaccttgaaacaatgggggctttgttgcatacccaggatttatgcagatataaaatgggttttccataagcctcttcttttttttttttttttttgtagctctctttgtatgtttgtcacatcctgaaagctaatgatattataagttagagtgtgtcactggacctgagattaacgtgcatatggctactataacaatgaaaatgaacactgttgactcctcagatttaacataattctgtctaggctgatggaatacacttatgctgtattgtaaattaatatctgatgtgtatctctatgtctgtttttccttctgtcagtcacatagaagagtgtcttctgtttggtaggtacttaatgaatatttgttaaataaaggagataattaatgtatttgcataaagcaaaacttctgtgagttgttccttagtacaggtattatttgtatgtatttacagaaaaaaacttactgcaaacaggaatcgttgtgtcttttaaaatgtaggtgtttcaaactcactgcctactgtatctaatctttgaatattcaagtaaccacaatattactgctatatgtctgctgctgaaatatataatgcagacaaaatattgaatagcctagagtagaaatatttcttttctctactgggctatcctgaaatagaaaaagacaaaagatgacaaaaattaaatatttttaaaagggagactcaggaaatgagactatgaatgttgggttgagatctgaaatgtagaatgctttagcacttgttttgactattgtaaagataggtttgggttagtggaaaaacatcttttgaatacaagtggacacgtggcttctcaaatcagtagtgagacttgttctataatcatgatacatgaaataataaaaattttcactgagaaatgaaagagaaggcttgattaagaggtatttggttcattagaatggatctagaagaataaggaagttgtgaccaggttaaacaaacagcctaatttcaaacagaaaaatgcgtcactgtgagaaataagaacccacagagaggaggtacattgatactcttatttgtctctgatggatttttttttttaatttcatgtctgtcaagtgatgaaataggcaaagtctagctgacctagtgaataggaggacactatgggatgaatctggagcatcccattctagtataatctggaaaagccacttttctccattctattccttttcaaattctgtgctatccaataatatgtatatattcctgctgtcttctggaataagtaaagttccattcttaatataaaatttccctttatcctgttctctattcaggtagaaagtgaacagaaaagctgtacaatcatggtctttaattaattctggatttgaatattataggcaagctagtgaggctgtaataaaatgccttaggaaattaattttttttctttctaatcactatcttcagaaaatctgtaagatttgtcatatttattattggtctaataaacttgtaagagcagttgctattttttggtatgctggataaaaataatgaaatattttttaaaactctcacattctttcttctcttattttccctttcaatctttggccaatatttatcttgaaaatgcaaaggctatttgggcattaggtagacttgtgaagctgtttgtttgccatttcagccgcaggatctgaacaattttgatggcatttggtaaatattcttcttccttagccctgggactaatccttctctttatagctttcatgtttatagaagagaacattattatttaacttttaacaaaatcactagaccaatgaaagccaccgtgaatgactctttatctaaagtatttcactgtatagttttcctagtaattgtgtaacaccagttcctcttggtgatatgtaatactgaaacctctggcaatacacaatcaaagttataatgagttttactctgctgaaagaatatatcatattctttcagtcctcaatactgttttaatcaatcctcaatactgttttaagtttaagtaaaggccaagacgtggatatctacttaaatacaaaaaaactgagtaatattttgtaaagagatctaagaaaggaatatactaaaggtcaaatcagatgaacaacaacacatttattttcatttattttatctgtacttcatggggatatagttatgcaactgtatgggaggctgttttctctggaggtgtcattgcttttcatgaaaatatttgtcatcctggtatggaattcaaatcatgtgtttgcatcagatgctgattagctatgactgtattgttaccatcaaacattatgaacagggaaacagcacagaaggaattaacaaattctcttatcagatgttgacactgacaaaaatcttcaagtctgcacaagggaaaacagttatagcattgttttggtttcaaagacactgaagtggttctttctagaatacttttcttatggactcatatttgccaagtaacataaattatacaagatgcagtgttgtatgatttaatctctgttatgtaacattctttggaaggcagaagatattagagaatggtgttagcctgactttgttattctcccaagtttggataattagaaagaaaacatttcttactaaaaaataagggtgaagccattattttccttcatatgatttgacactaggttgcttttggtttagtttattatttgacattagtccaaattaacagaaaaaagtctctatctcaaaatgtctttctgttaatgattgaattaccgcacatccctgttccttcagaaatccaattttaatagtaaaatagaaaataataattctgataacaggtatggagaatgaaaaaaatatttttaccctataaaagttcacactctatacaatgatagaaaagagaaaaaaaaaaagcccaggtgcctcaatttgcgcaaaaaactattcacgagagctaggccatggatgcctgtaggcatcctttctgtaaagcaagccctgtctgttttcttcactaatcacacatttcatttgtgagttagcatcagacgtggaagcacacatagcaaattaatcagcataagtgagatttggaaattctgagaaaaaatatttaaaagctgtggctctaaacatttagtcagagctaataatagtatgaaaatgactgctactggggaaaaatcctagctatgttctttgcatgagctatctattgattgattatcatttacaggtatatcttggtagtaaggatatgcaaaatcatccttcattatctatgaatattgataaatgacatattatttgaataaaataaaaatgttaaaattaatatttaaattatcttgtctcaaggcctctcccttaagcctcgtctgggtctattccatagtttcactgaagtgatcatttctaccatcagtgctatagtcaccaactcattgttcctttctaacagtgactagatctaagcatcccatcattactacccaaaagcaaatagtaagggggaaggtccttatgcttcaatattagagctaaatctaagcccatgactaaatttcatgtatttggtgtaaattctatgagtatgaaaatgttggtgccaggatgcagccatatttcctaatctggttaccagtgccttgttaccttgtttatattttcccttttatttagtcaaaaccatgactgctattgttttggtgttttctacaggctgtggaatgggagtgtgatgaagctaccaaaaaggcctgttacagcaaaggcaaatcaaaggtaagaagaatgcaattatgagcagccatcaccctgtcttgaaggactctacactatataaagcatgttgatatgaagagtattcctgattacggtgccatgtaaagtgaaaaaagcaagattcaaaatatgtatacggtatattctcaagtttttaatactaaattaaaattaaccccagcaatcaatcatttccaaaaaggattcagaacataagaagatcagagctaatttgccctttctgtcattagactaagataagaaattaattgattgatagcgctggaaaaaatatgggcctgaatttttaagatattttaaattcctcctttcttactttacagctaaatctagaaagtaatgatatgacaaataaatttattacataaaatattatttgtgatagattctttatcttaacatattctttataataaactctcttttcatacgaaaatctacatcccatgttcctatagaatgtgcagtttatagctaaggttggaaatgtgtttcttgagcaattgtacatgttgcaggcttctttcaaatgtttctctggctcaaaaagatgcgtgattctttgcctttccaggaagactatgtgtctttgagaaaattattcatgatcaacttgaggaaattcttctgcagcttgtgaacaggctcactgtgtattattctgttagtgatcttcttactttatattggagcacagacttccaatggtgaattatgctttgggttacagaagacagcagttatacacagagtagaaaagagggcttgctatgcaaagttggtcctaggaccaatagtttggggaaaaaaatatagcaaatgcagagagcactggcaaaagatcctcccccttctgtatttataaaagagtgttatgtaccttttttttacccaatttcattgtctgcttccctgccctttaactgaatcgctgtgggagtcagacactgaggcaagtgtcagccagcttagttatggggtttcccaaccctgaataaaggagtaggaagaagagaaggaggaaaatgcagtcttagccagggaaacacttggagacaagggggaaataaagcaggaattgatgaagggtattttctggaagatatttaaccgcagaaaaggcctctgagttaaatcatcagagatataaggagatttaaaggtactccaattgtcaaagaattcgaatgtgatatcctcaaatgctccccaaaataaataaataatctaaagcccacacatcggggacccctataaccttcttgttgagtttgtagaaatgatgtataggacttttgaagaggtgatttctaaatagtttcctttttcctccctgtggtgtttgagtctcaatgtgggggttgtgtggctcggccctcggccccacttcactggtcagagcacagtcctttaaataagaccacctgtgccaaggaatgagatgggacctggagtcagacttacatgaagtgaggggtggaaagatggctttctttatttcaactagtaagattcactgatgcaagcaccactgttccatgctctcaaggcctgccgtgggccttgcctggggatatcaatgcctcccaggggttgctctgtgtgatgcctgatatggtttggctgtgtccccaccaaactccatcttgaattatagcttccataattcccatgtgtgctagaagagacctgggggaaggtaattgaattgtgggggtggggcttccctgtgctattctcatgatactgaataagtctcacaagacctgatggtttttaaaggggagttcccctgcacaagctctcttgcctgctgccatgtaagacgtgtcttgcttccccttcatttgctgctatgattgtgtggactccccagtcatgtggaactatgagtccattaagcctctttcctttaaaattacccagtctcaggtattagcagtgtgagaacagactaatacagtgacctagctctccctcttgctttttctcaactctttcttcttgtctttatcttccttctggtactttgactctttcctctcctctttttctttctttctgggtctcatggacacatcaataagcactattcagatttgagcaacctagcagcagatattgttgatgcacacttgtcacagtgtctgttctgaaaatgtttagctgatagcccagacctgaggggccccaccctccttccctctcccaggtcccagtgctatttcctcgtccgatcttaacactcccagcccacggtgagcgtttaaagatgttccactgaatgactgaatgaacatgagaagcccataccagggtagtgaactttaatttagggtttctcatcttcatcattattgatatttggggccagattatgctttgacatggcagctattccatacatggcaggaaacacattgccagacattgacctggtcgggaatccctgctttaatttccaaaatggcaaatttatttgtcacttttgcattgtttattttgatttttatgctccctagagtcctctcatatttcatcttgattacatgtatatatttgttacaaagacgtttaaaaattaacagttaactcccttcccctttatgagcttcagtctccttatactccttgtcctactaaagcaaagcatcagattccatcatgtagcgaggggtttttcctcctcatagtctggaagtccataatttacaaagaatctatgtggttgccttttgctaatagattatttctacttggggtgaaaaattgcttctgctgaagaagaactagcccacgttttgccttaagccgtgatcattggttgtttggtgcttagaacttaagtaaattgaacccagagaagtattaggaaaaggccatcttttgggaccgataggtaatataccctcgattcacggaggagaccaatcgttactacacttaattgaattttcttgatacacagaaagcaaatgagggaaacaaatattttcaagtaaaatcaaacctttatgtttcacatgctttgggttttaatggattaaaaataatgggaaatcttagtaattattaattgactcaaaccgcatttgtgaatggattttttaacactaatatagtaagacagatgaagatgagtgtcaagcaccacgtactctgagaaagataaatcacacgttcttttaggttgccttaagtatattgataaattcacagacagtttaaataacttctgttgcttcgaagtacagctcagtttatgtagcagagctgtgtgcattggaaattcctgtgtacaaaaatgatgcagtagctttacaaacatgttggtctagacagcactgggctggttcatgggtggtgagaggagagggctcttcacccacctttataagttcctctttcttatttggcatctctcttgctttcttaacatagtaactgaacaatgaccatgatgtgaccaagctggctgaccaagcccagctcctgggacagagaagggaaagaaacaaggcagcccctatgaacaggggcaactggaccaaatgcagcctccgaaggactgccccctgaactcagaattcagacaacccacatttccccattttgacagttcctaggagccaattcagagaacattctcacagtcaatttgactgataggtaacgtctctttgggtgaatggaatgaagacttttcttagtggtcatgagcttagaaggctaattcagctgttttgtagttttgcttgtgctgaagttcttatgagaacagaattacaaagtttcccttctccctgaaataaaaagaataatgcaaaatgtgacatctcaaaaatgagaagaatgccagcaatttaaactgaagttgttttttttttttcctactctgagaaaagtggtctgtgcttctgcacataatgcatttagctgctgagctgagctggaatgcatgcatggaaggaggtggctgggtgtgcagggaggacactgcctgtgcccacttgctgttctgatgggagcattcctcagcttgctgcagagtggaggagagtagagatgatggatttccccttgtttccctgggatgtctgtatccagacacagatatgatttcacatataatccattaaaagtacaatttagggaattagggtcaagagaagttatccagattttttatttgggccaggtttgaaaagaaggtaggtactgaagctgccaagcccttgtaaagtttgaattctattttatttagaaaatgttcagctcccttgggaaagagggagtgcctttgcctgcaatggcttaaatattccatgggggaaaaaaagtgggggtggggaatctgtttttatggattcaaaaacttataataaaacctgttgtatttagttcttctggacatagcattatagaaactgaattctataactacttaagtatcttttacacaaatattattttaaacacaaatagtcaattctctcacgacctaacaagagttccttgtgtgtgttgggctataatgtctgaactgacgttcctcccactctgacatttaggaactttacaaaggaaacacagctgattattatgggaatgaaagagctgctgtatgcttctattacactttgtgattttcaaaagtttttgttcatgatctcatttcaggatttttgacaccaagttcctagaattattttgctagttagtgggagggttttgattagaatccagagctatgtatattgttctccctgtcatatcctgtggtcctgtttaccaagttgtcaaattatgctggtaaagaggtaaactcctagtgaacaggagaagaaactcatgacaccatactacctaagtgcctgctggtgtagggctggatcttgacattttgtacctaagtgccaatattttgaaagctgtgagttaatcaatacatgggacacattgtagccctgcttttattttatgtaattgctttaaaaattgagggtactttaggttaaatactaacattaggttaaaattagattatgcacacctaattttattttttttaattgaggtatccaaaaaggtttcccatgaagtcagctcagttgaaaatagagtatgtacatatatacagtatagtatattttatatatcaatacactgtacattacatagcacgtaatatatgtatatgagtgtttatctctacatattgcatctgtgatttgcatgtgcatatattcacaagtaatacatgtatacaattatatagatacaacctttatacacacacacatacacacatacatctgatttggttaggtatggttttgcaagagtcaccaggtaatcatgatttaggttgatgtgggttcaactttgaaaggctcatgcaattcctgtaaattgctcttcttcagcactttgatgctgacaaagataacacattatgaagaggacacattgatttcactgggagcactatgattaacataaagcctgtagccttctaacccttacctttcctccctaaaattagtgggctgggcgacgggctgggtattgctgaagagatacctgagggatccacagaacatacctgtttaaaaaaaaatcatgaaatgctatatgacaaaaccaattaattcattaagaaaacagccctaaaacatgttttctctgctggggctggggccttgtgtccttgagaccaagtgggtattggccagtctccatgtaaaagccctttctatgagtcagcaaccatgctcctcggctatcaattgccttgaagtcaaggacaggttgatacgtctgtggatcacaggcccacatgggtcattttaatgttcaagtgctgtgatcaaaatgtagatagatgactctcattatcaaccctagaagccttgtggcagcaagctgctagaggccttggagatgtgcactgtgacttcttggaaaatcagaattcattaaatcctcttcacctattttcaagttacagaaatgggctagaagaaaaaattcttagatgacaaaaggaaaatcatagacatttaagtatgctgatttataagagaaacctttaaaagaatctcctaaagggacttctacattgtgactctacctctacattgtgactccaagcagtacttcaagcaagttcaggtaacccatggaaaggccacgtttgtaacagagattggcaaagtgcgttgccagtggatctgcaagagaatttgagttttgaaaacaccatcaagaggagactaattattacacagcctggaacggttactcatttccattttttttttttttttttttttttttttgagatggagtcttgctctgtactcaggctggagtgcagtggcgccatcttggctcactgtaagctccgcctcctgagttcaagaaattctcccacttcagtctcttgagtagtagctggggttacaggcatgcattaccacacttggctaacttttgtatttttagtaggcatggggtttcatgttggccaggctggtctcgaactcctgacctcaggtgatctgcctgccttggcgttccaaagtgctgggattacaggcatggaaccaccgtgcccagccactcatttccttttattcacagtattgactgtccaattcccaaatttatcttctgctcaaaagctaaatacttctactttcttttttttccctgtgttttcacattctgtttcagttgaacttgtcccaatctctcttttcaaaacatttattattttaaatgaatttgtttggaattcacatctggaattcacaatctgtgaattaaacatgaggatgcctttaagggagtaagaacgggaagtacgtgagatgcccttagccagttgggtgactgagttatgctcttgacagttaagaagaaactcgaataccacccacctccactcgttgctcctgtaggactcagtgaatgagcacacctactgttattggtgataactcagacctctagttaaggctggggccaactacactactaccctccttcattagctcctgattgccacaggctcctctgggttccatagggctggggccaccctccatcattttataaaaattctgcacagacctccttgcctgatcatctggatccctgacatcttcctcctttttttccacacactcactccgttctgcgaagaacaccagtgacacatggggatgtggctcatcgccaataatagagccagtgtcttcatgtattctcacgtggtcttaatgatcagaacgtgctctttcattctctgccctaattgaaataattctgtccctttcctcatttactttttctctgatattcttacactaccagctgggtttgcactgcccctccctggcacactgctgcaccatggttaccatggttatcacacattctgaccaacatgctggttcttcgtcaaccttgagagtggtcttcaggaatgttaacctatagttgcagggcactgtggctcatgcctgcaatcccagcactttgggaggacaaggcaggaggatcccttgaacccaggaattcgagaccagcctgggcaacataatgagtccttgaccctacaaaaaaaaaaaaaaaaaaaaaagaaaaaaatagccaggggtggtggcatacacgtgtaatccgagctacttgggagactgaggtgagaggatcacttgagcccaagtggtcgaggctgcagtgaaccacgattgtgccactgcactccagcctgggcaacagagtgaacccttgtctcaaaaaacaaaaacaaaaacaaaagaaagcaacctacagtcttatttgcactttgttcttcctttgggaaattaacgtaaacaccatatttgatatcttggttattctcctttccataattgactggaggcccttgctttctcttcaccagggctgtagaactctgctgtgaaatcacatcttttcaatccagatgattctcctggaacaaattacccttgcccatgttgtttgtggtttaccttggggcaagctcttgctttttttttttttttaaaggaaaaagttttattacatcttgccttgcttttaaaagagttctaaaagcagcatcaaaaaacaaacaaaacctcacccttctattctgtttgtaattttccatcccagtccttatgatggtgtcattaatatgtctgtgtcatccattaagtccatcagcttgctcagccctgtgttctggaagatgtctttgtgggtctcctctgacaggcatcggcttccttcttttatcctcactctgcctgcctttataggctcccgtacccctctagtttcttccctggccctcctgtgttctcttcagcctgggaaggaagtactgtgtggttctttgaagtcttttgttttgttctttccctttagaactctcctgacccttccccaggaataaaaacaaaagagaacaaaacaagacaagcctcccacctctggtgtacctttctcagttaccagattcactgtctactgtttacgagcatttggtaattcttctgaagtctacttaggtctttgtggttgttttccatcttcctcagttcagcttccaatgataagtggttactattactgttaggaataatgttaggaggataatccacccttggtatttcactttacatttagaagccaatctgagccaggagtggtgctcgcacctgtaatcccagcactttgagaggccaaggtgggaggatcatttgagcccaggagttcgagaccagcctgggcagcatgacagaaccctgtctctagtaaagaaaatacagaaattagcactatgcatttccgctgtctcgatgctatgcagtagactgggttatgggaaattaacactttcatctagagtgggggtccatttggttgaagagaagatgagctataccattacatccagattcccctgatttccagcatgatgtgattcaaatcatcatgttatcatgcagcatctttcatgcctcgtgcgtcattcattcgccatggcgtgcaattgactcactattctggctttgtcctttcacacctactaccttggtctaggcatgaaatgacaagagcctgagttatggaagtgacttcctccttggcttcctgactccaggcttctctcttcagcttatcctgcacattggtttctgagtgcttcttcagtgataaaacatgagagctcatcaatacttcacgcagtcaaaacatgtaatggctcctttcacattcagagtaacatgtgaactcactacctgggcacacttggcctgtttcaggctcctcggcttctatgtgagctcctctgtacacaatgagagcgccatgctttctctagccacgacactttgacacagtctgctcctcttgagtggagtgtcttttccctcctttgctcagtaaagtccaacaggtgtcctacaagcaccccctccaggaagcctcactaaaccttacactttatttaacacttagttgtcagctccttcaggaagcctctctacacctcttcccttccctgttcctttggagctacgtaatatgctattcctctgtgtgtcctcattacagtgcatggacagctctgtggtaattgtcatgatcctgtatttttctgccaggagcctggattgagacttctaacccagtggctaccaaagaggagctactcagtgaatgcttgctgaataagtgaggagctctccagctcacatgtccatcactgctatgaccatacccagggttttctaagaacactttgcaaccacaaaaagtactccattcttggagtatccctcagcctagggttttgtcccaaatgtttcgaacatcttgtcctcattaagcatattttcacttttcaatcaatgaattaaaaatgcctatacaggccgggcgtggcggctcacgcctgtaatcccagcactttgggaggccgaggcaggtagatcacgaggtcaagagatcaagaccatcctgactaacatggtgaaaccctgtctctactaaaaatacaaaaaattggccgggcgtggtggcgggcacctgtagtcccagctactcgggaggctgaggcaggagaatggcatgaacctgggaggcagagcttgcagtgagccgaatttgcaccacggcactccagcctgggcgacagagcgagactccgtctcaaaaaaaaaaaaaaaaattcatatagatacttgctttgtatttaaaatatgcagttggatcccataaagtaaaatttgctccagtttgtgtacagagtttctcatgtgaccttctgatcaaaaagcgcttgcagcattttctcaaagtctgaggaagttttccaaggcactgcttcccgagcgacatctaataggttccttttatttattttcctaatacccgtccaaggccatttagcatttgtgctactatcagatacaattcaaaatgaaatcatttctgtcaaaattagatgcatgctttgagaatttaattgaacatgtatttatcttcatattttttatcaaacaaggtgcagatacagcaattaaatttatttgataaaaatcaaattgtttaatagctctgttgttattttttggtcaatatctgaaaggtttatttgttgttttaatggtttacattttattaatggcttacatatttattagataaaatgtattccttctcaccattcttcttgtgctcagactttgttagcatgtttatcattatacatatatatatatatttttaattaatttatttattttccctcaggaggaatgtcagaactacatccgggtgcttctggtgggtggcgaccggttattcacctgtgggaccaatgcattcacgcctgtctgcaccaaccgctcggtatggcttctttttgtgcctcaaaagaatttaatatcagaagaggcaaaacattgtgtaaaaatactagttttaaatgaatttctatacaccaaggtgttgctgttcaattctaaagcactttttgtcaaattgaataaatatttgatttattgatatatttctaatcaggaccatcaattagataaataactggaaataattataacttgtataattaaacttaaatatgtttctaaactattccaaccagcatttttttccaccagtgactttaaacattaatcctaaacatattcttttttgtcttattctgctttatggtagagatactgttactgttatttatatttatttaaaattattaaaatggtctaaaatcacaatccaagggaagaaaaaattagcctacaaattggataagaagtatgtaaaaaaaaataagcaaactaagaaattgcaccctaggcaaagtccagttataactgatcctctttcttgtctttaacctggcaatcattgacagagtaattttcagctgcacacaccatagcagtagcatggcagggtcagtagaacacacgtggaatcttcctaattcagggtataaatgcaaccttcctctgggaatatcatgaagaaatatgttcattccctggttgcacaactttcctcaagaccttaattgaccatctgcttttactgttcatgatttcaggttagcattcagttattggaaataaagggaggagttggatgataaggggtgtgaaactcagggagctctctaggtgctgcaccctgccctgggcgctttcaccagtgccatggttcagtcctcaacatctgccccacaagatcgctactctttggggcccccttttatgaaagaagaacctgagacataaagagctgaaggaacttacccaggtacacatctcatagcagagcaagcagtgtgcctgtacctaccgggcctgacccttctgctccaatacctctcaggcgagaaccaagaaccaaattgagcaaagattccaccagtacccaagagcttttctcattcaatggctggttgggaatccagcatttgggaagctggattcatacgaaatgactccaagacgcttagctatctctctgaaaactgaaaaaaaagaaagaaagtgttggaaatgtgggccacatagtgttgaatatccacacatccttacttgtgaacacattttttggggctattcattatattttgcttcacttatattgatagaattatacataattttttttttttttttttgagacagagtctcgctctgcctcccaggctggaatgcagcggcacgattttggctcgctgcaacatccgcctcctgggttcaagcgattctcctgcctcagcctcccgagtagctgggactacaggtgcatgccaccatgcgtggctaattttttttttttttttttttttttttttttagtagagatggggtttcaccgtgttagccaggatggtcttgatctcctgacctcgtgatctgcccgcttcagcctcccaaagtgctgggattataggcgtgagccactgtgcccaggcaattatacataattctttattgtgatcctatttctgtaaatattgacactggtttttatattaaagtggaaaagtatgcaatacttgtgcattataaatcaaaggcatatatacaatgatcttatttcttattttgtgagtattcagtggtacaaggttcagtaactctaaagtgatgagaaagaaactgattgatggactgtcttaccatgagcagagtaggctctttacatcagttggaatgtaaaagttggtcatcttgccccatgggcccccgagaggctgttgcacaagcgtcactgtgatgatggtgggtgtgaccataagcatcactaaaggggcttgtgcagagataactgctttccctctcatcctcccccacagttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatggtaagccttccgtcactccctctttctcacctcatttgtctttgattcctggtgatttggtgctcaaaagcaaactacaacactctaaataaaaatgaattcttcatcttctaaagaaatcaaagtgtcgcttgttcaggactaatgataaacaggatatcatatggctatttagtatttggaagagaagtgatattcgcaacactctaaccatgataatatggctaatgttgatatgaccacttatagaaacttgctgtttttttttatattgttgtttaatgtctagaaaatttgacagcttgtcatgtgtagactcctgtgcattacttcttaacttccattttatgtgtctagaaatggaaattactaacatggcatgtaattttcagcaactgtataaaagaatgtgtttgtctataggtaactccaaaaagtatgacaattaaaaatgtaaaaaatgtatcaactcacatacttagaagttagtagtaggcatcttcagggtttattcattcagtggctcagttaataaggaggcgagtattcactgcagtctctgccatccacagtctggcagatgggccctcaggccacctctgcttgtggttgcaaaattgttgctgcaaattcaggtattgcatccacatgtggcaacatccactcgaagaagagccacatccctctccccttttcatccatgcatttatttttaaagaaaccagaaacccttagaaggcttctttcagttctgggccagaacttggtcacttgcttactgagcaatcagaagatggtgacaaccatccaaattgaggttcgctgtgtacaaagccctgatgtgtgtcagctgaaatgcagccctctgtatatctgtgcattcatgtgtgagtgtggtctcacacacacacgcacatacacatacacctacaaagacaatgtatatgtaccatgtgtaatccattgccccaagcatttatttgatagtttgtacaaaagtgaaatcttgagagttagtagacttttgctacatatcagctaattatgtagaccagagtttctcaacctcagcactagtgatgttttgggccaaattgtcttagttgtgggactggggggtgggtcttgtccttggcatagtaggatgtctagcagcattttcaacctatagtcattatatgccagtagcatcctcctctgcccagttgtaacaacaaaaaatgttttcagcaatttttcagtaccccctgggaggggggaattaactctagttgagaaccactgctttagactcatcatatatgcaaaaccatggatacgtgtacatatattcaatgcaagtattttgccaaataatacagtcaacctaatcatcagagattgcctttaaaagactgtcctgtaggaaaaaaaggatgtcctcgtcattaactttctcaagtaaactaaatgactctattgcttccaaagggaaacatgaattgttttcccaaactgaagcactaactagaattctcccattaacatcatttctgttgaactgacttcaaccgaatcagttgattctatgtggatggtccccttttggccctgaaactttcatctgtgcagcttcaagttgttctttccatatgtttgttgattctgactggccaaggaagtttccacttaaaaatcaagaatccctatcccaataaaagctttgtaattagcatttgccagaagcaaagtaaaaagctcttttcccaaagtgacactttaagaatatcctggaaaaacaattcaggtcatagtatgagttacaaacactagctgccttcttacatgtgactgagtgaccaccagctgatcaggtggtcagtatcggtcagcgtcctggttgtcagcatctgtgaattctccttttccattggagagtcatgtgttgccatccaggcaatggaagagctaaaacagtgtttatcacagtcttctcaggcataacattgttatttgatttacaaaggcattaatgtttccgattcctaaaacattctgctgttcatttctaagatctgataactgcagacactgaaagtaattcagaggtcaatacggtggctctaccactcaggccacaagggcagcacaatttgcatgacaatgaatagcctgcatttctcaggaaagcagcatttccaccgccctcccccacactccttccctggcctacattgggaagaccctctctcctaggatagaaaaccaagagccctgcctgaggaccctgagttattgcatatgaagtgttgtcttcatacctctcctgtgttttgttagggcactttctgctactgctgagccctgagatactatttccactcctagttgaccctgattcgcttctctgattgatcctccatccaggatggattctggtctctaaccacactaggttctgcttccaccccctgctgagcctgaacacagggacatttatccttcctggcctaattgggacacaggctttgcatcccatctgttctttgccagatgcccttgtctcaggtcttcctcctttagttctccttccactcctgcccgcctgcactgactcccaccaaatccagccccagggggggccaccccttggcttctgtgtctcttaaacactggggtgctagtgagaatcgtcctgtggtagaaagggcaacagaaaaggtggagcctctgtcttcagtgaggccctcaggtcagctccgtaatggtctaagcaccccagttcctgtcctctccccttgcaactacccccactccagtcctctcccagcctctcccagggattctcaatgggtttatctttcctcctactttacagagaaatgttaggttctaaagggtttttcccagtaagccctcaaacttacctcttcttgtcactcggggtctgtagctgattctttctgctgtgttctggagtaattttcgttttttggacaatatttctgccttatccattatctttcttttcaccataacctcaaatttcttcctttctaatgatgactcatgatttcagaaaaatgttcggggggccaggcgcggtggctcacgcctgtaatcccagcactttgggaggccgaggcgggcggatcacgaggtcaggagatcgagaccatcctggctaacactgtgaaaccccgtctctactaaaaatagaaaaaattagccgggcgtggtggtgggcgcctgtagtcccagctactcgggaggctgaggcaggagaatggtgtgaacccgggaggcggagcttgcagtaagccgagatcgcgccactgcactccagcctgggtgacacagcgagactccgtctcaaaaaaaaaaaaaaaaaaaaagaaaatgttcggatgccttttctcttaagtaagacaaaaacaaagaaaccgcaacaagctaaaaacaaacacccttagttctgccgtgtccaagaatgctcccctttcacatggtgattttaaggacccattaaatgatgctctcagacttctctcttgagttttcaaccaagtgagcaaaataaaatttgagagttggacttgttgcggaaggaggctacaatggggtggtgaaggcgtaggtcttcctgctttggtggccatgcagtggcaattttctctcagcagaaacaggaggagtggagggtaagtccctgtcccatcagttgccctccattattggctgactttgttgaggacggcagtcttaaactcccatcttcaggcaattctcatcttctctgccctttgcatcccaccatgcggcgctgctgtggttctccccagtcccacagtgtctagttacattatttgaggaccgatttccagccattaccttaactatcttactggaaggatgacattgttgcctcgaagtttcttttacagaaagtttatgctgtaccatacttaggtagtgcacgctgtggcttgagcgtctgccctgtccttgactcttttccttccgctggtctttaagctttgcttatccctgggaattctgtcctcaatcccttccttctgcccactcttctcattccacacgcttttcttggattcccatctataccaaattttttttgttgtttttttcttagttttctatttcaataatttctggggcacaggtggtttttggttacttggattcccatctattctgaagtttttttgttgttttttcttagttttctatttcaataatttctggggcacaggtggtttttggttacttggattcccatctatcctgaagtttttttgttgttttttcttagttttctattccaataatttctggggcacaggtggtttttggttacatggataagttatttagtggtaatttctgagattgtagtgcacccttcacctgaacagtgtacaccgtaccctgtatatagtcttttatcccccactcccctgccaacctttcccacaagtcccaaaagaccattgtatcattcttatgcctttgcatcctcatagcttagctcccacttacaagtaagaacacacgatatttggttttccattcttgaattactccccttggaataatgatctccagctccttccaagttgatgcaaaatacattattttgttcctttttatagctgagtagtagtccatggtgtatatgtaatcacatttttttttctattccaaaattttaactcccctgactcacaccatgcccgcctactgaggaccattcacagatctggtctcagctccgacttagtccacagatgcgatgttcacttccagctggatgctccttgcagtactttcagctcagcctaccccattcatgttcatttctttgtttttcaatcttgggtatgggctctgtattagttttctagggatgccatgacaaagtatcacagcctgggtgcttaaacagcagacatttatttgcccaaacttctggaggctgaaagtccaaaaggaagctgtcagcaggattggtgtctcctgaggcctctctccttggcttgtagatgtcatcttctccctatatcttctaaacatggtcttccctctgtccatgcctgttgcctaatttcctattcttataaggacagcagtcatattggattaaagcccactccaatgacctcattttaacctaattacccacttgaagaccctgtttttgagtatagttacattctggagtactgggggctgggaccttaacataagttttgggagacaaaactcagcccagagcaggctccatgtttcacctctcatctgagccagacacctgcaaatctcagccaactccttccctctctttccagacccactcaaccccaggtcctgcagagaccacttttagagtggctcccagacctgagtctttcttcttattcctccacttctgtgcttgttcaagccttcctcatctgaaatgctgcactagcccctctctgacccactctccacagaatagccagtaatatgtggtgtgaagctttgagatagacagtagaagctttggagttagacgatctgaggcttggcccttggggcataaatttgtcttactggttcttggcttcctcatctgcatactgcagatcactgactacctgacctggacattgtgagaataaagtgggacaacgaagatgataagtattagtgtctggcacatagtcagtactccacaaataaggggagctactgtgaactccccaaagtccgatacaatgtctgagatgtagtagggagttaatacatgtttgttgactgaataaatgagtgattatttgggcctgtggttcttgaattactgacaccttccaacatcctctttcctcatctttactggcacattcaagctacatccatcaccatctaatcttgtgacttccagaacattagcaggacttggatcctctagaaggccaccactcagctagcagctgcttacatataatgatgaacaaaactcacttctttgttttgcatgcttttcagttttttgcaacatttttgtgttgaggaaagaaaattgtctcagcaggagaagttgggagggtatagcagctgctaaccttagtcagcaaaatttttgcattccgattaactgtgattaaattgtgtatgagacaatttgcttatgcatttaggtagtccctctgcatgtttccaatagttattggacaaaccgatgaaacgcccagtagagcagtcactaacttttactgcgtgctcatatactgggcactgttctgcccaaacttccaggcagccagcagacagccaccaatgaattgtttcatcaagccataccttcagtgacattttggacagtgcctgtgcttgtttcctaggttgctaaaacaaagtaccacaaacagggtagctcaaaacaatagaaatttattctctttttttaaaaaatatttatttaatttttaacttttcggttctgcaggatatgtgaaggtttgttacaaaggtaaacccatgtcatggggttttgttgtacagattattttattacccaggagttaagtccagtacccaatagttatattttcttctcttctccctcctccccgcctctaccctcaagtagaccccagtgttctttgtttccttctttgtgttcataagttctcttcatttacctctcatttataagtgagaatatggataggaatgaagttagagatttagaaggacagcaaaatgcaatccaaggaaaataaggattataataaagtgatacagaagctgaaggaaggaatagcccatataaaaaagaacttcacaggtctgacagagctgaataacacaatacaaggattttacaatgcaatcacaagtattaacagcagaataaaccaagctgaggaaagaatctcagagcttgaagactggttctgtgaaataagacagtcaaagaaaaaagaataaaaggaatgaacaaaacctttgagaattgtgggattatgtaaagaggtaaagacaccaaatctatgaatcctcggcatccctgagagggaggggaagaaagcaaacaaattggaaaacatatttcaaatatcatccatgaaaacttccccaactttgctagagaggccaaaagtcaaatttaggaaatacagagaatgcctgcaagattctacagaagaagatcatccccaagtcacacagtcatcagattttccatggtcgaaatgaaagaaagaatgttaatggcagctagagagaaaagacaggtcacctacaaatggaacaccatcaggctaacagtggacctctcagctgaaatcctacaagccagaagagattgggggcctatattcagcattcttaaattaaaaataaagaaaaagtcttcaaccaagaatttcatatccggctaaacttagcttcctaagtgaaggagaaataagattctcttcagataagcaaatgttgagtgactttgttaaccaccaaacttgccttacaagagatcttgaaaggagcactaaatatagaaaggaaagactgctaccagctaatacaaaaccacccttaaacacgcagccagtgtcaccataaagcaaccacacaagcaagccaacataataaccagctaacaacataatgataggatcaaatccatgcatatcaatactaatcttgaatgtaaacaggctaaatgctccccttaaagggcacagagtggcaaggtggagaaagaggcaagactcaatagtgtgctatcttcaagagacctgtgtcacatgaagtgacacccataggctcaaaataaagggatggaaaaaaatctaccaagcaaatggaaaagagaaaaaggcagggtttgccattttaatttcagacaaaactgacttcaaaccaacaaagatcaaaaagacaaagacaggcattacataatggtaaaggattcagttcaacaagatgacataactatcctaaatatatatgcacacaacacagtagcacccagattcataagtttttagagaccttcaattagtcttggactcacacacaataataatgtgagactttaacactctactgacagtattagacagatcattgaggcacaaaattaacaaagatattcaggacctgaattcaacattgaaccaaatgaatctgatatacatttacagaactctccaccaaaaaactacaggacatatattcttctcattgtcacatggtacatactttaaaattgaccacataattagacataaaacaatcctcagaagctgcaaaagaaccaaaaccataccaagcacactttcatgtcacagtgcaatagacatagaagtcaagactaagaaaatcactcaaaaaaccatgtaactacatggaaatcgaacaacatgctcctgggtgacttttgtgtaaacaatgaaattaaggcagaaatcgagaagtgcgttgaaactaatgagaacaaagatacaacataccagaatttctgggacacagctaagggagtgtgaagaggcatagcactaaatgttcacatcaaaaagttaggaagacctcaaattaataggttaccatcacaatggaaagaattagagaaacaggaacaaatcaaccccaaagctagaagaaacaggacctaatcaaccccaaagtcctagctcaggtatgcatcatatatagcctgtgtttaaagggcaaatctctctgagccccacagtgctcatctagacaacaaacaatcaaaatcagagctgaactgaaggaaatcaagacataaaaactcattcaaaagattagtgaatcctggagttggttttctgaaaaaaaaaataagataggccactagctagactaataaagaagaaaagaaagaagatccaaataaacacaattagaaatgaagaagaaaatgttaccgctgaacccacagaaataaaaataaccatcagaaactaccagaaatgtattgtcttaaaatgctgaaggctgaaggtccaaaatcaaggtgccggcatggccatgcactctccaagtccttgaggggagaaaccatggttacctcctctagctctagtagccccaggcactccttggcttatgatagcttcaatcctatgtctgtctccatcttcacatggccatcttcctgtgcctctctctaaattagcctttccttataaggataccagtcatgttggaatatcttaacttgattatatctgcagagaccctgtttccagataaggtcacattcatgaaaattgggggttgggacttcaacatatttttttggttgggggatgggtacagttaaactataacactgtccaaaggaagaaatactcaactgttgagatctgaagtcacaacgccttactttctgctgacaatcttaatgctctttcttctactgctggtaaatctgtttacttctcaggcttcctatatcagccatatcatctccattgttagcagatggcgttgtcttcttgtttcctgtgagagtcatgagtcctgaggtagggatggtgatctcctgtctgctttgcccagggcagagggctgttttacatgtttcttccttcctctctctacagtactgctatggacaatgcattcacttgaactgctgctttgtccactgtgcatcgctccctgcccctatgtctctggggaaggggcgcttctctcctccgcaagtctcaagaatgcaagatccagcaagtcaagattcattattgagttgaacaatgctaaaactcttgagcattgctgatgcttgagttagcagtgagctcgatcttgtgttgcttattctatatctgaattactatctcaaaagactacagggaaggatggcagaaatgagtgctctcatagtctagcctaagaggagcacagaggcacaaagcatgcatcatcagaatgtgtgggcagagcatgacatgctgtggccttttgcaaccccaggacccagagtttcagaactaatcttcaggcaaatgatgatactggcttttccatggtgacatctggccgggatacagagatccctgagtaaggacctaccagaattctaaccttcccaccacatcttgcagaaacccatcataaatatctggtatggttctaaaaacctgcctttagcaagctaagtctcttggattttatactgcagttccaggtgcaatttcttatgacaccaacagcattattggttatatactgatgaatacacactcccttccccctgatcctctgcacctctgcaggggctctagatggtgggaggtgctgtcagctgtcagcacaagctggattggagagggccagcaggcctggcccgagctctggaagcctttgtgggttctgcctgtttcttcttgcctggccgctatgatctggctctgcctgtttttacagccctggctcctgctatttttcccgcatgcatgcttggtgtcctttaaggagcaatgtgcagtttcgggggcgcattctgccttcctcaccatgttgctttgcagtttgtgattattttgtcctcactttgcttgattttgcctcctggctaattctggctcctagttagtttagtttaaatttccattttccccagtctctggtgggtctgttccatccctttctcacactgttcaagttgcactttcccccatactactggagctcttggtcagtctcttgccccaaccttacgagagcccccattttacttgcagagaaagccagagtgctgccatggccctcctgttcccttcctgtcctcatctatgtgctcccttggctttagcctctgaaatgccacacagtgcctctggttcttccttgcctttcagagctcagcaaacttttctataaagggccagtgaataaatattttaggctttgcagtccacatggccactgttgcattttttcaatctttccatcatagtatgaaaatctccacagtctatggatgcatgagtgtgactgggtgctaataaaactttattcacaaaatgggcagcaggtaggatttggcccatgggctagagtttgctgggcgctgttctgcctggaaagctcttcccccagacaacccatctggccaactgtcccatcttttttgagtctttgctcaaatgccatcttcttaatggaacccaagcctcaccaccttatttcagatcacagctccctcctatctagcccttttgactcttcttaccatgttcagttttagcctcagctattaatgttatttcctcccaccactacaatgaaagttcccaatgaccaggacttaacgtctttttctcactcctgggtcccacatgcttacagcagtgctggcattaaagtaagcactcaacggacattttttctaattaatgagttaaatggtgctatggtctgaacatttatgtcctcccaaaagtcgtaggttaaaattgaaccttcaatgtaatggtattacgaggtgaggcatttgagagctgattaggtcataaaggtggagtccctcatgaatgggattcgtgcccgagtaaacaagaccccggagagctccctcattcctcccaccttgtgaggacacagtgagaaggtgccggctaggaaccagaaagcaaacccttgccagacaccacatctactggtgcctggatcatagacttcccagcctccagactgtgagaaagaaatgttggttgtttataagctgccgagtttatggtattttttgttacagcagctggaatagatgaagacaatgggtagatagttgacttctttgttttccccactattttatgaattccttaagggcaggggctctgtggaagcctgctttatgtgctcagcatcttactcagtgtctgaaacatagatgaggattaatccatatttgttgaatgagtaagacattagcacacttcacaaatagcagaaatgtgaataatgttaaacatgggagaatgttctattaattatatatcagaattaaacagcaacaaaaacacagatatgcatatttgaaattgaacctggtccaaaaatttataacatcttccctttgagccctcatctcacttagccccccatttccagccattatttattgtcatttctcaaaggcagtacaatcaattggatgacattctggatgaatctggaacattaagttatgtgtttggtaatgaatatatttcaaagtcatattttctcctgtgccaaagtcgctcttaaaacaaacttatgtgtttagagaaataccttaacagctttaatgcattaaaatattaatcgttaataactttgaaatgattactgtaaggcaggataataaatgtttaatggttgatgcttaaaatagaaaagcaataaaacttgccttcaagaaactggcaatcaagttggggaacaataaacccatgaaaaggtgaaaatacatttccaaattaatattgtgcaaattgagtttgtgagttttgaaggaattatgtgcttgcacacagaggaaaaacttgagtaggaacttggaaaaactaactcctaaatgaggcttaataactcagcatgaacatctaatccacgtagccttattaacactcagagaccagctggctttccttctctggtggaaatgtgtacttatcccactgagttctcccagggaactccacagtgtcctgcagtctctgagattttggccaggatttcatatggaggtgaactcacttgaaatccacaagcattgtcttttcaactgtatcattttttatgagctattataattctagttgagaaaactcttctggtaacaatgttaaattctgtttgtttgaaatacattgatgatgttactcaagcattaagtagacccttgaggtctttaaaatgcaactatgaaccttctaatgattaatgataatttacttggaggatgaaaatctcctccgtgcttaagtcaaggagaaattctttctgcttgtcctgaagagaggtgctttggggagctcagtgcttctccttgggaccaggtgctgactctgaacagcctgagcacagctagggtggcgtgactttgttgggctccaacctggggacagtgagagcctgtttggaagggtatgcacagcacagtacctggaggtgtgactggtctgcaagaggtgctctctcgactgacaagattcgctacagctggaaattcagaaatggaagcagaggtcagagaacaagcaaaacaaagacaaatgaggattgggaatgaagtatatgtgggtaccaaaatgcaagtatttgtcaagaaaaagaagctctgtaaagccagaatagaatcaagactgcatagtcagcagcctattttttttttccaaataagcacctggggagatgcttaaaaagaatgaccttgtgaacaataagttcttttcagcattacaagtccaaggctgatatcttattcaagtttaaacttgctagggtgaagatgagatgacatggatggaaagtgtgttgagcaaagttgtgtgacatgtgacacagcacaatgagatgcccttttctaatattcaggcctgatcaagcctgtcagcagccattgccagttgcctatgccttgtgggatggctgcagttcagatatcgtgctgtaaatctaatcttattatctttgagggtcaggaatcattttaaatcaatggcctccatgcatatcgcctgcctgtccatgtacttattggagtatctgttacttgtagttattacaccacccgcaaggaagagtcgcagtagctatttacaatatgctaggtagatggaagactccaaatccatgtcatctgccatccttcttacaacctcttaagggagattgcattatccttcttctacagatgagcactatggggctcagagggacttgccccctgacacaggccatacctgatgcatacctgagctagcgcttgaaaacagatccactccagagcttgcacccttcctcctttacaagctgctgaccttccctttgtttagttggcactttaggaaataccagcgttacaaatggcctccatctctctctcccgatgcccacattttcatgcatgagctgccatgaagaggggtatgtggactctggaaaaggttgagagcattttcttgactgttgtagccttgcatacatggtgcaataaactggggctgttaaacccaaagtagaaaagcctgtgtggtaatttaatgcagacctttatgggtacaaaagtgtggttaagtgacatgagtcagttcttacggtgctctgaaaacactgtattgctccatcctgtacatcgagcacagagggcttaaaagctggggagccacaggtcctctccagtcatgtgaggaagcttctacacttgccaatatacttgccaaaggtcttttactacctttagattttaatttgtgcattccaaaagaaaagggatgagtaaatctttctttctcctgctaccacattatggggatacttgcatgaactgtatatacatgagtcaaggaaacctcataaagaataaatccactacaagaagggatgcctcactgtagtgaagatatcatgcagacgtgtactagaactgctaaaacaattgggaaatggctcaatgttcattgtctagagattctagcagtttcctagtgacagtcttgaatccctcttgatgtccttgcctgatgactaatgttacctcctttccttcttaaaagcatcccagtttagagcataaatcatgttgtcatcttgtttctaaaatgcccagatttatgtgtttctataaatttgtctctatattattctattgaactttttatttatcccagtcaagggcctctgacatttgttcactcactgccacatattgggaagtcggctccctgtgtcttggtcttctttttgccccagctcagatcaactcaggagacaaagccagagccatcatgcacgtttccttattctacagtagcttattgggaagaagtatgataacaactgaataatgttggagctcaatgtcttctttcagtaaaatcttacatggttttctttcagtcttttaacatattttttaggagttaaaatatttaccagattttaaaatttaaattaacattccaataaaaaccttgtattaatttgatctggcagattaaatgattaattcttcaaagaagtgaacctgtaaatttaaaatatcatcagagaaaaatgaacatggcgaatagaaattttgtgttttgacaattttcagaaatattcatgaaatgatatataactaataggagtgtgtgatttggcagaattttataagagagggctatgtgcttggaatggaataagagcagagtagacactaaagtctgtcactttgaactagaacatttagacacatatccagttaataaaactcctattgacctaaagatatggagaattgtaggtgtgagttttggacttgtagggcggtgtgaagaagtggtgcttctcatttaggggaagccagcccatttccccttggtaaaagtggttcctacttgaatcagcaaattcatgaaagtagtgtattttcaatgggtcatattccccaggaagaaggaaggaatcaaatgtgctagaactgtctttccactcctactgcaagggtcttagcaataacttttttctgtcaaggggctcaatgagtgacacacctgaggatgcaaggccctgattgctgtgaaaatagttaccaaggatgcacttggctccaacttcctaccccatcccacaccacacacccaggaaacggagtgataagtttttctttaaaactctttggtgtctctccaatggcagttgaaatccatactccttgttatgggctcctggctttgcctggctttccacctcccgtcctgttgatctctttgatcctgactgtggcttcattccattccttgccagccttatggtcttctcccaggctgctccttctggcagggatgttctcttcccccatccttgtctgggtggccccttctcagcctcacctctgccctttccctattctctcctttctgatcctctgtttctcccagctgccctggccctccatacccttgtcctcactgtaagcacttgttgatctgtcttgtttgtctcctcacactgctcttgagggcacgggctgtgtctatcagtttactaaggagcacccagtgcccaggacagccccttgaggcagtgaggaaatgcctagagcagtactctggccggctccaggctcgtctgtagcatggtccctgccactgtgtttggtttcaggcttgatggaataagtgtagatcttaatttgatatacggaatgcatactcaatgagttatcttattaattactgatactatttactcacatctgtgtttatattaatttttggagttatttttaataaatagaggtctgtattttgatgattaccagcaaagtgcgtttgattctcacaatgatactgtatgttggatgttgttgttattcaaaaacaggaaacagagaaaatatactggtaaataatgtgagtaaattcacacagccagtaggtggaagtattgagccatgtatacatatatctctatactcatgtatgtgatacacacatatacacagacacaaatgtgcgcatccatctattaaaatctatctattatctatctatctatgtatctatctatctatctatctatctatctatctatctatctatctatcatcatctgtcttttagtagaaacctcaggaaaagaactttagcctaccagtagcttttaacctatgtttaatttaatttaattttaagttatccgcttttaattttaatgaatatctagataaaaatagatttgccctggaagcttctacagcagttttatctacataaactgtgacaatggaaacaatgtacccaatacagagagggtctaaaatcagggaatgcttatggaaggcattttgtactgactgataccaacaatttaggaacagaaaactgctggctgtgtgtcacatctgaatattgtttccgttaactcatcttatttttgtgaaatagcttgctatttaaaaactcagcatggtagaccaggggcagtggctcatgcctataatcccagcactttgggaggctgaagtgggcggatcacctgaggttgggagttcaagaccagtctaaccaacatggagaaaccccatctctattaaaaatacaaaattagccgggtgtggtggtgcacacctggaatcccagctacttggaaggctgaggcaggagaatctcttgaacctgggaggcggaggttgcagtgagctgagatcgcaccattgcactccagcctgggcaacaagagagaaactctgtctcaaaacacaaacaaacaaaactcagtatgacttatttatgctcctaaaattctaatgacctttaagctttatatatatatatatatatatatatatatatacacttgatcattcattatcattatgtgaagttctgttcaacagaaattattccaagggacattgagagtaaataaatggtggctactattttgcagtcaaaagccaccttgtgcgacacttgccaaagtcaggctggaaaatgcctgtacacgatgccaaaataataatagccaccatttattggcatcctgctatgtatcagcccatttaattttcacagctttgcaaactaggtctgattgtcagatgcaacaacagaaaatatcagatgtcaatggtccaaccagggcagagtcacaggcatcgtgtacaggcattttccagcctgactttggcaagtgtctcacaaggcgacttttgactgcaaaataatttataattgactttgattctagtaagatttttgtagagttgggattcctttgtgcctttaatattcattcccattgtgtacaaatatttttatatcaagaacctattaaagatctgctcaatgatcagatcgagccatttgaatatggtgtacccccatattgatgctttaggcattggaatagaaagaatatagaatgggaggcttcttttggattctcagtatttggttttgcgtggtcgaaatctcaaaatttttgatgtttttcttcgcatcacttgtaattacatatatggtgagtcacttctcggtagtcctatctgtatggtcactattatgtaagtaaatatgcaaaataaaagttcttatatcatgaagaagaattcttattaacatgatatattttgtacaacacggtaatacataactcagtatgttttacaaacattagaaaaaacagtttctccatgcatatgtttacacagcagctgacgtgcctgtttttactgtgatttagttagcaacatacctcagatctctctttcatgcactcctatccattgtagacaagaagaaaatacctgattttccttctgacttgttcaattcactcaggagtgacagatactagtttgtggtggattgcattttgagaaaagacagaacttaaataatggaaggaaaacaaaattcatcttatcatcctgcctggcaagactctaacatcccctacttccaaatttatatcaataaatataagagctatttgactgtctgtcttacaattattcccactttttcattgtctttgaaaaaggaacaggatgctagccgaatttcaagaggctctacttttcaagaaactgtgtttcccgagttaatggcaggtcacacagtcaggggtccaccctcatcctgaaggatcagtgtagggccgcatgatgtgtttccaaatgcagtctcactccctgaccaacatgacctgcactgtgtggtgaattagagaacagcactcactacacactgaatacaaattattttgttgtttttgcaaaccaaaaggaaaacatgtatttgagcatttctatctaaaatggacgttgtgatcttataacattggttcagggtggtttggagatatggtagaggctctctgtggaaagaggaaactgtgggtcagtctacctgccattgctcagtcttctccttgtctgcaaaagtggatgtggtttgctggaacagacacagggtacagaatgacctcgtgaaagtcatttattggctctctgaggctatggttggccctccttgaaacaccctctggagttgggtcaaacactttccaacaatgttcttgtttaataagtccttaaagttgtttcttcttccactttttcttctttctgtgtcattcctgacttccatgataactgtggtttaaagtttcatctcatcatttattgtctctctggttggttctgaaaccccccttagactgttcctcagtaaacctgcttaccagtctccatggaaagatgactgtccagccaagagcttaccattgtttttctaaagcagaaaatcaaatcctgttgaatattgctagcttttgattgttttctttttgcaagcactatttatttttttcagtatagtgtaatgcagtggtccctaaactttttgggactaagaaccagtttcatggaagataagtcttccataaactgggggtggcagggaggatagaggggatggtttagggatgaaactgttctgcctcagatcatcaggcattagattctcataagatgtgtacaacttagatccctcacatgcacagttcacagtagggttcctgctcctatgagaatttaatgctgccactgatctgacgggaggcggagctcaggaggtaacattcatttgcctgctgctcacctcctgctgtgtggcctgactcctaacaggccatggactggtactggtccatgtcctgggggttggtgacccccggtctaatggattcaggactttccatccccatcccccactgctagttatgtgaatttggacaagttattaaatctctgggctttagtgtcctcatctgtgaaatgggaagaatagcacagcacctagctctgtgattcttgtgagttcaatggggatataaagcaccaagcacagatcttggcacaagacttagcattctacagatattagctgtttttattataaactcatccttcagctggaaaccataaaagatctttcttcctttgtatcttctcgtttttcagctcaggacttttgagaaactggagctatttactatgtggttttcatgccatttgtccccaagttaatagcagaagtgggtaatagtgagtgtatttgataagttttggtggacctcctgcatgtgtgctggtaacctaagtcccgggctagacacacttggacccttacgccttctctctttgttttccacattttaggaagggttgcttgttgctgtttttgttgttgttgtttgtttttagtacaattcccaaactctagttttgtttagccagggtgcaggacccattccaaaataatttagactcttatttagaattagacatgccagtattattttctttacacatggttttgaaattgttccgtatctttgcttttggggcctgcttcatcaggtaattctgttttggagacttacagtaaacacagacttaacacccccccacccaccacccagtattttctttattttccaaaaacacaagttacagatatgtaatctgctgtttttgtgaacatctctccaggatattaaagcatactatcacagtaaagatatctaacctccatcttttacaatgttatgcaattcaagtttttttttaaacagtcatttagggtgaaagcaatagtgacttaagaatatgttggacggtttataaattaaaatcacctcagtatattacttgatatacttcaatgacttaacaacgtattgtactgaagggaaaagtatcatacataaaccatttagagtatttattacatttttaaaatgtaaagttggattaaattaaaacattttgtgaaaatatcgaatataggtattgattgaaaattggcaatagtcttcctggacagaataacagagtagtcaatcccaaccctttgtcaatgtctgaagtcaacttctgcacttcagaccttaggtgattccatttatgtgtcttactcttaacattaatggcttatcttgcagccacacatatttttagttgtcctgccagtaacatgttattattgcagtgcaattgtatctggaaaggtacaaggccaattgaattgccccaacaaactaattgtccctgaaaatgtgtctttgtgaatatacttgttgtctgtatctttccattaattttggacaccaaaggttactgctataattatcctaatttgcaccagaaaattaagatacttgctgattgaatgaatagcatttagaaatagcgaagaataaaaccttgtgattagagttttaaaagcaaatattacggagtatgtgtatctcaaaatgtactatctctattatcactggtttcaaaccggaagttaggaagctaaaacttcaaatgctgtatgtaaaattcagttgataatgtatatttcctaaattcctgaagatcttggtgattaagtaaaggctttgccataattttgccatttctttgtttccccattttaaaactaattatgagaccagaaaactacaaagcaatgtctccatccccatactcttccctcctctaaatggtttacccagcaaaccagaaataagaaaatcagagttgtttttcactattccatggtcaccatagcaacagaaattgctacagctaattccagacacaccttatagttttagtctttattttcattcccaacaatgaaaacatttttaacgtccttagtaaaagcacatacattatgtcgaagtcacaggaatgtatataagtcaaataattttgttgtcttgcacacaaataggattgtagactgctatattctgaaccacatttcatctttttaatcatattttctccctctctgaaggttatgtaagaatttgcaaataaagtaatacatattgctctaaaatgtactgcaaatatttgctgccaatttttgttggtattaacgtcccattaacttgagccctaatttagctcgggatacttgagtgtgtaatcataccagtgacttcccattatttagaatctgtgtatgacactgagtttcccaacagtgtagatcattaagctgctcacggggcctcccaatagtcctataggaaccaggtgttatctaaacaaaaccacgtctctttggatgaaatactgagcaggcaagaccaaaagggaatgacatgaatgttgagattttttccctcttttctattgtttccagagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgtatgtaacttgaaataatttttctcccctctctcttactcattctgaataagtcttctgttctttgacctctgaggttttaaatttactttagagaaaatctttcttaatttactgggctaacagacaaaaaaagaggacttttcagtagactacatgttagataaagatatgtgatttgtgagactggtattaggaaaaatacgccaaatcaagaaagtttttgtcaatctttaggatatagtgacattaaattattctattataaattgctccttcctgatttgccattgtgttctgggcactttttgaaatactgatacatattatatgtatattttttctatatgcaagtcatgcatttgtgtataatgaaaatagtgttgcctggagaatctgaaatctttgagataacatggctcttgcttaaaccttgctcatatttgaaatgcacattttccatagctgcattttacactattattctagaagattgcttacttgagcacacattttgtaaatgtcaattatacttttgaaatatttttgtaaaaattatagtattttttgtctgggggtgggacagggagatactcctaactttagaatgaacaatatttcggctgtcttaagcttatgaagttttctgatctctttcactcttaatctagtggagtatcacatgtctccagagttatttcctatccttagctggtatgctgtgtaagactcaggaggagcacgtgccaaacccaggaatcaaggctcacattgagactctgagcatcactttcctacacactggctgtgctgctgctgatcctacactatgggttctgatttggatcacctttgaaatctcttgtcttgtgacttaagactttaagcaaaagctgaatatttgtatgcaaagtaaaggatcaaaatctggatgggttggaagtgctgataaatgaggtaggatgaccaacagtcctgaattgcctgagattatcccagttttagcattgatgacagccctgtaactaaggaaacctctttttcctgggtgaaccaggacaactggtcaccctatgatgtcctttctgcttcctaagtattttaatttactttttcatctcttgggcatcagatgcctgcccatgagtggtatttctaaaaagtccctttacctgcagcttatttcctcattaaccttctcttcctggtctctccactgcttaacttgtgttagtatttgcttaataacaacttttaccccccatgaagagtcttctttctgacatgaggttagaaaaataaggctagtatggatggctccacacatatccttgctccaccgtggccatctttattttcataaatctggtcttcaacccagagattatttcttctctttgataagttactttaaaaaatcaatttacagtttctgaagttgattttctttccaaaaccttgtttaaaaactagtgtagtcacacccaagataaatgtgcatttgctcagttgacatcagttttatgcacaaggagagtctggtttacttagctcttcattcccctggctctgggcaaaacaaaacaaaacaccaatttcagaagttataaaagtaccatgcctggaatattgcaagatggtgtatggtcaatttagatagttgcaaaaataagtttcagactactctagactatttgtttagtgttgcaaattcccatcatgtcagaagtcacccaatgtacggaatctatacttttagagatagaagtgctacatctcccctttctccctggaatactaatttgtgttgggtcttgagaatgcatttctaatatgcccaactcaaatttcacaatattttccacctccttttcatgtctcagacaaggtttttttcaaacggaaagaaaaggaggatcagaggtcttatgaatcagaaagctgtccgatactgggctgagcttcagggctcagaatgttgctttgcctctgtacattcgtcaaggtttctcagcactaggggaatggggaaaagataaccattccgactccttctgttcctagcacgactgtgtagttttctcagtcacttgagcatgggttggcctgcagaaaatggtgtgctactacaatggagtctctaaagatttggctttatttctaggtatctaaaaatggtggcttaccattgtagttgtttatagtgtagatagtaaactgtagagattgtagtaaagtattactatgtatagatatggatataaagatagtaaagttgcggtggggggtaggatttttttattgctcttgtaagttattaccttgattgctgatagaagccagattggaacaggtggctgcaggtctgttgtccaagtgagcttgttcatactgattccagctttaagccttctcattctcaaggtcatgttctagacctgggctgccctcgcctgcccacaggtctggagaccctgaagaagcgagtgaatatgtacttcctgtagacaatcccatcctaggaagagcggggagggcagagggaggagcacagtggagtcacacaggcccgtcctttgcccccagagcacagcaagtgaaagggtagaggggcaggcatgggctatactataccaattgtgctccccaggggatggcacaggggacaggaagaagtgttcccacaacactattaaaggatgctcagactggcagctactgggacatccaggggagtctctgggtgacaccagagcccaggtcagcccattcagtcctggtggttgtagtgaacagagaaacattatgccagcaggaagaagattaggttcttcctttacctggaagctgcctggaaacctggggccccatgcaaagcaggtacaaatcctgctttatttctctgcagcctgtgacttgggctgcgtaaactctctgtgctactgttttcttacctgtaagtcagggtcttctcaggatctgtaggttctcagtgagaaattagatgatctgtatcaagtgcttagcagggggctcagggaaatattgttattattcgtaatatcccccatttgcctgcctctgcacctggcccaaggcatgcctggatgggatatcctgtgtctagccattcttactccagcacacttattttcttgtccttattaaagtccactcacatgttcaaaggccagtttcttccctgtacttgtgttttaacttctcccattctctctaaggataatgaagagtcaaaagagcaaagtgaacaaacccatagctggtgttcgcccctttattttccagcgccaggccctgtatgcatcatgctgagccttgtccttggtgctggacttctggagaaaatgcagaaggcccacaataccctcaaggccctacttttccataaggatgtgtttactgtctgctctcctgaagtagaatcctgtctacttcacccacagatattgcaaaggattggaaatcctggcatttggagccatactggggaaaatccgggcatttggagccagccttaggttcaagtccagcttccccatttagtagctggctgacattggggaagggtcttgtcctcgttgtgcctggttttccttacctgtgaatttccttcaccttatgaggattaaatgaatgggaattagtaaagtccttggaatagagcctagttcctattcagtatttatcaaatcaaagaaatataaggtaggtatttcagttttggagtttgacctttcctttgatgcaggaaaagaaaattgatgagaaatgcttgtggtattgtctcagagcaagagaaaatatatgtaagctttcttgttttatctccacttcccctttgagaacccggactgagctcaaaatgcaaatttacttaaccaaataatgttgctgtttccatacttagtcagagggcactgaccttctgagggctcccatttatgactttctctcagagcctgaattctaaattatggcttcaggatttcatatgtcagtgctatgtcaaatttttctctttgaccctttgaatttaaaatctactttacattaaaagaaaatatgaagagtcagacagtcactttttataaaatactttgagttgatttttttaaaggatgacaaataaaacaaatatctgggttaaaacacacacacacacacacacacacacacacacacacacacacacacacacacacacaaacagctttccctgctgctgggcaaagtgaccagataaacaggtcaggaagggaactgcatgaggctgatgagagacgccatccgttggagaaggaagtctttttattccagaatttgaaaggtgaagcagatagctagctcttcaaattccctcttgcccctgttgcaactgagtgaattaatcctggctgacaggattacaaggtgttaaatgctaactagcctggtttctgtaccaagatgtttgttcctccacaggggagccccattcacgctctgacttcatccttttgggatctttaagagactgtggtcttgagacctctggaagctgtaggtcacagctgctgcccagtccatagggggaggtcagcaggtgctgccgagctctctgactgccttctctctctccctccgctcccaggaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccaggtaattttcggggggcaaaggggcactgttggcatcccccatgaagaatgcagaagccttgtgtagacaggcaagggtaatttaaaccgcgggtgcatgcaccatgcagctgtctccctggcccctcatggacagccccatactctgctggctaatgtcaatagaccaaggccttttgtgaactgtggcgcctggacccagaaagggccttttgtcagctgtgatgcctgagactgggcggaaaaaggccagcattctgcagcaggttaggaatccaggcttcaattagtactaatgatgctgggctctgtgtcctcagaatctctgatccctaatgaatgacattctaatgaatggggtccagggcacagagcagcagagacacacaaacaggattagagcgctaattggcaaatgtggtgggattccctgttgggaaggacagaatgtgatgcaggcagctgaggaaagaagaggaggtggaggcccttcatctgttatcacaaaactgcaggaggttcaagcttccagggctttgtgagtcatccatctcccagtgttcagaagaagctgggacccaaagagatgaagcaatttactcatgtttggtgagttggcaggtgtattagtcagtttggactaccgtaagaaaacaccaccgactgggtagcttaaaaaagaggcatttattttcttacagttttagaagctagaccttcaagacaaaagcgtgagcagggccattttcaggtgagggctctctcttcctggcttgcaggtggacatcttgctgcattttcacatggtggagagacacctttggggtatctcttcctgttttgtaagggcaccagctccactggaccagggccccacccttatgacctcacttaccctcatttactaccattaagaccccatctccatatacagccacactggagggtaggaatttgggtggcttacagacattgggtccatagcagcaggcttccctggagggccttctgacagctttcttaagatcatcatcatcattatcacagctgtcatttttagcaccagcaagtcccagaccctgtgctagatgcttcagatagatcagcttgcacactggtggcagtgctatggtgggtaatgccttctccatgtgcagggaaagacagtgggcctggggcagatcacctggccagggccacacagctgataagtagccaagtgaggattccaacctcggtcctcagatgcaaaatcctagcctattccaactaaatggccattagttactattattaatcagtggtagaagtgggtcctgtatctgggactcccaaaactgggagtatggaaaggttcagtgattttatactttactttgatttttgcaaggaccattcaattatgattgttttgaaagagttttgtgtttgttgttgtctttaagcttttgaaggagcatgagattaaaaataagatggctggcttacatgtcatctttccatgtgctgctttccttgagcaaattatgtgcatttttatcacacatctatctattatgcatctttattgcatatttccatcaacaaagggggaaagggataaaaatgcatgcaaatagtttaggagtaaattttgataacactgaataatgtgcattgtttactgtataaaatatttgataaatataactcttaagggctggacccagaggctcatgcctataatcacagtgctttgtgaggccaaggcaggaggatctcctgaggccaggatttcgagacaagcctgggtaacagagtgagaccctgtctctacaaaaataataataaaaaaaattagccaggcacggtgtcatgcatctatagtcctagctatttgggagtctgagatggaggactgcttgagcccaggagttcaatcagtgagctataatccatccactgcactccagtctgggtgacagagcaagaccctgtctctaaaaatcaaaaaagaatcatttatttggtgccttctacatatcaaatgttgtgtaaatgcatatttcgtctcattttctcctcttgaatacaggaaatactccttttaagaaagtcctttgtataataaaatcctgaaggttaaataattaataatgcttactgtattttccatacagtgatgtttttattgcagaaggccttactgtgaacagcgtggcttagtaaacttcatagccccttaccacctccaggcagtggataacttgtagcccgttcatcaggatacctttgcagcacacagcaaatctcatttcctaaggccaggagcgactggttttataatgccagtgtcacactgaatggcttactctcattatgggatggaagccagtccatgtagcataatgaatgaagcatgcagaaattggcatgcgtttcaggcaggaagcttgcattcctgagctgttcttctctgagtattatttaagactccaatggagctcaagttacagattatggtgattctttgtataactcctagtacaagtacacagcaagtgttttctttatgtttactctatttgataaccacactggcaaagtatcctcacagacattcatgaaaccatccagactggcatagagtgggaattcaatttgaactaacgatccctccccagacatgtataagaggccttatgtttgcaataaccaacaatggaaagtggttagattttttaaattcttgtttttcctactgacatttaggattttgtgcagtacttacatactagaagtagctaattaatcagagaagcagaaagcagaattggattcaggaagaagaatgggttaggagagatggtgcatgatatttcaacatttaatatagaaatctcaaaacagtaacaaagcaacaaaaagtatcatttttttcggacaaaatatataaaccactctaggcggtgcttcagagccctgccctgttagaggctgcagtcctcaaagtcatccagaccctgaccctcagtaagacacgcggcaatcactgatataaaacatcaccgaggcccagtggcacagctgagctgtgacagactccagaattttctgtgcagctttgattactgtcactctgaaaggatggagttgaaatggacgaatagaccctcaaatgtagttaagtggatgaggaggcagttgttggaggagcaagtgcgtagatctgatcctgtccatcaggaccctttgatatgcaaagcagatttgttttgttttgttttgtttttgagacagagtcttgctctgttgcccaggctggtgtacagtggtacgatctcagctcactggaacctctacctcctgggttcaagcaattgtctgcctcagcctcccaagtatctgggattacaggtgcccaccaccacgccaggcatttttttgtatttttagtacagacgaggtttcaccatcttgaccaggctggtgttgaactcctgacctcgtgatccacttgtctcggcctctcaaagtgctaggattacagatgtgagccaccgcccccggcctgccaagcatgtttgcagcaagatgcaagggagtaagtgaacaaagggaccattaaaattgggcactcctgcaggaggttaggtgattgtgggcttgaccaccatgcactagtgtgctggaacaagaatggatttgttgtcctagaaacaagtaaataaacaaaagtgcaaatatttattatcatttaaaaaaattgtagaattactgactgaattacttgaagagatgttggcatgaaaactgttgtggattgtagggcacatgagagcaatggctgtgcttttactatttttattgttttcttcttgcatggtgaacccagggagtcacacagtgccccacacggacacagcgggagtccagcataaaaggcaaagctagaaaattttcaggtattagagagctaagtgggttgcttatgatccaatacatagattctataactctgaatactcttccaactatttgaaatagaagcactgggtggaatattatagccagcaaaataaaccaagaagtagtagagtatacctcaaaaccaattcttggcaattctggcagtcataaataagattgatacaggcgatatataaataaagatgacaaggcgtagcgagtgatcctgcctcacccctgccaccgagaactccctgttaggtgtccaatttttctgggttccttaagaacagcaagagattcttatttgtatattatgccatccggttttcaagataccaatttttttttaaacactatgcttacaaaacaagacctgtgtgcaaacttcacccagcaggtaggcagctaactgccgccgtgacttgggtatcaccactgatttcaggaatgtaaaccaccacacgtaacatcatgctcagaactagaacctttctgcgtagacattagatcaagcctagtagagctctttttcattttttaaaacatgtgttgacaggtaaggacttgtctctgacctccaaatgttactatttaatactgtaattatataaactttcctagcacatcccctcccccccccaattacaactacttgtgtattcactcattgtttccttcccttctttgtttattcactcatttccctctggccactgaagctcaacagaccatagaattgctgtcctgctccaagaccaatgcatttaccattcaccattagttgaatggcttctctttagtgccaggcacattgtcttgttctttggcatttataaggacttccagttaatttacaaatgctttccacggattatctcagctggtctcacagtagccctgagaaatgagcagggtaactattttcctagccaccggacaggtaaagagacagagactgagaggcgagacctcacctcagaccatgtggcaggacagctgccactcacctgattccatgtggcttgagagccacggagccagagtagcacttgggtcatggcagggctgagcccttcacctaaactcacacatgggtcatggcagggctgagcccttcacctaaactcacacatgggtcatggcagggctgagcccttcacctaaactcacacatgggtcatggcagggctgagcccttcacctaaactcacacatgggtcatggcagggctgagcccttcacctaaactcacacatgggtcatggcagggctgagcccttcacctaaactcacacatgggtcatggcagggctgagcccttcacctaaactcacacttgggtcatggcagggctgagcccttcacctaaactcacacttgggtcatggcagggctgagcccttcacctaaactcacacagtccttgcctgtggaacttggggtgcccctgcaagggtgtgatagtaaattaagccttggactggatgcatgaaatccgtttaactctcagattctctttttctacaatcatcccatcattttatggcttatggagcattttatcaaatgctatacaaatatctcatctacttttcaaaaagcaatttccatcttatacgtttgcacctctcacctgttataaaaccacatattagacatgacatgttataaagggtagtttcaggtggtatgggcctggaaattcttttccatcaaacctacttatgtgaagttctactggggatcagtcaccatttgtaccaggaattaaagtttatgaaagacatgagaaggattggtagtagtttctgattctgagcttggctctaagaaagcagtgctttcctttctatccctctttttacctcatccttgccagaaacagtcttatataacatctgccagcctccccacaacacagctctgaatttatttcccagcattgtacagggctgaatttccccttgcatatcccaggttcatctccatgatatttgctctatctgaaatctctttccttccttcttccttctttattcctttctactctcttctccccactcctctcctttccttccccatttcccttacctcctcatctcctgttcttcttataaatttgccatgttcttttccatattcctggactctaaacattttttaataatttcttctaattggaaatacaagtagaaaacagtaaggccagcacagtatttttgtagcccatgtgaatgctgttcgatcttacagatgagaatgacctaatgctatcagcttgaaatccatgccttgcttacagaccccctgctgcagtagaaaaactaatacatctatatgagatccttgattgttgcattttcaatttgctacctaatttgtcaggcagatataatagtatgtgtttaaccagacagctttcaagtaactcgacgggaaaggaggagtttctatgcatctgctgtttaaagttagcaatcactcccactttaatttttttttaacttctgatcagttcatttatgatgatgttgggagactcccaagatatgagttcaaatctaacatgaaaaggatgctaaggataggggctgcagggaggatggagaagcagacatgtttgcatacttcaatgatggattgtggcttacttgatttccaagttactttccagctagggtggccacagccagctgtgggtgtccaggctgccggctctggtaacctggcccgtcttccctttcagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacaggtaggagctctggccccctctgaggggttttctaccatcttctgattttgtgttttagatttagattctaaacattcaatttcaatttcaagctttacgcctgatgtctctttttgcaaccagcaaaacccgcgatgctcacttatcttcctcagcctctgtccctctttttggaaatctcaatctattttcactatattggtcataactttaattggaaagacaatggcttgtttctttgctattattcctcaactattcataaaataagtcttttcttggcaagaccatttgaatttggataatttaagacaaaggtatgctttgttggaagatgttgttgggtgaaatattatcttgggattgtcatggttatttctcatttgttcaaaaacagtgccttcagcaaaatatttgcgtggatggtggtacatggcagtgttcaaagaatatgttttggggcataaataatggaacatttacagcaaatgtaggcagtgatactttcaaattacaaatgacaattaggtctcttcagtttccaaagcaactagagtgtagaaagcatgttccatctcagttcattacacagacggctctgggtgtgtgaggccagctgtagggacctggctgagctctgtgggcttgtccttctctttcctgccttcagattcccatacagagccatctcatggtggagtctgcccctccccattctttgtccagtgttctgtataattgtcatttctcatggatcacgattactgtttttgttgctgataataatatacattttttttcttctaagaacctctcaattcctagttacatatttaccacatatttaccagttagttttttttttttttttcatgaagttgctactatctactgaatctttactatttgtggagttcatttgaaacactgggaaggaaactggtgaacacataggcatcacctgccctgctggaccttacgttctagtggggacagcagataataaacagagcagtcagtaagatgccaggaaggtgacggtgagcagacacagcagatgcgcagagacagcccagcaagctcctgcatttgctagttagcattgatctccgccaggaggtgatgatgaagctaagcagggactgagaaggcagggccagccctgcacccataagggaaacaaccaatgagccagatgtgggactggccagtggcaggcagtgccactgagtggtcaggtaaggtaaggacagatgtgaccactgagtgggcagatggaggccacagctgctcctcagggccagtctgtgggaagaggaggaactggagaggaggaagagcactggccgaagtcagatggaaccagctgcttagggcatctcctctagaagcttttcagggaagggaaatggaggattgatgagttatctggaggggatgggaggtcaaggaaaggattttgttgatttttgtttgtgttaagagaaaggaaggattgtttctctttattctgtcatgtatttccttaattttccccagggtacccggcacggaataggtttgtgggatgaatgaactggacccttccataagagttcctagtttttcaccataaatgtccaggctgatgacacggagaatagggccatcttcttccaattctaggaggcagttgaggacttccttagtaccttgggagtgggagggattttgatgggggttgaggctattcttgagtagacctgaatgggtcagtgaagagcagcctgaggtctcaacctgagcctttggacgtactccccacgtaagtccaagtaggtcatgtttgcttctcttgtgtttataatgaactgtagtgaacttctgaggatttctgatgaaactcctctatttttactttgatgagtgtcttagtcagttgctacaacaaattaccatagactgggtggcttaaacaacggaaatttatttctcatggttctgaaggttagaagtctaagatcatggtggctgatgactcatttcctggtgacggccctgttacaggtttgcagatggctgcctgctagttgtgtcctcacagaatgaagagagatcttctctcctatgtctcttcttataaggacactcataccgttcctaagggctccaatcctaatgacctaatcacctccctaaagccccgtctcctaattacatttcatgggggattagggcttcaacatatgaatcctggggggacacaaacattcagtccatagctacaagcaacttcttttaccattgtttaaaaccactatttaaaagtttctagaaacttgcttgcacatgtctgttttgaatgatagcatgattggactgctgctcccaacaccctcacccccacaccgtgttgagagtagctcaggactcagctgccgcagggattccagaccatctgatcctgtctgatgtgcagatctgattccgatattgatatactatgtgccatttggcaaatgcatttcgcagagattcgctttattgttccacaaacctgatttttggcttttcttttgatctactgcctgtgtacaaattcaattgtgttgtacatgtacatcaagatactgttaatttgaatcacaagttgggattatgggtaaagatgccatatgtagaactctttgacagtttccatctctcactagttggattgttagttaaactcaagaggaggagaactttgtagtgggtgaaggtactttccagcagaaaacagccatagatacccggggcccaacacaaaccctgctccaaaccatatgcagtgacccagggcaggtacaaaagcagttctactgaaaagtgaattcccagaaagcatttcagcttgtttagactggcttgacaattttaactgaacaacctctataattacatatttcatgtctcaactaacttgtggatcttttcatttactcttatagcactgtttaatatattttgaaggagatatagtctttttttcagattttaattaagaatgatattcagttttaagggatatttttttttaacatacagtctttatgtccaaggaattgaatactggaaggtataataatatacattttaatttaaccctctaagagccaaataacccccaacaagcagaaatgttaaagactagagattttgacattttgaattcaaaaagctgatgtttttccggtctcttatttataactagccccagtagttacatcaaggcaaaccagggaaattcatctcatttgattttaaaactgatatagaagcgggagggataaagagagattgattaatgggtacagatacagacatagatagaagtgagacctggtgttcaatagatcagtatggcaactgtagttaacattaattgattgaatatttgaaaaaaatctagaataattcagatatttctagaataaagaaaacataatattttaggtgatggatttctcaattactgtgatttgattatatgaatgtatctaattatcacatctaccttgaaaatatatatatctaatatgtttcaattaaaacaattaaaaaggtaaatctaaaaaagaatctgatattgagcacacatgctagagtcctttcagtctgggtgcacttgctataccatatccaggagttaaacgagttatcaactgatagagcatgggtaagacattcataactaatgaatgtgaagctagagtccttcctaccttacttgcagaatcagtttgatatccttccaggcttgggaatccaggtttggtggtaggtgtattttcttttactttgattttacatgaacacatgcaaatgggaggaaaccagccaatggctgtttgaaaagtcagtttattttatttgtccatattgtctacagatccatgtgagctagacttctcttgctggtgtagttcatctgcgtcttgcctctttggtggcatttcccactgctgccactatgctgagtcagcagtcttccccagatacattctgggtccattttcatgctactgccctgtatctctcctggtgtccatccacccagggccaggcatgttatctgaatcatgactgtgctaatattttgtaagttggtttttgaagattttctcagagccagagtcaagtggaaatggtagaatatttatgactggagttctgttagtgacggagtctcatatgctattgagttctctacaaagacaaaattaaggtcatgctgagcaatcaggtattctgggagtttctcccttacttgacttggaaacacttctccactggctcttccccaccactgtgacagtccctcgcagtcccacatgcactcctggtccagacatgtggctgccgctctgggctttttccacagcatggccatggttgttctaattctatgctccctcccccacaatgccattcagtcttgggctttctattctcccttctaggatgagatatatcatttttattttcactttaactcaattctagtgtttagaaaagcatttgaaccttaaattgtatataatcttaaaatgttctaagcttagattgtggcaataattgcacaactcagaatatactaaaaatcagtgggtgaattttatggcatgcaaattatatctcaataaatatattttttaaaaggaatgtgatctctttttgtgttatattttataaattgttttagttagaggataattcataaacatttatataaaaacacctatcaggcactaaagaaatgtaaaggaagaagacatacacacacacattttgaatcattgtttttcatttcaaacttgcaaaattttacatagaaaaatcaggggcagctaatagatgaatataaagcaggaaacattcatatagaggtttatatgcttctagctgctgaactcatgtgagattgtgccatgtttatcacctctgtttccttctcttcccctagccccaaggttaattgtattgtggaatgaaatatttatagaaatctcaaaaaatagagctgggcacagtggctcacacctgtaatcccagaacttcgggaggacaaaacaggagaatcactcgaggctagaagtttgagaccagcatggacaacatagtggaactgcacatctacaaacatttttaaaattaggcaggtatggtggtgagcacctgcagtcccagctactctggaggctgagttgggaggattgcttgagcctaggaatttgaggctgcaatgagctaggattgcaccattgtacgccagcctgggaagcagagtaagatgctgtctcaaaaaggaaaaaaaaatatgaaggctcaagaccttcaacaaagagggagcctgggctgagcttccttctctgcatccctgtcctgtcacttcagtctacagaaaagcaaatggaatagaaggcatcccagcaggagcaggacatgtgccacaaagttactttgcttggaaaaaaaagggagagaaatgtaaataaagtcagtacccagagttgaaatgatgaaagaaacaaaatgagatgaaaaggaagttcacagagataagcgaataaatagaagatcaaaatgacgtgctattctactacaagagtaaaaattaaattagaaacttcatggaaacaaaaacacagctaaagcttagacacagagtaaatgtttgcagtgattaaggtggaaaatgtagaaataaaagataaggttttaaatatgaaggacccacaaagacaatggaccacacagagtgattggtgtctttgaaccaaagaaccctgtctgtggagctaaaaacttgtgcccaaagacactattggagaaaattaccctgcaataaaggaagaattgagtctgcaaatttcaaagcatactgtatttgtgcaatattaattcagaataaaggaacactagccaggtaagtttttaaattccaagaatacagaaataattatttaggtattgaggaggaaaaaaaaaactaaaaatgaaaaaaaatcacatggtctcaggatactctgcagctgtataaatctgtgaaacatggttatgcaatattctgagaaaaagaaaatgtgaattgagcatgttatactcatccaagaataaaaaaaaacagacactcacaaaaatgaaaatctcaaggaatagaaaaccaaaaatctcttttacaaacatgaaataagactaattaggggctaaattcagccaaatgatgagagaaggtttgagaaagtaaaaccaaaataggggaacactcaataccagatttcaagtagaacaatatatacacacattagaggaaaataaatgtgactcaagaatgttattctaggctaatctttccatcaaaaataaaggtacatggaaaatttagggataatgtatctgtgattcctacttcaaaaacagacaaccttggctgctagccaaagaagaaaatcagaacaaaaacctcaggaaagacgttgtggaaagagggcaagtgaggtgttggggacccattttactatctgaggaagaagcaataaggtgtcacgtgagccaaggctctggggtgcaatggagcataatgagctcagacaacagagaaggaccgctcattggtcaggtcgtaagttcaaccgcaggttctctcagccttacttgaccctgaacccttggccatttgctctgcctcagctgcccccgtggctgacagattcctgggcaggaccaggaggttcctccagttgatgctgagcagctggtggtcaggcgtctgtggcgctgttgctgcacctgggcttggatgagatcgcacgcttctgggagtgggatatggcttctcaagcaggtgctggaagagctggtagctgcagcccagaagtgcaggaggatgaactctccatgaagcaagcctcacccagagggatgtcgggtatgggcagaacgcaactggtgaattccccttccattttcacctccaggcggctgtccaagggcaggcttctcatgtagccaagcagatgtctctttctgtttcatcataaaggaagagccccatggtaacaaatcatatagcaccacttcctgctctttcctgctccctattcctttccctcaccacacagccctgggattgcacccccagtaatgcattagcaccaaatacttgaatccttccctctgttttctaggcaaccacagtaagagatccaacaatgcctggagttcattcaaccctgtagagtttctaggctccagatgcaggcagggatagctaatatgtgccttctagctatgtttaaaaattcagattttaatctaagcataataataattactgaaagttctgtaaagaaaagaagttacatgatatgatgcatgttttcaaagattactatctatacatcctggagaattaatcagaggataacaaaaagggtagaaggagggtaaagtttggggtacaatttctttctaaaccaacagtactgtattgctacaggatccgccattgtataaaaataagcaggcattctagatgtcattgcattgtaactgagtaaggaagagtaggctggggtcaaagctattgaagtcatcaaggtggtctaggaggaggtgagcatggcatgctcagccagaagataggcagatgtcaccctcaatgaagcaaacattggttcttagggggacaaaaaatcttatttttattcaaatagacatggactatacaagcaaatatacagtacagaatatctgtagtaaaatttcatgggtgaggggacaatcaggaaaaatgtgagaagtcttcttgtagaagtgataatggaacacctatcagtttgagaaatgctgctcttggttaatttcttgaagagaagctgacagatgcagcaggtgttttggaggagtgagagaatgggtgcaattaagaatgactcctgatgtttttggtttggacagttgatacttctcgtggcctttgctgaaaagaagacactggagtttttgtgccaaaattcactggagagggttcagcaatggacaagacagacagacaccctgtcctcaggaagcgtatttttttttggggtggggggcagaagcaataaaacaagcagttgcattaaatgttaaataggaaaaaacgaaacaggaagatgagatgggggaggcagggctttcagtggtaagaagaaacgtgcaatgtgcggagagaaacaggtccattaaagttggaagttgtgctgtctttcatggaaaattggggtgcagagagattggggtgagttgaggaggagatagaggtcaggaaatagatacccatctagacaacttcttaatagatgagggactctgcggctgggagtgagatggggcagggggttgggggagacagcagattgaatcgagtaccatgcggggttggcaagggtactttacctgtgggtgtcagcagacagttttgcacctgtcatggggaaatgcatctgtaaatgtttctagtcccccctctccatctccacatactcactgtcgcatcccttccggacctcagaggaacgtgtttctatcaatcccatccccaatcttccaagatgcagacctagaacctgggctgagaagccaaggggaaggagaggacttggctgaggggctgagttaggcctcaaaataaagcaccaaagggaaccaagagagggtgtgagctggggaaggaggcgtgactgtgtgtgtttggtggggtgccaggggggctgccaattgaggaaaaaccagccactggagaagtgagaaaggcaacaacagaatagtttctaagggcagcacctgaagtccatgctgtttagtgcttttgaagggtattaatactaggtaaagatggaattccacctgtaaggactttggggttttggcacatgcaattttgactgttttcagtacaggttagatcctgtgaacctatgaatgtggcttttaaatatttactactgccaatgggcatcatttcaccaaggaggaagaatgagggagtaagaaagaggggtccccaagttggggaggttctgaggtgcacaagggttgggggcagaggtcagaataacctcagggaaaaaagcggagatgccctgatgtacctgggggcctgagactcatgcctgtcaccttcacttagctttgccctgagcaccagggaggaaatgtaaccagggacctcccctgttctcactcttcccttccaaactcattttaagtacagaggagtatctttttatggttgcttgctacgaatcattttttaaagtcaggagatcaatatgactttccaaatgaacttgtagaaaagacaaacaatgttctatgtactctagaagtttcttctgcaagagtgatagtggccaactagctcaacaaatgctaaaattctgtttctaattttcttttctccctgcaaatttttttttctagcacctaattttcaaggttttcaggttcctatctaaaaaaagtagggcaaggctgagtgaggaacagaacttgacattccctttgtccaacatacataagactttagagaccccaaggatacccttctgggtaccagaaattaagttaatacatttacggctgccatcactcctgagaattatctcactcaatgtttctaagcaatttgcaactatctaagtgtcaggaacaagtattaacttgtgaaaaactatcatgttggaatttttttttttacattcactccaaattctgtccttctcaccagaaattataaatccaaaccaagtctggacttgcattacgtgtgcttctttatgtaaggggctcccatcaactgaagggggtacattacataatttgagtgcttctttgataacatttaatgaatttttcatttactgagggaataattgcagcaaccaatagcaactcaattacctggtggtgtgggttaaagtgtgttcccaaagaaggtatgttgaaattcctaacccttcagtaccctatttgaccttctttggaaatagggcctttgagcatgagcatgtaattagtaaagtccagatgaagtcatactggagtacagtggacccttaatccaatatgactggtgtgcttgtaagatgagaaaagaggcaaaccaggagaatgccatgtgataacacgggcagagattggagtgcacaaatgcaagcccaggaacacctggaatggacagctgccctcagaaactagcacgagacaagaattccacccagattcttaagaaagtatggctctcctgataccttgatttcagacttccagcatccagaactgtgagcaaatacatttccgctgctttaagcccaccagaacatggtactttattgcagcacccctaggttactaatatacctgggtagactttgccacactgcatctgctcttacagtcaaatttaaagagtagcctggtcttctcctactccctgaactccatgaacacaattagttctttagtatgagtttgttttaggcccgattaaaatgaaaaaatagtgttgaatataatttagtatatgccaaaccacttaaaatgctataaaaacaactaattgttttgtttgattaaatgtgggagcattagttcttgtattttaatgtgtttagcttttaaacatgttttctgaatatttttagtagctgatgcctggtctcccaaccacaaaataatatgaagttataacctatgaattagtaaatttcccagtatgttctaaataggatgcaaccaacttcatcttcatggagcagataaatttcctgttttcttcttggtctcttgcttcctctccaccttgctttgctttggacccacctgagacaggtgactttcctctcaggtttcacatgattagtattgactggaagttgccctcagtagtaaaaattgtggtctgtggacaaaaaatacataagtaaataaaattgcttatctttaccttttttcatacagatcctgcctgatacaaatttttgatataactccttcaggtttaatggtagtggctaggagatgaagcccagtggattcctgttcccaaacctgctgtcctcttgcttatacaaaaacccagttagggtagtattgtttctttttgagatgatggtattataactacgaggatttttcataatcttgattcagtgccccaggttttcttattttttgctaagtctaatctctacttctacagagggacattcaaaccattttctacgtgaaagcttcatgagacatgtctaatgtagaacacgagttactggagtatataatgtagacacaggcttaggaatttttaacagatatttatcctggaaaattcagttatgagaagacccacttgactgctaatttgatgacgaatctgcaagtgtttttacaaaggacttttctagttgatgataagaacataggtctttataggtactaagggctttcaattaaatggctcctccatcttcatccatatcatttgttgtggtaaaacatattttacaatcattaccaacactttttaactattatctatacagaatactggcatgtcttaaaagagagcttatctggctgggcgcggtggctcatgcctgtaatcccagcacttaggaggccgaggcaggcggatcatgaggtcaggagttgaagaccagcctggcaaacagggtgaaacctgtctctactaaaaataaaaaaaagtagccgggtgtgggggcatgtgcctgtgatccgagatactcaggaagctgaggcaggagaatcacttgaacccgggagatggagttgcagtgacccaagactgcaccattgcactccagcctgggttacaaagctaggctccatctcaacaaaaaaaaaaaaaaaaggagagaaaaaaaaaagaaagagagcttatacattttttttcctcactcaggagctcacttttgtaagacccaagtgtgcaaattgaacataactgaaagtgtttcctttgttcaacatattctgatgagaatatttttaaacaaatatttaagagcagattctgctggtgatttaacttggataatgagattctcggtagttttttaaaaattattttctccataagaagcatttaccaactaaattttttttgaggaataaatccaagttctgtcaccatgagacatcaattttgttggttttgaatgaggcaggctgaaggtttcaatttatctgatgtactgtcatgtaaattccaatttattataagttctgccaaggtgtttatggatatcagagatagaactgaaattatactgacaaatatgtaaaaattaagtcttcgaaagctaatccatttcatctgttggatggtgattcttgacatgtgtccccgtgtgtccatttccagtatcctcatgcttagttttagagttctaatagggtgctaaggctgggttcaaagtcaaaatccacataaccctagtaacctgtgagatgcaggatgtcttttagggtcacctggcagcagcccaggcctgcatctcctaggagtatcctgggatgccccagtttgggaagagacaatggagatgagccttggtggcttctcaggacctgcgtggaactcacccatggttgtgaacaaagatgaacaagtcaatcttcaacgaaggccaagtcaaggcactgacttcagaaaatgcatatcaacagaaaatacacatacatttccaccagaatgaagccctccaaatgttcagatgaggctatgtcaggaacacaacctgccctcatagaacctcaggcatattgggatagagtcaacatcactgtttcccacagttgtgtctttatacctgcaattagaagaacatctgaaatgactccatcatttaaagcactcatcttgtcctctaccttcattttctgtaacctgcaccctgaagtcaattctttagggtaaccaggttccaaagagacttcagcagcctataactgccccagttttctggtttctaagtaactatgcatctggccaaataggaagaatttaagtactgtcactccaatgaatcaactgtgatcactgctgctcctgctcctctgagtctgtttatgggattaattctgttgtgttgctggagcagtccagttacagtggcacccacatgctgggtaagcatgggctttattattgtccctatctgataattctatttaaattctacctaatttcaattagattattctggcagtgaggaaatccttgggttattttaagcaatggggtatattttaaggatacatatttctgctgccccatcagtggtcacccatctgtgcattctttaactcacattcctgagagggagagtctgacctgaataccagatcaccattatcctgaatgtgccacatgctacaggctaggccacttctgaggctgctggtcagctggcagagtggccatccttgggtcaggggccaacctctgacaccatcagctttgggaataggaactgggtcacctctgccagaactggggccccttttttcaacaagagcaggacagctaacctcagaggggaccctgggcttcacacacagttcaacaaggtgttaaatagggtattcagaggatgtgttattcttgcattgttgtacaacatattatcatattcttagcaatttcaagcatcatacacttattagctcacaatttccatggtcctggaccccaggcactgcttagctgggtcctccgttcagggtttcactaggctgcaatcaggatgccagctagggctgcagtctcatctgaaggcttgactagtgaggagtcagtttccaagcttattcagttcattaacaaagtttatttcctcatggtgttgacagagggccctagttttgtcctggctgttggcagagtttactttcacatcctaagaccacctgcagctttccacccatacccttcttcaatgtggccacttactctatgcaaccagcaaggagagcctctcttctcagagaggcccagtcttccctttagggtttttcactttattaagtcaggctcatccaagatgatccagcttttgattaacttgaaattaacttatttgtaatcttttatctgcagaattccttcactgtggcaatgtcacatgatctaatcacaggagtgacacactgtcatattcataggtctggccaatactcaccagagaggactacatagaacatgaacaccaggggttgggaatgatagggactgttttaggaatctgcctatggtaggaggtctattagatgccctctgtcttacagatgacacctcttattctcatcccccaaaaaccctctaaatatgttttaattttgaaagtttaaaattaaatgtaaaatggttttccttggagcaaacagctaggactccaattacgaggctgttcctatttaaagggagaaattgttctggtttgagctgcacaagtaattacgttggttatttgctctacatctagttatccagacctggctgaagtgcttccaccaaacggagttattttccatttttgcaagtgctccatgagcaaatgtgtataatgaaaaagaaaaattctggaatgtagaagagaaggacaaaaggaagatgccatatgttgtatggcattcaaagggtaatttcccactaactgaaatcaagtcagtgaacaaaccaaacccctacctgtcagtgttaaacgtgtaagggccaccgccatctctgcttgcacccctctagccatctctgcactttctttctttcctttctttgtactgccaatgggatgggtgttcatttcctaactggaggcataaacatgtgcctaactggaggcagaaatacaggcagtgaggtgactgcatctctgtcccagggcatgctgtgtctctgatacccagttattcaaggaccactgagagaatttaaggaatcctgcaagaaaagagtatccactgcttgggagtaacttgaccctccatgaacacacgggatctggatgacctttgcaattcctttggggatgcagggagcagaattttagaactctaccacacccccacttgctgctgaatattagaataatatataaaattcctgtcacctggcccaccacagtcattctctaagctgtgaaatcagaaaacaaaatacttcttagaaccataaaatgtggaataatttgattctgctgtgatgtgttaacaaatggaatctttgctcagggagacctctctgactccaagctcagatcaccacagagctgtcgtctcttacgccttcaaaggtctgtagagtaaagcttcctattatgatgtagtctaacatgaagggcacggtagcagagactttctgaaggagtgaggttgcttgggctgtatttactggtgcaaagtggaagcacagctaatcatagaagtcaaattccttgtaggacttttttttctgccttggctttgagtatctgatgtttttattttggatctaagcacatcctgtcatccttgttaacttgtatagatggcccctgcctggcaatgatgaccaggcattactaagcacatttaggccttgacctctgtaattaaattctaaaacagacagcagtgcattctgaaggacatggaaggaatgggtgcatcctccagtgcgtgataaaatagcagtaacaatggtgttacagacgaactttcctccaggagttgttacaaagcagagtgactggaagaaaaggtacctcaccacatcttttcaaaaaagcctttgcagagaagatgaggataccaagataccttaaggaacagaaggaagatatttcacatatctgggattaagagagggttgggagtaggaagtaaggtgcaactgtcaatattgcagttcccacctggaagtcattagtggaaaaaaactcgcctcaaatctcccagcaaattaacacttagaacatttcctttcaccagaatgtctgcagtaagctgtaatttacagcggtgcaattattgacaatggccaagtctaactgcatacttgtcccaggcatgggaaaaacagtatttgtcacttgcagagatgtaacatcagaattacttttattttggttgtttcaaaacacagcctaaaaatctgctccattatttattggtttataatattttcatctctctttcctttttgaaacctagagaagtccaacactacgtttcttaagtatggtattttctggggtttaaacagaattgttaccaaaggatgctgtggagtttcataatgttatgttttcataatgttaagaaaggaatgatgttttgagctatgtccctaggggcaatgctgttcctacacgatcctgtcttactcatcagatcaacatttccttggagaagctgaggacatgcaatgtgttaacgagaccttgtttgaagaatcaaaggagcctgtcattaaccagccctcttgcaatgataccaatgcctgtgtccctccagattgaaaataagttgaaaccttattcccaatgtgagggtatctggaggtggagcctttaggaggtgattaggtcatgaggatggattcctcatgaatgggattagtgcccaatagaagagatcccaaagagatccctcacctcttccactatgtgagacacagaaggaaggtgtcatctgtgaggaagtggctgtgaccagacatcaaatctgcaggcaccctgatcttggacttcccaggctttagaactatgagatataaatctctgttgttgataacccccccagtctatggtattttgtcatagcaccctgaatggactaaagatgctcctaaagttgagaatatctgaaattataattatgtagccagttattcttctagaccaaaaaaaaaaaaaaaaaaaaaccgggtgaagaaaacaactttccctgtctggaattttctgactgtagtaagtgcaaaataaatgctgaatgaatgagttattggaaagcagcaagccatctgtccctgtgtgcattcctcctttcttcagatcttcaacagtgccatttcattattttgactaatcccaaaacagaaacaatatggaaacagcagtaaagagcttttgaatttttttcccatttaagagcaatcaacacacgtttaataagtttctgaccaagagaacacttatcaccagattctggattttgaaggctgtgaaagctcagctatgtttgaaagttttaaaccattttgagattaaagcattgtttagaagggcatttcttgctacctataaccactgtgtttcaactgagtatagtgaatcttgttaaatacatagtatgtttctttgaggaattaaaattgagagaaaggaaaggaaaatttgctcaagaaactgaagatttctttcttataaccagaaaatatgtattaagaattgttctcatgtgtaactaaaatattgagcattattgtctgaaattagtaaaaaatcctttaaagtgatcttcagttatgccaggtagaatttgatttctacacacccagaacagtttagaggtttctgtaggcttcaattttcatgtgtttgtgacaatgataaaaatttagtaattaattttttgaatgcccaagtacagttaagggattttagttaaaaaagttatgatttttagtattgaagtgatcaccaagattaattgtcagagtagaaacttcatttaggccttcaatgatgtgatcatttgattaattttaaaaatctgaccttgtccttagcggaagaacactgattcatagtgaaaaaaatagtttcaaccacaaatgccttgatttgtccttggtaaactgtctttaaatggcaatcgtcacaaggaactgctgctctttgagttaaactataatcttccttcaattagaaatcatattgattacacggtgttggcatttttaatatctctaggcagcattcatttctctgtgcacggattggataatagccagttgtctggggctttatggagttgctgacctgcagtgactcacctggcagcttgtctgtgggaccctctaacacttaacctgcacttctagttccctagattctggagttttccagccttggagtcagggcatgccaggagctcgggggcccaggctcaatgctacctcatctttgtcctggctcagctctgacctttcacccagtttgagtgacctggcctttgacatcttctcaagtgatcagttctttgctctggtgtctgagctttgtcctgtgtcctaggacatatccccatctcagaattagagccgtttctgtgccctgtaagttggtgcccgctccctctcgtcccatctccaggcactgacctctcatcctccaggtcttctgactcttgctgtctgactggaacccttgccgcagcctgtgtgtttagctggaggacatatatctagtgttggaacccggctccctctcagccatctacatcccagttagggaaagcaatgaattggttaagactcatgattttcctgctgcccaataagaactggcctgagattcctcatagatcataaataaatctgcacccatgaaaagatttggggagtctcactggaaagtcaatggaagctggagagctgggggccctggactctgcatcattagcgtggagcatgtttagtgactgaatctttcagcttgtcgtctcgaccatgagtcccaatttaaaacaatttttctccaaactgatgtttaagaaaacttgtcactcctgcccctcagatgccaactgggcctttcctgccctccagatgtttgctgtttgctttcatatttcagactctcaatttcctgcctaggaagtccacagccctccccatcatttctgttaccaatccttgggcttatgctcaccagatcctgttgatattcagggtgaatgaatttctctcactgtcaaacaccaactcaaccccttccccagagcgtgttttaaaagaaaaaaaaggacagaattgtgtgagttgaatagattatgggaggacctgtgttcacaaggaaggattgatggaggtgtaggcatctttttgccatcattctagtttttcactctcaccccttttctttcactttttctgtttctttcaggaggatagcagaggaattccaacccctctcccatatggagccccttcttctctcagctcttttgacccaaccaatatgtaggtctgggggcgaggaaggaggagagtgtaggcttcatgtcaaactctgtacagggcaccacccaaaggatggctggaaactccccagtaggactgttggtgaatgaaagggtctcctttatcatatacttgtcttggtcctggctgctataaaaaactactgtcgactgggtgatttagaaacaacagaaatgtatttctcatagtgctgggggatgaaaagccatgaaatcaggatgccagcatgcttgggttctcatgaggacccttttctggcttataattagctaccttctccctgtgccctcacaggggaaagagacaaggcagggctctgagacctattttataagggcatgaatcccattcatgagggctccaccctcatgacctaatcacttcccaaagccccccacctccaaatatgaccacgttgggacttaggatttcaacctctaaatctgggggtaggggggcacaaatattcagcctatttcaatatgcatgtcctgtctctcattttttaatgtagacttaatatatttgcatctaagagtaggttcctataacatgtacatgttgggtagtggagtatggcacaaagtactagtgacatgcatgggtatctacttcaaaataagttcacaaaagtcaagaattgtattgggtatcaaagtttcacatgtatttttcattccacatttcttgcaaatgagtcacccatgttcatgcacacagctgaggttcctccaccctaccaggctggacatggaaggtaggacactgaagcatttgaaagccctcagaatgcacagaccctgttcatacttaggctagaaaaggggggcattgtcactcctgacttgttaattcatatgcaccattaactgtggctcacacctcccagatggaatactgacagtgaaaataattccctgcaagtaacactttccctcgggtgaaggaaatcagtggacattgagcccagtatccaaacatcagaaaacctttggaagttgatatttttgtagcaagagcagctaagccagaatatgacccaaataagttcttaataaatattcacctaatgagcaaatgaactaatgagtatttgtgtcctagggcaaatagttggtagttctgagtgggtaattatcatgagggcagtgtcatttgagtggcccatcacagacctgagcagcctggaggcccttccttgtcatgaagcagctgaaggaatagtcagtcctgactagaggccacaccaaagttgctctatgtgttgaagggagaggagagtgggagagcgtctgactatgccagggttttatttgttcaagagcagatggaaaatgatagaagaatgtcaggtgagcaagcccatcttggccaaatgtgtcctttgcatcacgtgaacattacacagttctgctcctagaaggaaagtccagttagtaagtactaaacaagggtgtgacacgtttacatgccgtggctatcatccaactatctgaacaaagccaaactcattatatatgtattactccatgactaataagcaagcatggagagaggacacattacttactgtgtgagattcaagatataggagaaacttaagaggtggttattatgggtttttaaaaaatacaaagtgtatatatttgaggtctgcaacttgattcaatatgcgaacacattgtgaaatcatcaccacaatcaagttaattaacatacccaggaggtcacacagttacccttttctttgttctttcttttcctgcttgcttgcttttttcttgtggtaaggacacttaaaatctactctcttggcaaatttcaactgtaaagtacagcattgttagctatagtctccgtgctgtacattagacccccaggattttttcatcttttctaactcaaatacttcatccttaactttaaggaggttccagttttggcagaggggtctgagtcttgtgatgtcattaaggaatgactcaaatgtgtgttaaatgtaactctttgggtaatggttaatgcactatgattttagaacaagaatgagattaatatatgaataaagtacttagaaagggatcaagccacagcaacatggcctggaggagcatttaagcctttgttccaggggcatttgagtcaaatattccctccacctcttgtaagctgggtgctgtcagaaaatgaggaagcctctgcgagcctcagattttgcatctgtcaagcaagaatcacactatttatcatgcattaaattggaagcagtgtacatccagcccctgtcactcacaggttgaaggtagtatccctgcccattggttttttcctgtagcagttttaatatatggaaagaagagcttctgagatggagggaggcccttggccgtggcatcctcctccccctcacccacatggtaacaatgatgaagacacataaagtgcttcccttgaccttggcaccatgctaagccctttacataagggctcctggcagttaaagaatagtcaagactcaaagctccttcatcactgacctcactgttggcatctggtgatatggactaaaaacagccccttattgttggtcaaatcctagatcctttgagttagagtcacctagaatgtttgttaatgattgacgatggtcctcaggcccactgcagacctcccaaatcacggtctcagggatgcacctggaaggtccatctcaggcttctccctgagtagcttctctagtcataaagcttgggaaccactctgctgtacttacggctctcctcctgtcacaccttccttttcagatccccaccccactccatctcacttcagcttctcacctcttgggcaactttcagtggagtgggcagtgagaggggtgcataggaagttaggagtgacctgtgtgctctggacacctatagaatttttaacatggttattctgctatttcttggcaataaccaggaaaattgaaagacatatttccaccttgagcttaaagattgacttctgaggcatgattctagaattgtgaaatcctcatatgttcattcactaagactcaactgacggcctactgtatcccgagagcatgacggtggtcatgaataaggataaggctcagcatatcacaccaaggaaagcttatgtcccataaaagatggacatttattctttggtttgacttaatgcactatcttagttgaaggaagaataccttccataagcacacagactttggaaaaactgagctggcctgggaggtgagaaaaggttcccactccacccggaccagaggcctgagagctggctcttgggggatggggagatggctgcctggtggagagggcacagaatatgcaaagcatgcagatctagaaagtcctggggtgttctggaaagggggagacattgaaatgagctgcaattgtgggtgaagagataggagatgaagctgaacagtaggatagtcatattgactattccatcctagccagtggattcaggatttcaggtgcatggacagatttgatacaaaggggagacattgagtttccagttttgggtatactgagttctagttgcatgcggtacgcctgagagttggttggaaatccttctttgaagccagagaggaaggtttaggtcagtaatggcagcctcaggttttctttgaaatcatagaaatggataagacagtgcctaaagaaagctcataacgagctaacaaacagcttggaacatcaggcactagtcgtaattggtgtaatgtagccactgagaaaaatgacaaaataattttcttattccactgagtaagagagctctctttttttcctttagaattaatgtttcaaaagtgcaaaagtgcttagcatagatttttctcaaccatctcaattgacaactaatgggaccagacacagtataaatttcaccactgggggctagagggtaatttagactctggatgcctgcctggtgactgtcagagaagggctgccaaccttaccaactgggtggttgttttgtaatttagatacaataaatctaaggcaagtaatttcctttcagaaacttgaattgcttccttaacagaatgattggagttatatttaagctgtgggttagatgagagtttagaaaggatacccagagggctctattaattgcactcttgttttaaaagtaatatggtttttattcacaggaaatgcagtggtaaatttcctataagcgctggcttatgatttagggtactgcaaggagcttttgaggttttgttcagcaaggcagccaaagcagctgtaaaagagttgtcatttctcctcctggcatatgtacagtgagtagtggtggagcagggatcttgctgattttagacaaaacttgaataggacttatcatttacaagctaaacattaataagaaaagaatagcagcaaactcttatacaacgtgtcctgtgtaccaggtaccatccaaacaaacatacagttaaactcacttagtggccgccgaccctgtgagctgggcactggggagaaggcaacagagatatgagggatctgcgctcggtcacacggcctgtgattgtgggagcctggagtttaacctgggctgttgtgccccagaggccacacaatgaacatgtctctgcttgagcacctactatgtgccaggctttgttctggaaaccaacagggtcacagtgaacaaggcaggctgcatcccctagtgccgggtctccagaacttacatgcagagggtcaggctatgagaatatggtttaaaatattaatactttgtgattttaaaattttgcttttaatttatgaccaggaaagtttaaaccgactgactatccttttcagggaaaaaataagccattagttgaatctggtaactgagtgaattaaattctccttttcaagcatacactagccaagaagacctttttttcttctctgaattctccttttctatataaatgtaatattgagctcccagtgccaagaccaatttaattcatttgctcgtttacaagttaagagaaagaactttccttaacatattagctgtctgctgctttgggataatgaccagctgaattgatgaactttatataatgatctgttgccatggtgacgagctgcccagtgagtggaagcgggtatttcatcattacctcgctgataatgcttggtatggtaacacatacaaatacaaaagcttttcttttactctgcagtgactctgggtcgatgagccaaacactagaaatgcctcttggacatagcggcagagaatcaaatagaatccaaatgcacaactggaaataaactaatttagcttcccaggttagtggcctccttgtccacatgaatctccagccttgtcacaagtgaccattgtcaggggtgccacttgtcttcctcacacgtttaatttctctattggattcagcacactgaaggctgaataattttaaaaataccttaaactataacaaaagttacagaattaataaaaagagaatggaatccagataatagatttcaccatccaatgctttgcaataatctatttttatatcacattttcctcaattcgtttccttttctttgtgggtaggacttttttcttttcatacaaaataagaatttttatatatatcagatatattacatttctaccctttaagttttttattgcaccttagagaaaatatatgtttatcttctgttttggaagtgttttgggctgctgttgttgagacaaaataacttctttgagtattttttgattgctcagtgttcccaggtgtctcagcatttaagccattatacacgtgagacacagggactttcacgtaaatactgtttaagcattaaattttttcattgttcatgcactcatgatgatagaaggctatctaatcatacacaagtatggacaattgtgcactgtttttactcgttgtgatggtaaatattatattggattcactgtgtttcctttccctcctgtctccacccctcgtttcccactttaccttcttccttctaaagatttatttccgtaaaattttcaaatgttgatggagctaaaattctagaaatccttcaaaaagaaattcattataatcagagaccttttctttaggtacttgaaagttcattcttaagtgctcatttagttctctctgaatttcccccaaaatcaccagaggcagtagcataaaggttttaagcagtagcaccaaccatatgaattattacatattgttgatcaaaatgcattaattttgcaaaatgttatacgtcctatgacattccctgcgacttttctagatcagaactacatataaaggtggttatgtgaaataaatgaaaacatttacaaataataggctattcataatatgagtacaaggttatagtacaaggttaaaaagattgaatctaatatataatttataatgcttccgtattagaatttgaatcacaatattttagaggaaagcaaaaaaatatttataatctagtttttaaattgcgcttaacagtttatctggatgccagaatctattatttctatatcctactcttgacatatttatattatatatatttataattatataaattatataaatatttatatcatatatttataattgtataaattatataaatatttatatgctatatttataattatataaattatataattatatatactatgtatttataattatataaatatttatatgatatatttataattatataaatatttatatgatatatttataattatataaatatttatatgatatatttataattatataaattatataaatatttatattataaatatatattatattatataaatatttatattataaatatatattatattatatacataatatataattgttatataatacaatattgctgggactgccataacaaagtaccatagactgagcagcttaaacaacagaaatttatttctcagccctggaggctggaagtgcaagatcaagctgtcggcaggtttggtttctcctgaggcctctcctcctggcttacagatggctgccttctctctttgtccttccatggtctttcttttgtgcctgtatcctaaccttctctttttataaggacaacactcatatcagatgagggcctacactaacgattgcattttaccttaaatcactttagagagcctgtctttaaatacagtcacatgctgaggtcctgaaggccaggacttaaacatatgacttttgggtggacacagttcagctcataacagactctatcttagtataaggcatatttaccttacaaatgagatattgttacatttgtgttcatttaaattggccagtactctgaagatgcaaaacggaatcttgttcaaaccataaaattcatgttagctacttaaacattgaaagttaaaaaatagcagctattttcccccagagcaaaaaacatggttaatttttcaccactgataattgaattatgcacatgagagtctacattatatatagcaaatagtgatttaaggggcttatttttattgtcaattttaatgtttaaacaaatcctttgtcatctaaattctttttttttttaaatgaaacagcaatagaaggttttttttcatcgtctgtttccctgtttgcttcatgagcccatagaaatgggagcttgaagcctgatagagaagtctgatctgccctgggcttggcatcctttagacactagttttctgtgtagtcagtggtatgataagataagcacatgtctatacatcacagctgcatcttttcctggaataacaactgctatttaatatgctgttgtatcagttcacctgatttttaggaactcacaatctatactattactgaggcaccattatagggattgcatatgtctctttttatacttttgaaacaaaaataccttcaaaaattcagaaaccagctcttgatccgtatgaacaggacctaaactctggcccagtagtctgacctttggaaatcagttaacatttctggaccttgcttttctcaactgcacaatttaaaatattgttttacgtcccttccaaccttaacatccatcatatctttgactgtttgaaaggttaacttggaaaatataatgatgaaagaaggttcaaatttagagatgaccaaaatcagtaggatcactcatagtctccccaagaatgtatcttgctggattaaggaaatcgactgcatttcttacattaaggaagaaaagatggtttgtgtgtgtgtgtgtatatatatatatatatatatacacacacacacacatatatacacacatacatatatatacacatatacacatatattcctatatatacacatatacatatatacacacacacatatatatacacacacatatatatacacatacacatatatatacatatatatacacacacatatatatacacacacacacacacacacacatgtttgtttgaacatcatgctatatacctttgcttgcttttccttgttagcttaatttaggaataaatacatctgatttcccctgtgatttgcacttgctttaatatgtggattattcaggctctggatgatggaaaatcatgttggccgcagtgtttctgtttgggaggtcagtcagggttattcataaaagagacacagaagctatactccaaagaaaagtaggaactaacttgacttcttggtagatagaaaactctacaaagcaaacagatgaaaaacagaaataaccttttctaatggtcgtgattgctttctgtccatcaataagtttctgaaatgaactacctacatggcattcactcccacagggcatctgccactgcctgtgagctgtgtgccagcaagtgatagcaggtgtccaggtaaggatttagagaccaggttccattctcatggccacatttactggccgtgtagctgtgagctgtcacttcaccttggtgaacctccatcatcttacttgaaagaggaggcaattgacctggtgcagggatttttaaacacttatagagaaggacctctatatttgaaaaatagggcaaggttcaatatgtgaaatgcagaaaactgaagctcatgatgttgtgggtttggacttgtctcttgtttgcgtgtagccaggagtacctggctctccagagcagcaccaggacacccctgtacatcctcaggcagtcccgtacattagccacagcctgctgaaatgtgtctctggccagctgaaatgtggttagtatgaactgaaatggactataagtataaaatacacttggatttcacttcatataaaagatccaaatattttatattgattacatatgatatatcacataatttttttggaaaccttgggttaagtaaaatatataattaaaatttattcacctgtttccttttttccattttaaatgtggcatctagaaaaatttaaattacttttgtggagtctgatgtgtcaccattggacagtgctagtctagataaaccctttcggttcctacctcctaaacctcagtgcttgagggtttttgtggggatcctaattgctattgctgcttccccagttcccgcgttcaggtcactgcgttcccatgaaatgcattaggaatttatcctggtagctttacttactgccacattctgctctaagaacagtatttcattcaaactcccattaaaaaaaaaaaattccccactaaaaaacacatttctctttccagttattcttcccacagtgtacttagtaacttatttgttccaggacatgaacacgttttcctgtgggatggggactgggaatataagattcagtgtttcatgggtcatttcttgtggctggaattctttgggggtaatttctttttgtccttttcaagttacactcctgtcttttgataagcattgtgtaaacatttcttctccagtagtcatgtttccaatggaatctactactgttttgtgtgacagtgtgcaaactttacctttgtaaactattttcatttatgacctttgctttttcttttggtcattttcctaatgactcagattgtagaggttgaagggaccatctctgtcattatggtaatccagttttacctctgcattttatacctgacatcaggtttactcctggtcttctttgactgcattggtcaccagcaaaaaatatatatatattaagaattgtttagacctacaatgtagtgatctgtgccgaggagggttctcttcttctcattggcaggcatgccactgaagccctttgcttgttcgagagttggtctggtgacagcatgttatgtggtccttgtttctttaggaaatcatccttttatcttattctcagaaacaccaacatttaattatacacataacttctactcatctatagttatgtgaacttttctttgcatgttactctctttaaacagttggtttaagggagcaggaaggtccttcactgtttgcccaaggatgctcgagtccaccttgtatgtacagagggagggggtcattgaggccagaagaacatattgccttctgacacagatgtgcctctgcttgtccttgagatggatgacagacaaagtcttccaatggaggagaatgctgacttttctttctttatttcttcttaacaacaacaatagcaaaacaggatacatatgcagaatgtgcagatttgttacataggtatatgtgtgccatggtggtttgttgcacctattgacctgtcttctaagttctttccccttactccccttcccccaacaggccctggtgtgtgttgtccccctctctgtgtccatgtgttctcaatgttcaactcccacttaagagtgagaacatgcggtgtttggttttctgttcctgtgttagcttgctgaggatgatgtcttccagcttcatctatgtccctgaaaaggacgtgatcttattgctttttatggctgcgtagtattccatggtgtatatgtaccacattttctttatccagtctatcattaatgggcatttgggttggttccatgtctttgctattataaatagtgctgcaataaacatatgtgtgcgtgtggctttatagtagaatgatttattttcctttgagtatatacccattaatgggattgctgggtcaaatggtatttctggttctagatccttgaagaatcatcatactgtcttccacaatggttgaactgtttacattttcaccagcagtgtaaaagcattcctatttcttcacagcttcaccagcatctgttgtttctggactttttaataatcattctgactggcatgagatggtatctcattttggtttcgatttgcacttctctgatgatcaatgatattgagcttttttcagcattcattagaatactgactttcttttcattgccctccagttggctaagttctatgacttctagaagagcggatagaaaaaaaggacaatgcaatcaaagcacaactacctcttcccctgtttcagtctgtatcctcagtaatagccttataattaatgttcactgtggagtccattgttataatcctttatttcattcatcaacattgaagtgaaaaggcatttcatgtctaaccagttcatagaaaatatgtatcagttctgttctctaaaactcaatatcgtcacctataaagtaggaatatgttgctacatatatccaacatatcttcactagcttgccaagatgatcaaaggagatgtgatgtaatagggctgccatatatagcaaatataaatacaggctgcacacttaaatttgaatttcagataaatcatgaataatattgaatagtgcatactaatactaaaatattattcatgtttatctgaaattcaaattggcagcctgtatttaatctggtaaccctagaatataacatcccttctcttctgctaagatgagacaaatatgtagtgaagtataatatttaatgatgttttcatgtaattacaagtatttgtgtcttttgaataataaccatatcaacactaatggatatttaaagtcttgaagtagctctgtccctttcatgatgagtatctatagttttctatttgagagagaaactataaatagatgacactcagatttgtgtccatagcataatgagtaggggacattttcacaaatggcaaatactatgagagtttgcactgaagcagtgtccattctgagcatcctctggtcagcactgattctgcagctccacctcacattgtcgtctctccttgggaaggggaactgaaatggacaggaaatgcctattttttttttttttttacttgttgatctctgaatgttaaagaatgattaagaagattttacatatttctggcactttttttcatgcaaataactttggttagagtattaaatttcagaagtatagaagttttgtatggctttatttcttgtggcaaattttcggagttaatattttcttggatgaaaccaattcttcattcatatttagtttatgacatcttgggttgaaatctttccatattggtgaaattcatgtttgttgtttcaccttcacactgactaatatcataactcctgctagagattataatgggaaaaatattaatcagcgctctttagcaaatgtgggagtaataatgacattctcattccaggctggctacacttctttccctcactcatttgttcagtctttcagcagaatatattcatgaaacatctaatctctactggccctaatagcagccactacacatacatcatatgacacaactgacatagttcttttccctatggagcctaagatcaagtgtaaaaaccacaaaacaagtaagttagtaactaaaaccatggtaaatgttgtaaagtaaaaacagcaaccaaatacaaatagctttgcaagatccaccagggtcctgctattgtcctcctatgtcaaatagaaatctatggggtttttcggggtgtctcttctatagggccatctctgtctttctgccactgaaagaaaataacattgtcatttgtcacctcaggcaaaggagctgcatgtccagggtatgccacaatcacaggctcttgggctgcaagtgcttcctggtggccgttgccagagcacagagaggcacaggcaaggatggaggcatgaaggagcatggggccaccatgtgcatgcctggagcctgcctctagatgcagtgagatgtgggtgacagaggtgtagaggaagctgcaggagtggcagggatgacaggggcgggtggacgagaactaggtgagctgtgggtgacagggaaggagaggtcccatcatcggccctgggattatggtgctgctgtcccttagacaaggtcacaggaggtgggacatgctggtaggccacatggagagtcagggaggcctgtcaagtttctggtgtctccagtccctaacggttgagttgcagatacagagccaacattcagctttgaagacagatcccggctttgaagacagaccctagggtaatcatgaggacaggggatgagaaggctgtgaccaaacatgtgagcatgcaggagttcagaacaagggcagggcacaggcaggggaaggaagagcttcaaggagacaggaagggtctttgtgtgctaaacctgatgcagagggaagggggaactgtggaggggactcgtcacatgactagacactccagggagtgaaggatgcacggtcatccattgtggaccagcatgcaagcccacgctgagcactttgctctgaaatgctaagccctgtagttttgttagttcccactagttggaaaatcagatacaaggtatgcagaaatatgcagtaaaagtttatgatcaaagatggctcactcttttaagtcaaactatcacagatctttaaaaatttgattctttccacaattacttaagaatttgaaatacatatgagcatattgacatttggactgttgttaatttgggcaggtttctcagaatcataatccttcaacaaaataaataataaacagcaatgagtctttgttaaattctcagataggctatagttctgtaaactctgtttcccatgccactctaggctggtgaacaactagtgtgacgctggtcacagcacagtgatcctccagctggatcctgactctaggcaggccacccacccctgaacttctatgaaagctcctgtttcacccaggggtctctcacataagttctcccatgagccttgcttcccctgcctccctcctaacatgtgtctcagatgatgtcctcttgtgtaatgatgtcgcaaaggcagccacaggctctatgcccatcactgctccacaggaaggctgacacctccctctgctggtgcctcatggggacctccttgcagggcctgtggctgacacatgtgagctgatgtcaccttccctgaagcccccatcttgtccctgttagttccttggtgctgtgtaagtttattgactcttcgctgtaccccaggcagagagacctaagaatcattgaggctgaattttccaacaagcttatgaactgtgatgtccaagtcaaaattaatttgaattatagaattaagacataaattttttcttacatgcttacatctgtgaactgtgaatttgctaaaatgtctgcctctctacgccacagctgcccctttctcttccctctctcgttctctcttttgtcctcacccttttacatgaacacaaatacatgctctttcctcaagatcattttaaaatcttccccgcatatagcatacttcagtgtatgattgacctttttaaaaagtagcatatttaaccagttagcttaaaatgaaagcaagcaattgtttgccaatactgtctacatgatttttcagtcagtgtataatcagaaaatgctcactggagatgtttcagatatgctttttaaagtaaattcaggctaaaacatgtctgcttatgtatttttttaaacacaaatagcctccatctctatggctttcatagagagagaaaaatgtaaagtattttatccaaggtcttttgcaatgaattgcttgataggaggccttgaagtcaaatattcttgactacttctggttttagaataactccttaaactcattttctgtgtttgcaaaataagaaccatgatgttttgaaactcgggatcatggaaggttttattcagtcagggccttcaggatgattccaggtacttgagtggatctctaagcggcttccagaaggctggatttcatgcctgggatttgcagggtgtcagcaaggagttgcggggtgcagcacagggtacctgggagagcaatgttcgtttcaactgtgtgtccccctaagctgggaaggctgcatggctcaggggccgctcaccctccagcagtgctagcagtcaagcagataaataagtgcacagaaacacccagggagcaagaagcctggagcggggagggcttggatcaggccagaaattaatactcagaagcacaagaaagaaagtttggaggagttgagcccaagaaaatcatcccaaagagcaagcactaggaggaaagaaggagctaatgtagacagaggagagagggagatggaggagggtgtacttctcgtggcaggaaggaggagggggcatcacagtcgtactggatatttgaagctgccaatcacattgcattttccttgccctgctgggcaccaaaatcagcatctctgtcactaagaatccaagatcgtcccttgagggtctttctttcctgatgttttccatgggatggcacaaagcttgctactttgagctctccatcccgagacttggaactggaagggtccaatcggacatgattagtcctcatcccttgctacatgagagcatcattttaaaagatactgctgcctgggccccacatccagtgcagctgacctaactggtctgcagtggtgtccaggtgtactgtttttgaaggatgctcagatggctttcctggctgaagatccatggctgcatacacagcacactctgtttaaccagggattggtttgtgagaccctctgaccttgtttccttttcatcctgtgaccttcatagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccgcacacgcaggtagggcatctccggggtcaggatgcactggtgtgtgtgtgaagggcccacccagagagagccagggaggcttcagatgccctgaagttgaatggcctcagagccacccttcatgcctctgagagtcctgtgctctaggatgcagagctttcattaaaatagattcactgtgatgagaataacccaccagttctcctcagaggaggagccacgttataatacctgtaagaagttgtcagggttaaaataaattattcagtgccttagaacactcagtggtaatactgatatttgatgactgtattaatatgttaatctggcacaagcttatatatatgtatatatatatacacacacacacatacatacatacacacacatacacacacacacatatatatatatatatatatatatatatatattttttttttttttttttgagacacagtctcactctgtcacccaggctagagtacaatggtgagacctcagctcactgcaacctctggctgccaggttcaagtgattctcgtgcctcagcctcccaagtagctgggaatacagatgtgtgccatcatgcctggctaattttggtatttttagtagagacagggtttcaccatgttggccaggctggtcttgaactcctgacctcaagtgatctgtccacctctgcctcccaaagtcctgggattacaggcttgagctactgcacctggcctcaagcttgtattttatttgaatatagaaataacaaaaaatattataaggtatacgtccttctcgaccacagctcatatgctgataaccccttgagaagaaggagtggttgatgttgctgcagtggcacccactttccgggacacccccccctcccccgccactgtccttggcaccagctcccctggagtgctgcttctctcctgagcctgcagagagggtagggagggaggtctccagccacagggaaacccaagagtcattgcatcttccttcaccctcaggccagtcttatcttccgtgggacatccacgatcaaccacagttgtgtttaaagtttaatttggaaacatgttggcccaggtacttaggaaatgaaaaagtactgtatacatcacacacctgaccagcactttactccgggagattgtatatacactctgatccctgacaaaagatcgcccttggggaaatcagaatcttaaatgttcttaggcatcttgtttaattccactcctaaagcagggtgtaattgcagatttggagtagaaatagtcctttttgatatatcactcacagacatctaccctacacaggccactctctctctaaacaaggtgccaagttacactggctttggaactcagaagctagggttcatggaacagacctgttgttgccttttttttttttttctgaaatggagtcttgctctgtaacccaggctggagtgcagtggtgtgatctcggctcactgcaatctccacctcctgggttcaagcgattctctttcctcagcctcctgagtagctgaaattacatgtgccagcatgcccagctaatttttgtatttttagtagagacagggtttcaccatgttggccaggctggtcccgaattcctgaccttgagtgatccacctgcctctgtctcccaaagtgctgggattacaggcgtgtgccactgcgcccagccctgttgttgctgtttcttgacccaggtcgcaaaagtatttcagaattcactttgtcactcaacacatgtgaattgctgtagactcaaataggataatatatagagtataaaatttaagcactctgcaaagtgagtattcttaggtggaaggaaggttttgatgtgtaatcacagcaataagcctgtcaagatgattctagaaaatgaagtctttaatgtctcctttgaaatgagagagagagttgaggaataatgccaggaacctcccagctaatcataatgatattgtgaacattaataacagctagtggtatttattaactgccattcttatatatgcttacttcctaaatttaaccactggctgcttgaaatgtgttctggtttgtgttccctgcagaactagcctagggaaggaattattcttcctccagttgctgttggttcagtgggtaacaggattggggtctggccaacaggatgtcatagctggaatatatctagaaggacaccagtctttcaactccagctcagtgaaggatgacctttttggagggtgacacgggataacccacaggaagccgcaggcctgtgctgtctgcagggtgattctggtgccagaatgggagtgcatggcttacagagcatgaggcaattcatcttttacaggttgctctccttccttgagtctgggtcataatcgctcagcctcttgtacacgcaacttaggaactaagttctgcatcagatcagtgatgagaggcacagtgtccctggcatctctcatgcacctgaactgccagcccacttgtggatccacaggagctggtgctccaggcacagaggcctggggaggagttcactgttccctctttcctttcaaggagaatgatgacactggtgtgtcttcactgggctcctgagagggaaggagcttgacatttatagctggagcttaatcatcctgctgtttactctgagagaagcagtaagaaatcgtaacttcattttcaactgatagactatagtcttctgtgtgcccttcctcagagggggttagtttttgcctggtcctttagtatttcattcgagaaaagaaaactaaagatttcaacccaagcatttctctgaatatttccaatgtgtttctctattatcctactcctgtagaaagataggaaaccctccctagttaacattccatggagaaaagaatctttaaaaaaaaataactgcacaaacattttttataaattataaggaaaaattgtggggttttttgacaaaagcaattttaatctttcagaaagatgcttaaagaagtacactaaataggaataggaaaacaattgggtaacgattggatactaatttctttgccaatatactttccatcatagaatctcagtaatgccatttattattggaaaaccagtcttataaatgaatcttgaagtatttaaaaagggaaactgcttatctaaattacccatctccttctaaatcatgtttacatgtttaattttcttgagtcttttttccaaagacaatgcacaatgacatttattaaaatgtgtataaatgataactgatacaatttcacaaatttctttcacatatctgacaatatgctagattttgtgagaatttggcgggattattatgtcaatcctgaaagtaaagtagcataccatatccattgttcagatgaggaaatggcagctcatatttttggtgtcctgctcaaagtcacatagctactgcaacatgagacctgggtcagagccgagactgccccaggcccatgttgtattactggttgtttctgctgccccggtacaacgaggaccacccattcagtggtcagatttcagctgaaggagctgctggattgcactcttcatgtgtgaaactgagaggcagagctggtcagtacccagacaggcagaagccaggtcttctgagagaggctcaacccccttcccgttagcctcttcctcattctgcttgccatcagactggatcaagcaaacatgaaggaggttttatactctgtttttccaaagctttctaagctgagtctccattccctggttattcttaaggagatcctgggacctcaggcggcgggggttgggagtggtgagagaacacctgcctgtactgaccacacgtgtgttgtgactgatcagaacatagcactgttgccttagaaagttattttaaaagatcaatatttcaaaattatatttccgtcaagtttgacctcaaagacgagtaaaaaaattgtgttttgatgttagcatttttttttagcacagccatttaatagatagagtgagaaaatcattcaaaagacaaagctaactcattggaattggtggtgatctctggggatgtagagtaccagagaaactgcactattcatgcatatcctttttcattttaggccttattgaccacatctgtgtataagttgcaaaagtgagttcacattcactaatttctgaggaatttggggatctgggaaggcccagctatgagtaccatgagtaacaggggaagacaggaaagctgacctcatcctgtgggccaggccatgcacctggctcatggtcgagtagcatcatgtggtctttaaagtgggaaaaggctggaagtggtgactcacacctgtaatccctgcacttcttgaggctgaggcaggaggattgcttgaggccaggaattcaagactagcttggggaacatgatgagacctgtctctacaatgaataaattaatttagtggaaaaagtctccatgaggaggcacaggatggagcagccaagagcagccactcactgacttcctgccttgtgtaaacaccaatgcgaagtcagaacctgctaccctatgagctctggccaagaactcataggcttcccacctctgtaattcaggaggaaaagagcagccacaggacctgtgctctaataatcttgtctagaaatcaggttgttattttctcccacaagaaaatgttatagccttccaagtagtgtgactgattgtacctcttcaaggctaagaaaagaacagcttagaggtgtggtgatgggagggccgctgatttggactctttttattctgttttgttttgtttttgagacgagtctcactctgttacccaggctagagtgcagtggtgtgatctcagctcactgcaacctccatcttccgagttcaagttattctcctgcctcagcctcccaagtagctgggactacaggcatgcgccaccaggtctggctaagttttgtatttttagtagagacggggtttcaccatgttggccaggatggtctttaactcctgatctcaggtgatccacccacctcagcctcccaaattgctgagattacaggcataggccaccgcacctggccctgatgtggacttttaaagtcattttaaggcctctgtgtggagtggatcagcatgttggcaaactttctttgcaaagggccagagagaaacacttgtaggctgcacagatgtccagtctctgttgaaactcctcagctcttcccttgcagtgtgaaagcagccatagaccataatgaatgggtagatgtgtgggtcaagcaaggctgatggatttgtctgttgaaaaaagtgtgatccgcttttagatccagacagtttattacttagccaaaaaaagagcagaaaatgagtctactcaccacatcccttgtcccacaggatgacatcaaaacaaaaggggcagccgggcatggtggctcacacttgtaattgcagcactttgggaggctgaggagggcagatcacttgaggtcaggagttcaagaccagcctggccaacatggcaaaaccccgtctccactaaaaatacaaaaattagctggacatggtagcgcatgcctgaaatcacagctacttagaaggctgaggcaagagaatcgcttgaacccgggaggcagaggttgcagtgagccgagatcacaccactgcactccagcctggacgacagagtgagactctgtctcaaaaccaaaacaaaacaaaacaaaatggccaggtgacagtgcagcaggaggactaaggcactgtactctcaggagcccgttccatgctgtagcctggcagttttagagcctaaagctgtatcctagtgcgggtatatgaaggggcagaaagccttacacctcatcagaacctggaaagcaatgagaagctcctgacagccttcctgggacatagggatgagggaggaatggttttgcagcagttcctcataatcctcccgcgttccaggaccagggaggatcctggggccaaagcttaggtcacttgtgagtaagccttgccctgtggcctctgtgcactcatgaacagtcaccagagaggaacattccccagttctgtgtttcaggaaaagtttaggtggccgtatgaatttggccacaggctgtgtggtttgctgacccctaagttagattatcatctaccttttgaataaatgaatgttccttaataacactaatttagaaaattaggtatttcatttatcaaatgagttattaaattacataggttaatctgtaccctaatattttctgaacaccatggaattttctaccctttggatacttactcatacaatcttaattttttatttaacattcattgaaagagtgtgcacttaatcttttatcatagaacagaaagtagactgtaaattcctgcatgccagcacaggcttcattcaagctgtgggaacataagctcccaaagcctgggcttcctctgtgcttctgagttcaatgaagcccccagcctggtatccagctcaaaaaagggtcagtaaatataatatttgttaaattagcaaatggacattctgcctctcccttatctgctaatttacttcataccttgaaaggaagcaaaattcttgtgacaaaataaaattcctttgcagaaaaatgtggcaatatcatacagtagcaaaaggattgaaagcctttgggccttaggtgggttttttttttttttttttggtttgttttatttttgcttaatgaactaattgggggaaaggagagaaaatctgggaactggaagtattatagcttacatataaaagagtcacaccttttaaattgtgccttataagactagagggaaagatggaccattaagaaaaagacattgggcaggacgtggtggctcattcctataatccccgcactttgggaggctgacccgggtggatcaagaggtcaggagttcgagactagcctggccaacgtggtgaaaccctgtctctactaaaaatacaaacattagctgggcttggtggcacaagcctgtaaaaccagctactctgaggctgaggcaggagaatcgcttaaacccaggaggcggaggttgcagtacactccagcctgggtgacagagcaagattctgtctaagaaaaaaagaaaaagaaaaagaaaaggaaaaagacattggttctattgagtgaactggtatttgggcgttcttaatgcagttagcctttaatagtatcatttagttaaagaaattaacacctcatcaaaaaattagtatggaaaattagattactacaggatgtttattgctctaaaggtcaaagttttaaaagccggagttaataggttgacacctttcttaattaaatattccctaaagacagcatctgccaatggaaaaagcatacaatgtgtacagagaaattgcagggtctccacgtggtctcccagccagacaaccttactcatttggtcattaatcaaataaacattcaggaggacattttgacatgtacccattttacaaagtaaatattatcccctcagaatgaatttaatatttgccaaatctcaaagtcttgagtttttgtttgtgctggctttggtttaacctctagagaatgtggattttttgtaattaattcctttatattatatttattgaactcaatacatgccaaacaccaagtggggccctgcatagaggatgatgaatgaggcatccctgaccctgccttcagaggactcagagtgtaataagaaattctggtgtaagtaaaatcacctgctgtcatggaactgaaccgaaggaccttggagttgccttagaatttattccaaaatcgatttatctttaaagtctgatcccggaatacactaggacctaatctcctcacctaatgttcctctccaattattttttaaagctatatctgtatcataaccagtgttctaattttcaatttccagtagtaagggaattaatcaccacttatgatacatcctttcaacgattgttctctgattgagttattctgaagccattaagcgacacctatgaagacatctgtatgacacaacaaaaatgtaataaagcacagcaacattatatggatgccaccattaaatctgtttttaaaaatagagaaatggcagaaagtaaatgcaccgagtttttgttggtgctggcactaacaaaagtggtaagtgctaattaggacagtgaggaagacatgataagaggggttccaaggtaggcttgggctggagcacagtgtattccagtgttgtcgtaaggtaacacccccagaccctgggcagggtgggtaagaacccatcaacacgtgaaactgctttacaaagagaatgtgtccttggtctctaaatggcaatgtgtgttttcaacagtcagctgggtaaagtttgaaaatctattaccaactgtttgtacttcagttgagaaacacaactaaaggatatcagaaagaaaaagtttccttcttggccaggtgcagtggctcacacctgtaatcccagcactttgggaggccaaggagggtggattgcttgaggtcaagagttcaagactagtctggtcaacatgatgaaaccccatctctgctaaaaatacaaaaaaaaaaaaaagctggatgtggtggcaggcgcctgtaatctcagctactcgggaggctgaggcaggggaattgcttgaaccagggaggtggagtttgcagtgagccaagactgcaccactacactccagtctgggtgacagagactccatctaaaaaaaaaaaaaaaaaaaagttttcttctttaatatctactccacaggcctcctgcttttgagctctcaaatttaaagttatgtaagaattccataggaaagcttgagctgccaccacttcttggctccagacccctgcacctgagttattctaaatacgagcacctggacttctcctaagatttttatttgctgcatagtccagtgaattcttaaggagataactgttctcatatgtttgcaaaacagcttgcctatggaaagagcatgagctttgcattcagatggttctggatggggcttttgtgtgtgtgaccataagccagttactcaaagtctttgtatcttatttctcaaccctgtttccataggagtgtgttattggagataaagagagagaggctatgttagggggctggtacttaataagaatttgacacaagatagttcctttcctgttttaatactatactcagttcatgcaggtccttctgagctggcattgcctgtgagtggtcttttacactttctgcacactatgttgaaggctgggattcaaagtctccctctgtcctagatgtaagtcaaaataaaaagtgaatgaacaaacaagaaagagaaggaaaaaaaaaaagtaaaaatgacagactgctcttttatgtgtggtttgccttctttgcccacatatacttctcatggtctccggactaaactgaaggtaaactgaccagccaatcatttgctgctctgccttcaaacaacttcatgttgtctgagaggaggattcttctcctttcattcaattgttacctgactctgccggggcaaatcaacagttcatgagactctagcatgaccacatgatgtgcttgggtgagtgatgtcagcatggcctcatccaagcagcgggagcatctgtccatggatttgcaataattccctgtctcaagtgaacatgtctctatccacacaagagcaactgggattcaggcactgatgaaggctacacaaggccaagtgtgaagagagccaggtgcttgccttcaccactgtcaccggctgcccagcagtcatgagggcaccagagaatccacattcaaggcagacctcacacttgctgtaactacccgctgagagggacaaatgttctttctgaggggtgggctgtactacacagaagggttccttggcattgaacctcttccactcaattgcagtcaaactgttaagttaggtgaattataagaaaacagaataatacatattttcccctctggacttatgcccttttaaggttttgagtaaaaattaaaatgtattacttgacaccttctgcattcttcaggcataattgttgacccttaaaccctatttcacagaagtgtttctcttgaaaaagaaaaacatgttatatagcaaataagtaattgtgtcttcattttaaatcttaattagccaagaggagaggacactgggggagggtgaactttggaggtacctataattatgcctacttatggaatagagaatgtggaataccaatggtgtgggtttctccctgaatgaagtgaccagtaattattttcttttcttcctgagcacatagacacagctgtttctggttgccattcctggtgagttacttccacatcgtggaaccatggaaggtttatgttgggccattgaaacaccctgtgcctcctttgtcctggttttggtcccctggtacaatcctagccatggaagaggctgcctttcttggctttgtcctggaggcagtcttggcctttctagaaagactttatatttgttctagagaaaatttacaatgattgaagcccacaaggaggtcaagataaacagctcaggattcagtgcttaaagagggagtggaacggggtctctgcatcaggtcagaaaccaaagctggcaaaccaagttaatcacaagtcctagatccaggaagaacttttgacttgcttatttcacatgtgctctatctaatcccatcactgttttttaaattatcaattttcctgaaatgctttactgtaaaatgtgtatcaatcttgttcaattttaaaacagatttttcaggaaaattgaaatgttatatttgcctatgggttttaactaaaagaacatatgcttagtatgcttaatattagtgccagtataagtcaattatttaaatttaatattaagtgcaaaatgaaatgtaaaaaacagccattgtatttgatcagtgttatttaatgttaagccgagtagttttaatacatgaaaagtattaaaagttaatcactaattgaaatcaagtacattaatttcacctacaaatcatagcatgtaatgtgaattattgctggacttagtattttcaatatagaatgttttcaactacctcagaaatccatagtgtataataacttgaaattgtgcttagggactaattataacaactgtatgcatctccatctcaaaaaaaccttttttatatactgtctagcacgatataactctccaaacagccctgtgaataggtatttttgttctagttttgcagaagaggaaaacaatgaaaatgtatgttctagttggatttaccaattgaaggatctgtggatgtctcaggaaggctattgtctacttggaattttcttcagtcttattttttgtaagataatttgtttgtttgtttgtttgtctgagatggattctcactctgtcacccaggctggagtgcaatggcacgatctcagctcactgcagcctctgcctctgaggttcaagtgattctcctgcctcggcctcccaacatggcatgtgccatcatgcccggttaatttttctatttttgaacatggttcaagactatgttgaccaagctggtcttgaactcctgacctcaaatgatctagccacctttagctcccaaagtgttgggattacaggcatgagccaccgtgcctggccagataatgtttttaattgcagctcttaaagtacaagaatagcttatgaagtatatggtaacatggtacttaggaatgggacagattttcataggaattagggaagggataattcataggcagtttgatcactaccacaatcattgtaatgataatagaagttaatattgatgtttgaagtgtggctcttgcacagtatttgggaagcactttaaagtatgcaacacttgcaaggaaaccctcaatctttagtggagcccaaggactctgcccatttctctcctcaagcttcagcccaagtccagcctccattttaccagttcttcaaactctccaagttctctccccactgagtgcttttcccaagctgatctctctgcaaaaaggttctgttcttgctggcgcctatcaaatgggtcacttctgttcatcccatttgttccagtccctacatatcctctcatccaaggctcacccacccatcgaagtggggattcaccagactcttatggccctttgaattcttcctttgcaactggttgttgatatttatcatgtaactatttaatatttactttcttaaccaaatgggaagttcttggagctcagtgacagtgtctgtttgccatggtacacccagcactttcaaagttgacttcatagcaagtgctcgtaagtatgtgctgaattgatacatgattgaaacacttttaaaatcccatgtgtaagaatacattttatattaacaaaatggcaaaaattcttaatatcaaaaataaactgacctaatgataattagtgtgacagtgacaagccagataaagtcatcactgatacttagataatctaataggcacgaggaattgtacttattaataaatctcaacttttcagaaatacagtgaaaatattttaatgaataaacttatttttctgttactccaactaacaaaaaacgtaattgcaaatttttaaaatgtaaagaaatactttagatatatgttgatgttattgtcatgtggaaaggaaagtagacatttatcctgctttttagaattaaggcctgtctccaaatatatgtttagctctaaaaaataccctcaataagtgtgtttttgaaaaaaattaaaccttcggattctgactaacatttttatctaaattcagatactttcaaataccagggtaatatgtaaaatgagaatagtgtaaggtcattaacacattatggaaattttaaaattgaatgttgataattatatttgaacagaatatatttatggggtacaaaatgatgctatgacatatgtttacaatttagaataattaaatcaagctaaaacttttattaaaaatatttaccacacaaggaaaaacattttcaaagtggaatacagaaaagccactttcacaatggctgcattaattggaaacccatgattttccacagtttcttaaagagatccagcttccaaaaataaaattgtgtaatagattttcttaagacataatttagaataaaggtagatctcatcagaattttgcccatggtgtaaaatattttgcatgaggaaattatatttaaatatacatgatattttattgaatgggcatttgtgtttgtaaagacattttaacattttaaaggataagtgtaatgttaagaacgtgcagaaccattggaatcatcagaagaaagagatgttattacatgcagctttccacttaaaacagcttgaaatacttccctctaacactgtggcattgttttaagtctccaagcagctttgcatgggaagtctggggtaaacgtgaggagcccgtggaatttttccctttttggaggtttaattttaactactggtcatgttgctttaataagaaacacgaaaaggaatgcaggccttttgaatgatctctaagtgtagcctcgctatgcttttgctctgtgtaaagaatcatacacagagaattcccatatgtgatatacactatgttattttgtcaataaaagaattactctcaggtttgccataggagccgcaaatataaatatgtcacttttggctagtttagtaagatgaagacactctcagattcgatctcattggcacagccaggtggagtcacagcagggagcagaaggactcttagcgctcaccccacccgggtctgtctcatgagttgcacttgaagggtctccagatttccagcaacttcctctgggcatttttctacagaacaacactgcacatgcaaagttactcaggaagaaattgctgacacctggataataaatgcacacttttcatggtcttagtcattggttgtgatagtttattctcatcttctctattccctgcacaaaaaagtgttattaaatcaattgcgtgtcttgagaattgagaaaatttttatgtgttttctacaataaaaatacaggttcaagttttattcaatgagactgatcattggaataattttttatttaaaatagtacattattgggaatcatattcccaaagctagagattttaaaatgcttatgctcacactctctgttataaacttgtagtaattgaaaaggatgtcatttgaataacgggaaaagaaaccatactcacatctattactcttcctctaacacctgaatttgtttgttttgtgtggggtttgagatgtttagattttttaatatgtatttgtgatttttgatttgtttgtttgtttatgaggaggagaaaaatacatttcaagtggataaaggatagggagccaaaaaatgataccttagaagaatcagaaggaatcgggggagtgatgtttctataatctttaatctttctataatgtttgatgcttaatctttaagttgggaagatttaagtgagaaagatcttaacatggaacacacattagatgctataaagaaaagtgttcataagttttactgcataaaatcttataacatgtatatctcaagaaaaaaatgtcaaacagggaaaatattactcagagagggctgcattttaatgcaaaaatcaccccttccagtgaccatgtaataaaatgaatgactcatgaaagagatcaaatcaggaattggatatggataggaagtttacacatggaaaatgcaaatgtttaaaaagtatattcatctatgctaagccttaacctaagacacaactgaaagaaatgaaaacagacaattgggaaattctatttttttcatataccagctttctgaaagactcaccctttgggtgagttaaaaaatatggtaacatccagtgtgtaacagggtgaggcagcagaggcactcccatattgttggttggtccaaatttaataatgcctataactacatgaataaaattttatcatatagaaaacccatacaaaaatgagcactgcagccttgcttttaaagggtaaagttaataattttaaaggggaaatttacactgctggtgggaatgtaaactagtacaattactatggaaaacagtgtggcgattccttaaagaactaaaagtagaaccaccatttgatccagcaatcccactactgggtatctatctggtggagaagaagtcattatatgaaaaaaggcacttgcacatgcatgtttatagcagcacaattcacaattacaaaaatgtgggaccaacccaaatgcccatccatcaaggagaggttgaagaaactgtgatacatatatatggtggaatactactcagccataaaaaggaataaattaacagtaacctggatgagattggagactattattctaagtgaagtaactcaggaatagaaaagcaaacgtcgcatgttctcactcataagtgggagctaagctatgaggatgcaaaggcataagaatgacacaatggactttggggactcaggggcaaagtgtaggaagggggtgagggataaaataccacaaattggatgcagtggatattgtatactgcttgggtgatgggtgcaccaaaatctcataaatcaccacaaaagtactcatgtaaccaaacaccacctgttccccaataacctatggaaataaaaaattgaaaataaataaaataaaatgaaagggaaatttaaataaatgttggttcatcaaagaaatggagcactatacagctgttaaagggagtaaggtagagctatatttattgacaagaatagtgcaataatagattattggttgtagaaagcaaaatgcgaaaccgcgtgcacaatcacatttgtgtgtattgcatatcattattatataaaacatatatttgcctataaacaataacaaaatatatatatgtatatatagatatgtgtacacaagcatgcttatatgtatggataaaatatctgcagaatatgtgagttagtataaacagtataaactactactagggaaataggctttccccttgtcctttataactgccttgtttgtatttttgaatggaagtcatgtctgcatatggtcgcatatcaaggagttttaatgaggttataggaacaggtagttgtttcatacatttttgtaccccaacctagccctacttctgagaaacagctttttaaatcatttgcacttctttaggtaattaataaatgacaattgtataataacttactacctatcagtagatttatcaactgtaaacatatcttccctagctgtacagccttcaaatcgatctttccctccttcagttttttcatttcaaagcgacagtcaatgtagtgcctaattgaggtactgtattaataaggttgtcatggggtttaaatgaccaaatataagtcacattcttagaaaactgctttatatatgattaatacatttggtgttttaacaatgattattttgtattataaatatgaacaactcatcattacttacttacgctacctccctgctgacagggttgatggttaagccatgacttctggtcctaccagatttctagtccttgactagtttgtaacaggacctccctcactgtaagtactatcctgcctctaagaggggtcattggcacctccatgctggcattgtctctctttcctcacatctgcttcctgcccctccaacttcttggtgcattcacagaattcccaggttcaatgtcctgcgtgcccatgacattatcttctgtatatttctggctccatcgctatcatctccgtcttcttcctccctcatttacctttgcttgtctttataatgtaaaggccacagccctcatctaataatgcccatgtagtgtatgaactctttcatttagacaaagttaaaaagaaaatatccgccatctaaaatacttctgatatcatatgtaggatattatagacacaactatatgaaattactattaaattgaaaattttaatacgtttaagctacagtaaacaaatgaaagatgctcctattttttgagtttgaactattcatgttgaagagttttggatgtatctgcatgttgttgggctaatttctcagattttctgtgcctcagttttctcatcaataaagtggtggtaataacgatgatgattatggtgatggtaacagtaaataaaacctgcctatcaaatcgtttaagcgtctgcatgctatgatagtttgtattatagttaatatgatagtaggtgttaaacaaataatacatgttgtaaagaggaggcggatgatcatggtgacggtagtggtgagcacagctatattgtttttgaacattgtagaatcttgattttagcactatttatgacagcaaaatgctcgtgttggctcatctttagtcatctgtcatgtatgttagattaaaacatagatttttcaaaatgtctgtgtaaatgatttaatattaggtacttactggagtgtgcagatagctgtgctctccagtgtgcagcctaaatacccattgggcttcatatgtaagaaatcccatacctctctgccaagggacaggttcgccttgtcttgtgtatcttatcatgggtaaagcgacctttctgttgaccatttggtgtgtgtttccagcacctgcattggggcccaggacccttactgtggctgggatgtggtaatgaagaaatgcacaagcctggaggagagcctgagcatgacgcagtgggaacagagcatctctgcgtgtccggtgagtgcccaccttctccatcctctgaaaatgctgcccatgggagccatgctcccctggcgatcctcagtcacactgtcacgctgtctgcaccttttcatatgagaaccatttttgcaaacccagtctgtgctctctcagatcactcagctcttggcttgcacagggccacgtggaatgctgttataggtttttttgtctgtttgaagagaaatgtcttcacagaaaactgtgttgatttgataatggagtttatggtttgttttattcttggatttttttttccccctccagagtttggtgtggactattttgccccttacagcgctaataaaagagaaacttccacacccacaaatttcttttgggagatataattccagaggctgacataaggaaagatgagaaaagaataaactaaaggatattactttcaccttcatgtggggccaacccgtagatcctgttcaaggtcacaggaaggtctggaagagaccgcctagtgtgcgttcccatagaggactctatggaatgaggagaaactcacctgtattgagagccagactgaatccaagaaaagcacatttcatggtttcctttgctgatatatgtgtttgggtccacatttataggaaccagtacttagaatattttttgctttttttttgtttgtttgtttttggagggtttttggcctttagaacatttcattgaatcatcttaaattctcttatgtgttctcatagaatatgaacaacagttattaacttccatataatggaaaagtcataagtcatgttgcctttacaaaactgctgatctctgcccatcagttctgctgtatctctgcaagacagaggtgtggcacattcagtgtgtgaactccttgctgtttcttccatgctttagaactgcgaaggcgttgcaacagtcagcctgtttcccaccaaagaacttaccctttctgttatctcaaccacatattcataaagcctgtccttcagcttgaaagtcggaaaaccaggccgggcacggtggctcatgcctgtaatcccagcactttgggaggccgaggcaggtggatcacaaggtcaggagatcgagaccatcctggctaacacagtgaaaccccatctctgctaaaaaatacaaaaaattagccaggcgtggtggcgggcgcctgtagtcccagctacttgggaggctgaggcaggagaatggcgtgaactcgggaggcagagcttgcagtgagccgagatcgtgccactgcactccagcctgggcgacagagcgaaactccatctcaaaaaaaaaaaaaaaaaaagaaagtcggaaaaccagaaaccagacaggatgaagcaaggaagtctggggctattcaaaccagtgtcatttcccaaatgttggcaccgaatcaaggggccttcactgtaacagtgtgtgcatcaccacatctaggctctggacagcttcctagtaggattagctgtgggtcctcatgattatttaacttcagatctattattttagtagccaatttttctgcaaaatccctttaaaatggttagaaaaatgtcattgtttgttctaaggcccttcctatttctgaaaaatactaagaacacaagggtgctcacctttcattctttgcagcttgataaaacataatgtttaatacctgaaatgtggttccaaagtacagacatacactttggaagaatcagcaaatcttcttgcagatctttgatcttgcatttttaatcataaaaaaggcacaagataatagctgtgtttcttaagtaataaggccattgtctaggacccagagttgttttagtatatatctgagagatactaattatgtaattattactatctgtaatgggagcttcccagcaggcagcttgtccccgtgggaccctcaacctagaagggctttccctctgtgctctagtgtttgtgggctggagttcatgggccagaaatacacacccacgcacttggtttataatgaatgtatgtattgtatatgtctttagtcattaaatggagagttggctgggcacagtggctcatgcctgtaaacccagcactttaggaggctgagacaggaggattgcttgaggccaagagtttgagaccagcctgggcaacatagcaaggccctgactctacagaaaagtaaaataatttaattaggcatgatggtgcatacgtgtagttccagctactctggtggctgatgtgggaggattgcttgagcctaagagtttgaggctgtggtgaaccgagatcatgccacttgtattagtctgctttcacactgctatgaagaaatacctagaccggtcatttataaggtatagagatttaattgacttacagttctgcatggctgaagaggcctcagaaaacttacaatcatggcagaaagtgaagaagaagcaagcatgcaccttcttcacaagtcagcaggagagagagttcaggagaaactcacttttaaaccatcagatcttgtgagaactccctcactatcaggaaaacagaatgggagaaaccacccccatgattcaattacctcccactaggttcctcccttgacatgtgggggttacagtttgagatgagatttaggtggggacacagagccaaagcatatcactactgcactccagcctgggcaacagaacaagacctgtctcaaaaaaaaaaaaaagaaagaaagaaaaggaaagatttaatatttcagaagtgaagagaggatggtcactaaagttgtttcctactactgagaggacctgaggtccttgttgccttctgaccttacttgagtttttaacaagtaagatcagaaggtaacaaggatctgccatggtgtcaaggctgcctcctctaccatctctgctttcaaaaataaagctgagatgtgatatctggctctcagtcagcaaaacactcattacaaggtctgcttcttctgatgacagggtatttcattacacaaaactatgtctgtcatcccacccaatgtattttatcacatatcaagatacactttagataagttaagcatatacaaagaaggcaacaaaagacaataaattatgtcattttgcacaaaacacaggaaaggaaaccatatatatttctgggttatataggctaccattttgaaaatgagaaattcatattatctaactatacatctctttctaaaaatctgtctcttagaaggagatgacctagatgtaaatgatttgcattaatatacatcagtattaacttaggtatttaaaaaaactattgaaatgtaattttcttccgtgttattttttaactgaaatggaacaagggcttaattttattgggcaaatctatcatatataatcatttctgatatgccactggttgtgatgtgtaccactgctttatatgttgctaagaaacaacaacaacaaaaaacactctcatggattgcaagatgccagtttattttagagatggtaaaatacaaaaaaaagcagagggaagtttgcaatcagtaaacactgttacctacttctacgtatatagatcatagaggtatgtatctctttccaaaggaaattaagctttataagctgagggatttttgaatgagaccaaatattttatacctcatgtaaaagtgcaagctgcataatgaaagacaggagatcctgttacattgagtgcaataagagttacaggaatattgatgatggtgagtcaacctcagaccctcttgtgtgtgaccctcccaagtaaactttcacaaaccttggatcaatgacatagcacaactgagtttcccaaagttagtgttctagtcaaacttcatgcagtggctgtgacttatggctgtcttagaccatttatgttgctacaacagaatacataaggctgagtgatttaaattggacagaaatttatttcacatcgtcttgaaggctggtaagtctaagatcaaggtaccactacttagtctggtgaggggcttcttgctgtgtcccgcctagaagaagttgggagggcaagagacagccaactttctttgtcacaactctttataagggtaccaaatccattcctgaggtaggagccctcctgacctaatcacctcttcaggattccacttcttaatagtatcacactggaaacacctgaatttggaaggagcacattcaggccatggcagtggcttaaatcctctgctatccagagagtttgaattggataagggacccccaataaatatttctagggaattagggacttaaagaagacttattttctacagagggatccctatttaaaaatgtttatgggtttctatagtacagatgacagggcaatagtttactcacatattgattaatgttctgtttgcttataaaattgtaattgaaaacattactctcagtttaagagatttgaagtgcatcagtaaaatctaaattggcatatctagactgattagaataatatatatgtcctgcataaatcataatgttgtttaacaagggtagcatagtcttaggaatctacttgagttttatttatgcatgaataccatccacaccctttgtggatacatgatgaccagggtaccatatgatgtaatgagtccctattccaaaatgcatcatgtattatagtctgcatgttcactccccacaaatatgatgttgaaatgtgatccccagtgttggagttgggacctggtgggaggtgtttaggtcatgggggcgaatctctcatgaatggctggattccctctcttcagtaatgactgcattcttgctctattgctcacatgacaggtttttttttttttttttttttttttttttttttttttttttttttttttttgagatggagtctcgctctgtcgcccaggctggagtgcagttgcgagatctcagctcattgcagcttccacctcctgggttcatgccattctcctgcctcagcctcctgagtatctgggactacaggtgcccaccaccacacccgggtaattttttgtgtttttagtagagacggggtttcaccgtgttagcctggatggtctcgatctcctgaccttttgatccacccgcctcggcctcccaaagtgctgggattacaggcgtgagccactgcgcccagctgagagttggttgttttaaagaccctagcatctctcactctctctctcaccatgtgacacatctgctcccctttcaccttctgccataattgtaagctttgtaggaccagaggcagatgccagcactatgcttcttggccagtctgcaaaactgtgaccaaaataaacctcttttcttggtaaattacccagcctcaggtattcctttacagaaatgcaaaatgagctatacatcatgtaataagtaacaaaatacaaggagcaaataaacacctagggggtctcctaataacaggattctcctcaatgccattatgtagttagggtctttagaataaaaggggactttagcagtgatcaagcccagagccctcttttagatggcagtaccatagactatagtctaaggggtttatcaaatgttccaaaactgcactgggaaagaaaccaggatttaaattcaacatttttgacattatacctaatcttcaggataatgcccttctaagctctcaacgtctttccaaagcaggggtgacacggtcatcaccaacagatgatgcttagagagtaggtgagagattatttctgaattttgtgatagaatcttaatataagagaaagaaaagagaactaaggtttacttgtatgtctggaacgtgtgctcagtgccatgtgaggcaactttcaatggattatctcatttaacgttcactgtgatccccagggatggatatttttgcttccattttataaatggaagaggtggggctcagaggtattagataactattgccccagttcacccatcctatcagaggctgcacagtgcttcagcttagttctttttggaggcactgcatttcctgtgtaactcatttgcagagataggcttagggatgatgcttagttgatatcatagcatgagacaagctttcccgaggagcatatctaacattctgttttgttacattctatggcaaaacgtacatgaaaattttaaaaaggaagatttttttttaatttttgaaaaaatatcagaatagaaaaataagacttcaattaagtcatgaaacaatagtggttggaatatagtaagaatctaaagatgaactccagggacctctgcactcaccaaatgcatctacatccttggtcagttgaaattaatgaaatggacatgaacaaatcaaatataggattgtagatggtgcttggtaacaaaattgaatcttccttagctagcacttggaaacctgctatttcctagatgaagggaaatttgctattacagagttgggggtaaaattacttgaagctaatttctttgagagtctcaccaaagaaggatctacaaattactttacagaatgaagtggttgagatcataggctctggactagcttgtttgattcttgggtcttttacaaccagagtgactttgagcaacttacttatcatatctcagcccatttcatatctgtagaatgggctgtaggtgctacagatgtgttgaagattcaaggagttaatacatgtaaagcacagtgcctggcatacacgaaactaccactacatggtatatgtctcactaaggtctaatgtttaatattaaatagtataatacacatacccctaatagaaactttcattgcagaaatctggaagatagcacaactacagataatttattctagatatgtgtctgatgtctgtttaaggaagcctaagaaaatataaaaatacctattcatatgaaaaagtaaagccacagaacttagattgttattcatggatctgctttctaggcagattcttacacgaatatactcagggtcaaaatgagcaagtgcttaaatgcaacacagagaacctgcacccaaagacccatgtacttttctaaggattgcaagtcctcattctgaaatgtagtagaaccaactacagtgatcctggattgaaaacgctgcccttaaagtcttcaactactccggccatggccagaaactgaatctcacattcttaccctgccagagtgcaattgctgtgtgttctcactgtgatttgcccaatgcagttccttttctttccagggtttggtaactgtttctgcactattttatttgcctctttcctcttcattctttcattagccatcacttatttcaagttcttcctctatttccctgtgcctttcttatgagctcctcttttgccgattcatatatttggaaagagaacatttatagcatctctttgcttaagaccctactaattcatgctaggccaaaagaaaatgaacaaagaatgtctggtgcagtggttctcaatcaggaaaaaagttgcccccaaggtcatttagcaatgtctggagacattttgggttgtcacatctgggggtgttagggcactggcatccagtgggtggaggccaggggtgtcactaaacatcctgttatgcacatggcagcccctacagcaaattatccagcccaaatgtcaatagtgccgatgtggagaaactctggggcagtggagaaaaggaagaccagtgcttcagattacatcttccaaataagtagctagggattctttgggatattatcaaattcatatgaatcttagtttaatttttctataaaaatagcataaagaaattaaatcatatagactgtatatgcctaatggtaattaaatttcctgtgaatagggcctaattaaggactattttcatcctgtggtatatcgtgaggcagcagtttcagggctgattctgctgccgaattcaggcaggacagcagatgagcaagtctttgattccctaggccttctcctcttgctcacaagatggcagtaggattgccaagtatcatattcacacataaccatgtccaaagcaggaaggaagagaaggagcagagaaagcttcctcctcttcatttgaatgaaaatagtttctagaaacctcttgcagtgtcctcttgagtctcattggccagaactgggtcacatgtcggtttctagacccagcactggcccaactgaaggggttgccatgattggcttatagcctagtcaggattcaaccctggcctcagatatgtcctgtttgaggttcagaagcatggccggtggtgccagcccaactcaccacagattcctcctccctctgctccacctcacaatggtgaggaataattcccataatgaatgcaaatcctctttttttcaaagtactttcttcataaaaatccatttaccttggctggtgtccctaccttagcctctttggaaaagtggaaattctcaggttccctccaggacaggagattattttaaggaatcacgtggactggaactctgagtgatttctgtttccgtcttcattcggttgtcaccatcatattgtacttccttctggcctcacagtcttagatatttctatcatctatatcattatgagtttaggatttccttatgacctcttagagctaaggagatcctaggaacctccctggtcatttcctttgtattttagatgagaaaatggagaccaaaggggcttggaaagctcttctttgcctcaaattctctaatttgtcccaattctgccatgtcaaatgtttctgattaatattagggggatttataaaccttcaaaaaaatcacaaatgcatctgcttcatgaaagggacatatgtgcaaataaacccccaaacacagaaggacccaagaaaccaaagagtgaggcagacaaagtcagtttgtcggtacagggtgagtttattgggaacttacagagagaaatatgctcttgggcagctgcaggacaggtagatctccatgccattattcccagggcttatgagccatagggaaagtgtatatgtgcttcagagggaatgcctaggaatttgctgaagggcactgtttgcgctaagtacatgctcttacacaaggaacaataggtaaactggaaatcttagaggcattcccagaacttgggttaatcagaagtcagcatggtggattagcatccaggatagaactgctttgacctccatagcatcccaacctgaatgacccctcacacctctggaacagcctttgcagaattagaagtgatgagagaattccagcatgactgattccaccttgcttttaacgtcgcaggctaacctgttttatgtaattttgttttacatataataacacagagaccaatgccaagataactgtgagaggaatttagtttatggttaaattttgaggcaaggaaaacttacctccctgtcctcgtattcagagattgaaactgtattcacaatggtaagggcttgacctttgctgaagaataggcatgagcaatgacctgctgacatttaacctgcttttctttaagctggttaccacagattcaggtaaccaggggtcacaagatttataacttctctaactcacccctatagataacattgcaattgtgaaacctaaagaagtggtctttgagatatttttcagatttagcacttcagctgaccaaaagctgtcctgtagtccgagaccccctctcaggaactgactcagctgcctgaaggcagtttgaacactgctgtgatttcatcaactgtttcagttccccaccccggcctgccaaagtaccctcaaaaacccctagcctctgaattctcagggagtcaggcttgaggaatttctttctgttctcctcacttgcctggccctgtaataattcagctctttttttttttttgctgtcattcctgttgttcccagtgcatttggctttctgagtggagggcaagatgaactcttggagctgttacaccttcatagagaagtgaggctaaggatgaacagatgtcccagagagcctctcaaacagtctccctccccactaactctctgcctcaagggtctgaccttcctcacatccaatgtccgatcctctttcccttgctgtcttgtgaccttgggctcaggtaatgagaggcatgggcaggaggaataagacgggtatcactcccttacccccttcaactaaggattgctccagccaccctgtcctccctcccacctgcaggcttaggatggtcacagctcccatggtggtgtctgctggggccttcagcagccctagaaggtttcttaactgggcccacactgcaaagagtcaaaatagtacagacctatatattgtgtaactatgatgcaaatattctgtctgaccaccgttattgcttgaggctggctccatgaacaagagacatgcttttgacagtcaaaacaatactagcaaggtttgcacagcaagcaggagtctggatgtgaaagcaggcgaggatgtgtaagcataggaactacgtttgctcacagtgaaagtgacctcttatccactgacacaggagtcttttggctggagacaagagggagggctgataaacaggtgaaaggagaatgttgaaaatcccaaatggtagggtctttgcctctttaacacagaatcttctgtattagtggcttgagtcacgttgtcatgcaaggcttggttctccaagaaagctctacggtcttcagagaacctcatgatcagagtaggcactgtcttttcatcttagccaatagggaggccaccgagaccttggaaatggggatattttcctcttgggtaggatccagtgtatcacttagaattgctctaacagaaaaccaagtgctgcatgttctcactcataaatgggagttgaacaatgagaacacatgggcacagggagggcaacatcacacattgggacctgttggagggtgggttgtgagggggagggagagcattaggacaaatacctaatgcatgtggagtttaaaacctaggtaatgggttgatagatgcagcaaaccaccatggcacatgtatacctatgtaacaaacttgattattttgcacatatgtcccagaacttaaagtaaaatttacaaaaagaaaagaattgctctaacagatggtgcagctccattccgtccgttttgccacagtttcttacatagatagccaggtatggaaggaaattcccaatcccatccaccttactggatagaaaatgttagagggttggttagaaaggagggatagtcataattatagcaattggatttggccaaccggtcatgtcaaaaacaacgaacacttttcatgttagttcctattgtatttgggtcaatgatgtatcaaaagtaaagtttgcctatatttttacccacaaaatatggtgtcagcattattctgaaatggcgaagtatgggtatagtttgtaacccgaagagaatgaactgtatggtacatagagttgtttcctgtgagttgtttcatgtgaggatgatgagtctttccgatggtagtggatggttctggaagagaactctggcagaggaggaggggtgcagccagctgcagagggcaaggtgaaagcatgcggttcactcatcaccaaaggtcttccttgctcagattttctcaaggatgctgaagtttccatattaatattaggaggtttggaggccgtgcatggtggctcatgcctgtaatcccagcactttgagaggccaaggagagctgatcatttgaggtcagtagttcgagaccagcctggccaacatggtgaaaccctgtctctactaaaaatataaaaattagctggtgtggtcacaggtgcctgtagtcccagctactcaggaggctgaggcatgagaatcgtttgaacctgggaggtggaggttgcagtgagccaagatcacaccactgcactccagcctgggcaacagagcgagactccatctcaaaaacaacaacaaccaaaacaggaggcttagacttaggccttcttcccattgcctttctgaggagagctctgtttgctggtttctgggcatgtgatgtaaggctgtgccccatgagtctctccttccagcagcactgccacctcctgagcagatttgcttatcagatttggcaagaagccgtcccttcttcaatgagccaggtacatgctggtgcctccgccacaccagagctggtcatgcatgtcccagcgatgccatgccctccccttgagtgccttcagaggtgccacaccagcaagctcagggggctccctgacccctccccataaggtccctgccctgggttcctcctcagtccttggtgttgctcccctgaaccaccagctcaccccacactgatggggaatgcccatgtgccctttgcatttggcagcctcattcctctgccttcatccttgccagcccttgctagcccctctacttggctctttcttcactttttaagactcaacacaggctcctcgttgctcttcccagaccttgtgagcatgttgggtgttctctcctctgctccgatagcccctgttcgtgaatccatcgtcggattctacatggagtaatagttatgtgtctagctgtttctcactggcccgtaagctcttagaagttgatcagaaaacaggtttgactgggatattcttaacaaagagaagcgctgcagctgcttaatagatactctttaaatatgttctgaattgaatgctttcagtttgagagccaaaccaagtctttaatgataaatgttactaagctttcattttttaaaggcacataaacatgcaatggggttgtgcagctgtgatttttcactccagttcctcttagttttggattttccaaattagtggacaatttgtccataacttgatgccaagtcactagtatccttcactcttcctcctcctctcttctcagccctcctcccatcattcttctccttctcctttttcttctccttcctttcctcctcctccccctcctccttttccttcttcttcttcatcttcctcttcttattttctgtctcccctttccccctgtctccctccctgcttcttcctcaccatctccagcaatcacctctgctgctttacgttgaaatactcccttatgcaatcttttttttttttttttttttttttttttttttttttgaggcggagtctcgctccttccctcaggctggagtgcagtggtgcgatctcggctcactgcaagctccacctcccgggttcacaccacaccattctcctgcctcagcctcctgagtagctgggactacaggcacccgccaccatgccaggctaattttttgtatttttagtggagacggggtttcaccgtgttagccaggatggtctcgatcttctgacctcgtgatctgcccgtctcggcctcctgaagtgctgggatgcaggcgtgaaccaccgcgcctggccctttttctaactgcagcaacaacaacaacaaattctagaggagttttgattgtcttatgagggatttttaatttttactccattatgtgttcagctttaaccttttctgacacctctgcttggttttgcttcctagaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggtgtgccgctcagaacacgccagttgtgctgctgtgtattaaactcagattctcgaggagtttgggacatcatttataatataactcccttttggagagaactgtggtgaaacaccagggacattcaccatttaaaacttacatgatttttgcaaggagattttaaactataaattggattacagatctacgcttattcacatactcttcattagattaggaaaagtatttacaatttggacaatatgattggctttgtttaaggaaaacatccatgttatttaatagtcttttcatggaatatatctacaaatagtccattaggggtaggatataataacactaggttaggaggtagaagaagccaagtccttgatcgacttgctctactccataggatattggagctcagagcacctcacctgagctaacgttaggcactgggtaatcaagagagcagtttaaataagataacctattgaatagctttcctgttgcttccgcttactgtggtggtgtttgttttatttatttattttttttacaactatattctgtttgctctccatcccctgcacctataacaccatgatcacagagaaattttaaagcaagtatcaggaacacttctgagatcagtctttatgcttctttgtcacttgttcattaatttgcagtattttttaaacatattatctgctttccatgagcccacttagaatgaaaaaaaaagtctctgggacaattgtttatgaagtcactaacagtggaaatcagattgggtgatcaaattgtaggagagcccaggtcatgcaggcacatgcacctaagaggaagtgggccaggaaagtaaagtgcaggagcaaaaggccgactttgccctctgctcacatttttctcaccaccaaggtgaaaggagcaaatcagggccacagagattagggtttttttttgttttgttttgtattacaggggacacaggcatatcaacattgcattatgtactgtatgctttctattaaatgaaatgatttccacagatgcctgggtaaaacttacaaaaactatcaaactgctgttgtttgaagattacaacaagtagctaatactctttgctcatattgtttcatggaaaaagaagattatcaaatgaattgctataacttatttatcgatctgtcttcagttcttgctctagttggaaagtcattttctaagcagagctgcaatgcaactagtagttattttaagattaaaaatctagaaagtgaactagttttaatgaggctttaaaaacgtaagtggattgctttgtactaataatcgtgaaagtgaccccctcctgatctctgtttactttatgtgacttgtttggtcactgtgtctgcctctaagcagcatttagaagtatggaaactcaggtctgggtaatagacatatacgtgtaaagctgcattcacttctttcctcagatattcttttcctattacttatatacacttttatttagttactaccctatatacaaacatgttccatatattgtaaatggaatatgtcataaaattccacatttgtggcctggcatggtcgctcacgcctgtaatctcaactctttgggaggctgaggtgggcagatcacctgaggtcgggagttcaaaaccagcctgaccaacatggagaaaacccgtctctactaaaaatacaaaattcgctgggcatggtggcacatgcctgtaatcccagctactcgggaggctgaggcaggagaatctcttgaacccagcaggcggaggttacagtgagccgagttagagccactacactccagcctggcgacagagcgagactctgtctcaaaaaaaaaaaaatcaatccacatttgctaaaagatttaaaaaatgaagagtttccaaacaaatttgaaagcaccatttgcttcatgatctaacaactttttgcacatgtaatgaaactttgcaaattaaatgtaatttatttatattaaaactgctatttaaatttttaaatataattcagtgaataacatggataatttttaagattttaggtagcagggtataagatactagctgattatctttataagaaatgtgggaagatttgtcttattgtgtgataattttggttatattattatagagcaggtttattataatatcatacataaagctattactacatattttattaaatcattaggtttcagtaaagtaggaaaacatgaaatattctaagaattttctcagaaaaatttttatttgaaattatttttaatatgatatattcaacatattatttatagcaggaccttcagtggcatagttgttgacctccatgttttaaaaggaaatacacgaagtaaaaatgagaattaatgtgagctaatattttttcataggaaatgtaaatcttatggatgaaggtgacaaatatccaaagaaatgcatatgtgattgcagaagtaaaaaaattctgcatgaagtagaccgtctatgtggaagtttggaatctggatttaatatatattttaacacataaaattttaaaaaaaaacctatgtattttttaatagcaggagcaacgtgttaagggggacacttaaattataaccagtctgaatacaagcattttaaggaaaaaatacaatactaaaacatttctagagctgtcaatagaattaaaaaaattttttaaattggttcatcctatttttattttatatttttatatatctacattactctgtatgtgtaataacataaatacacatggttagttatatgcaatttgcacttcttatttgcactctttatgtctctgtcaatctgtgaaaagatagccaataatctgaatttaaacatcctttttaaatttttaataaagtttgttttaaagctttgaatattattctaacaatacaacattttcgttttaaagctttgatagttattctaacagtacaacactctttatcaatttgatgctatcaggaaagttactgattttcattgatattaatagattttaaaagatagcattttcggcagttttagatgagcattttgtccaaaggtgcacttctcatagattataaatgatataatacaagtccaaaaaatcctaaactgtagaggtgtagggattcatttctaaatgcttttcagtgaaataaccttattctttattagtttaatattttcatgactcaagttttttgatagtttctaatatagtccattatttatggtgcacttaaaactttattctcaaatttcctatcttggctataaaccagatgcctgggggctgcagacacaggaattgagattcacagggtgcagtccattcagtcccctggctggtgttttctctcctgagcagccccaagcgtgatcctcctgaggaacacaggcatttggccgtgggtgcagacagggcttggactctgagcctgcgggacctaatgattgcattgcttcccttccctcaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaaggtacgtgcccaccctgctgccagcaccgccagcctcacgcttactctcattccggccaggtcgagttccccgcggttttagttttggatctgcctaagcttatgtgtggcatccctttccgctgagccagtcgtcctcttcttttcctggcatcctttaattttgatcaaagcctcgtcgacagcatcactgggctgctctggtgcctacacagctgggctggctccgctgagcaattgccaagggattagagtacccaggaacctctgtgctgtgctaggctcctggagactctggaagtacgtctgcaggagacttactcttgtgagaatttaaccagacagatctcaaagctccagttccaaggaggacctaagaaggtcccggatgcagacactactgggcaggtgcggtagggttttcctcagaactcagttaatcctctggaaggcatgggagggcatattcagaaataccctcaatgaagctgcagcacaacccaaattgggggctcttttccacgtgtattttgagctttcagcacatcatggcaacattttgatttagtcttggatttaacaatttgtttcttggtgtagaattagacatttggtttcaggctcaacctctgcaatcgtaatcattgaatctgttttgcaagatcattgaatctgtcttaatatgcattaaatatactattaatgtttattctaatttgtcactattgggaaagaattcaagtaggtaaatttcataatgctttcaggattcttattcagctatactaatataaacttattgaatgactttcagtgcattttaattaaaatgtagcaggtttatatttgatgacatgagctcactggaacctcgaataaaaatactgtatatagttatttgctatgcatttagtatttatacgaacagaaccaacagacttactgtttagatagctctctattaggtatttactacaacctaaaatcaactaaggagaatcattcctttttttcttcaagtgtgttcctcacttgccaattaagatttcactccttttgactaacaggaaatgaagatgatttttaccaagcagggtgtgtcattttttaagcagtccctgagacagtcttgtgcaagccctgtcattttctaacaccagttgataagtgggaaagcctattatggaagaattgtctccctattatttccaagccttgtacaattttaaattggttggaagtttttaaatgctatgaattgtcacctaggacaggttgaacattcctaatctgaaaatctgaaacccaatatgcttcaaaatccaaaacttttctagcagtgacatgatgccacaagtggaaatttccacacggttttttgacttttgccgtcaaaatgcagtcaaaactttgttttatgcaaaaaattatttaaaatatataaaactacatccagcctttgtgtatatggtatatttgatgtgtgaatgaatgaattttgtatttagacttgggtcctatccccaagatatctcattatatatacaccaatattccaaaatctgaaacaatgtgaaatccaaaacactaatggtcctgaacatttcagctaagggatgctcaacctgtatagcccatccaggcaaagtcacttccatctgtacaaaggcttccctagagtcaaggcaccaccacaaacttagcatgtgttatcaccattcccaggctgatcacacaggaaggaagaggctgattaacactgtggctaacatatgcgtacgtttgcatccacataggatttttcatacagcggtgtcttcaggaaaagatacagcggtgtcttcaataaagatgacaagtgtgtttgagggacttatatgtaaaatattccttttgtaaagaagaaatgttcatttgtagattagcatttgctcaatggaggaaaacgtgaaattaaataatagatggatagtaagaacagggactatgtaaaatttttatagaatttaagcttttctattgaatagtctttctagggggctactgggagattaatgaaaaccagaaaaaccaagtacctaaagtttcctctgtggtcttcataagcaataggttcttagatgtctctgccatgttatatgaaaggtctcttcacctaagaaatataaaagcattctgattccaacaatgcagatgtttgaggactaagctcaagattgaaggagactatgatctccatgggagaatacaaaagactaagaactaggcatacaaaataattgatacatgtatatcatatttatttaaacaccatcaaccctcaagaaatcctgggtagccacaagataatgaattgatcttcccaaaagattccctaagttaatggtaggtttatagttagtgatttttcatctgggacatctccagtgtgtggaattattcaatgggagctttgttgcaacaaaaatctcagaagtatttacataatttttttttctgaaaaataactctagcttaatttttacatgtactttaaaatgtatagacagtttctttttctcttctgacatttccttgaaaagattttctggagtagcaggaactgagtagaagcaccaactcccagagaggctactaacaaaaggaagaaatggacgtctgcaaatattatcaagatgcaaatgttattatctgtgctagtttcctcctgctgtgtagtggtagttccataaactttgtggctcaaaacaacacacgtttctttttgaaatttcatagtcccagtgggtcaggaattcctatatggcttagctagatcctctgcttggggcctcagcaggcttcaatcaaaacatgggccagaactgtggtctcatctgaggctccactggggaaggatgcacttccaagatcatgtggtagttgtttgtattcagttctttgtgggctgtcaaactgcagacctcaattccttacatagttgttatttagagaccactctcagtttcttgccaagcgatccttcctggtgttgtcacttgccttttaaaatccagcaggaaagacagtctccttgcaagatgggcattacaaacttatgtaacataatcacaaaagtgacatctcacccctttgccatattctgttgtttggaagtaagacacaggcctccacaacctagaggaggtgatgacacagggtatgaatatcaggaggcagagctcactagggccaccatagagtctatctgccagagttgattctctgttccccagtcattcacatccctacccctcacatgctgaatgcatttcacccactttcaaggtccctcagtcttatcccattaagccatctccccaaagtccagaaccttattatttacatcaggcccacatgtggaagaggctgtctgggtgtagttcccatcagtctgttaatctctaaagccaaagggagaagttatctgccactaacaaacttggagagtcaggcaaaggataacagctttagacatttctgttcaaaaaggcagtaggtgggtggagtgatggaaattatgaaggaatcactgttccatataaattctgaaatctagctgagcaagtgtttggagttgcttaattaagttcagggagtgggcataatgttttatggttcttggctctgccttctggactcttagttatgcttcctgagtcaggctttctttttcttgaagagagcacgtgcttgtagctaggtagttttatcagcttccttcctgtcagtagaatgtgcagggtttccagcagcctttcatgtgtattttctctgtccctttccatccaagctgctggtatcattgtggaaataagtttcttaaaaacattatgggccttcaatggatttctacaaggttactccactaaacaaaagctacattcacagacctttttgagttagctcttctctaccttggggtgctgctgagatggctgagagacaacaccctccagctcactagaggtgatctgatgcagttgagaggatctgtgaggcacacacttgctctagaaaggactctttgtgtaactaaatactactccaattctttcatctttctgaggttacaataaaaggttttacagtcactacatcagcttttactgtattccaaccttccctaacagtacttgaaaggactgtgaaagctatttcatattttttgcatcttttgccattaaaagtgactgatttccaaaatcatccagttcctgttcttttagtttaataatccattcctcagtctttcttcacctacatttcactgtaagcagcatgaagagaccaagcagcaccttcaacactttgtttggaaatttccttagctatgtaattcaacttatgtgttttgcctttcatattaacaaaggtagcagttttggcagttttcacccattgtgtaatgcagttctccctttttccagttcctgataatatattcctgtttactttttaagtttttactgtgcttttacacacacacacacaaaaaaaacataaatttgccacttaatcatttataagtgtgtaattcagtgacattattgacattcacattattgtataaccgtaactactatttccaaaacttttcattgccccaaacataaactctgtaattgttaagcaataataactattccttattccaccctcctcccaacccctgataacctctaatttatgttctgtctctactaatttgcctattatagatatgtcacataagtggaatcctacagtagttgccattttgtgtctggcttgtttcacttagcataatgttcaaggttcttccatgttgtagcatgtgtcagaacttcattccttttgtaaggctgaataagattcagttgtatggctataccacattttgtttatccattattttcatcagtggacacttggtatattttcaatattttgactattgtcaatgctgtactgaatattggcatatgagtatccatttaagtccctgttttaacttttttgtgtatactgtatatctaggagtgaaattgctgcattggatgttaattctatgtttatctttttgaggaaacaccatgctgctttctaaagagacttcaccaatgttctttcccaacagcaacgcatgagagttccaatttctctgcattcttcttatttacttttgtttttccttaattttatccatcctagtaggtatgaactggtatctcattgtggttttgatttgaatttccttagtgactaatattgttgagcatcttctcatgtgcttagtggacattagtgtatcttatttatagaaatgtctattcaaatattttgcctgtttttctaattgtgtttttgtctttttcaataactaatttatttttgatgaaatttgtaaatatttatcatgtacaaaatgttgtttaaaatatgcatacattgtggatggctaaattgaaccaattggcacatgcatcacgtcacaaatttttcttttttgtgtgtgtggtgggaagaccatctgttttgatgttcagttttagttctttatcccattttcctctaaacccttactggccatgtcctttaagtccagatttctactaatggatggttcaaggtgatttagattttctttaatgtgctcctcaaaattattctgcttcctgccattccgtggtctcaaagccactttcacattccaacctcttacagtagcactgcactcccatgtaccacggtctgttaatagttgttatataataacattaccacagatttaggcatttaaagcaccaggtgtttatttgctcatggtgtctatgagttttttaatctgggcacagcttcaggttctcacaaggctgaaatcaacatagaggccctagctgtgatgtcatcagggctcagctagagaaagacctgcctccaagatcatgtggttgttggcagccttcatttccttgtgggatgtcagactgagggcctcagtttcttgctggctgttagccagaggctgccctcaattccttgacaactgggtccttctcacctttttgcttgcttcctcaaagccaacaagggagaaagttctcttgaaattagggtattacaatctatgtaacataatgacagaagtgacattccaaaatctttcacatattctgttggttagaagccagtgacaggtcccattcatattcaataggaggagattacgcaaggtgtgaattctaggagctggggatcacggggaacatgttagagcctgtccaatgcattctcaaagttaagagtcccagggctcaatggtttttattaagtgattatttgtcttcatcagtatgtttgctgaatcctgtggtgagccaaactgatgttcttcacaagttatttttcttcctaaatggcttgaattaaatattatggtagacttaatgtacgtgcagtttccctgttgccataaaaatttatagcagtatggcccagtagagggctgatcatttagagtgaagcaagaagaaaatagttcagaagaggccctgattggttcaggttaacagagattgcagtgagcaactagcatggatctaaccagaatggaacataatttatgcattttataatttataatagaaagaacactttattgcatgatatagtgctgagaatctagtccatatggaattataaaaggtctttattttcataagagactagatttgtgaaaaaaagtggataatttatagagaaacagtgctaggtcattaattgacttttaaatacaaaatgagaataagcagtcatgggcaaaattaaaatcttaattattaacacatcatgaggtacatctgtgacttgcaatgctttaacacagtagagacactcaagagccaatagcatttgaaaaacattgtagctcattctttgctaaaagtctgcagtgtgttggggactagagaaaggggaccaactgctggcccattgtgtagatattttatccacaattaattttaaaacccttaaccagcagataccaaagtaactgacttccaacctcattgttttttgtatagcttcataagaggggcttctctcaggggcatgagttagttgggctgggggcagggagagggtcagaggaaaacactttctcacaattgtgtaggatccatacttacaggcttccaagcactttgtctctgaacagtctcttccagggtgaattcctaagtgaaaacccagacacaaagagacagagttagcctagtaatttctatttccctctgacctctctcaatggggaggctgcaatttcagagggtgacacgccagcagatcctggtgtggcttgtttcatggactactataggagaaagagaaaaaaacaaggcaggttattgacaaccttaaaatgcagctcagtagacaatttattaacactggctgaaagttccatgcacgggttaccctgcggtagatttttacaataataacatgctgagcattttcaggagtggcctgctgtcagcaaataacagaaaggatttgtgtgctatggtttattttgctttggggaaatggtagctcagttgctgtgctttttattaaaagtcaggggttttataaacatttttggtaaggtttccctctgccttccatacccatttttttgttgttgtttttaggagaggggttgttgaaagctgaaattaggatcaagttttctaacaagtccatgccttttaaatgctggtgaatcagcttagaaatggagatagcctacttctccttctacccacagtgagctacacatagatattttaactaaatgctgagagttctgatattctgagttttcttgacttcctcaaaatatgttctcaaaacaagtgtcaattttctcctggaatactccatgaaccaacacacatattaattttacttattggaactcgacacatttgcacgtacttcctaagatcaaattcttttcatctgttgtattctcaaatttgtcttgtctctcctatctagaggccatgatctcttaattagaaggtcctttcccttcccctactacgtgtaggaatgtccagtggccctgagctctgagaataggaccctgggagactatagttaccacctaaagaggaaaaccttacgtttctgtgttatcttaaatgtggaaaagatgaggaagagtgataactgttcagttccattggctacgctcaaatgtgtaagtttagacaaactaaactgcttgcccagttggttcttgactctccggaggctccttcaccccctacacatcaactatctctccctggaagtaagagtgtcttctgccttccactttcagttaagaggctgactttggactccactgtttttgttttgttttctatacagtcacacagttgccatattgtactttcactataccaagctccatctccaccacttcttctccttctttccaacaccatcgccgttttctaggttggagtatctctcatttgaattgttgcaatccagcgtcctctagttgctgtttgttctatgggctcttcctgctgctaaactgccctgtctggggagatgcagaccccatactgaaatatgaggagctcctcgaatctcaggggctccagagaatagtcaagatgaagcaccaactcctggagatgagtctgccatctaactctcatggagttattttgtctctggagctctgtggaagtttcctgatttctcataaagttccagttttccactgtatttggtaaagatagatcatcccactccctgttgcctttttatgttttgttcttctcaatgatctttcgtgctttactctttccatttctaccttccattattttccaaaatgctgacaggggttcagtgtgcctcatcccgtcagcacccctcagcttggccttgctttctacttttcacattgtccctgttcctgaagcccacacattccccatgaaatttttctggtttgacaggaaaacagttccatcttaccagcattcactgtcaggaaactacactctccaagtttcttttcctggtggctggctaccatttgcccctattttcagttccagaaaagcatttacttctgcataaataattacagtaatgccactgtgtattaagatagttttgcacatcctgagctgtgtccatgtccctgtgtttattttcgactgtgaatacctgtgatcaggaagccttctgcaattcctgttgcataggccctgcaggattaagcctttattaatattgatgacaataaaggtgactgacttacaccagcagatgggaacctttgcctcttgtttcttaaggcagatagcctagcaagagaggagggcatgagaaaaagttgtgcattctagtattctctagaaggtaaatttgggaatttgggcttcttagatggactatgaatcaccgagtgtgtctcactacatttggtgctgttcagactaacctcttcctttctatgagctgtaacctgtagaatgccaggctgtttcctttttgttttttgtttgtttactttcctcacttcacttcatttcacttgcagtgttaaaaattgaagagaaggctgggcgcggtggctcacgcctgtaatcccagcactttgggaggccgaggcgggcggatcacgaggtcaggagattgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcacgccactgcactccagcctgggcgacagagcgagactccgtctcaaaaaaaaaaaaaaaaaaaaaaaaaaaaaattgaagagaaataatatgactcatgataaggataaaggaggctttggatatttggctgacatttggaaaaatatgtagaagtatagaagtatattcaaacactgaaaaatagaactaatatttgtaaaattgtataatcaattctttttgaataacgagtggtcttttaaattgtttggcattcttctgagagcctacaaataaatttaaaagtagaatagcttaagcagtatataacttgggccttcatgctaatcccatgctctaacttttctttaacttatcctaatataactatgggcttatttgattcaagaatgagaaaggaattccaagtaaagctatgctgactttgtatctgtaatctgctttatctttcaatgtttatgttcacaagataaatgccctacctagatattttctgtatactcttatttttgggtgtctgtttgaagggttttgtttgtttttcctttaattggctgcacaggaagatccatcctgcattgtgagtttagcattttcttcattgtctgccatgcatcccattgtctgtgcacacacagcatggccagcaccacatctgccttctgtatggtgcaactgctcaaaatacaaaaagctcctccacgcagagcatgcccatgtgttcaacatctggtgcagggatggagatggaaacgtcagtggtttcaagtggcactaattagtttccttgtcattttggtttcctcattacagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggtgagtagccttcttctcacacccagcccacaatccagaaccaggaatacagactcaatacacacaaaattctctgcacacactagatgttctgcaaacaataaatgttctgcacacactagaggctctgcacaaatttggtacactgcaaacactaaatggtctcacacactaggtgctctgtacattctagaagctctgcaaacaccttatgctctccagatactaaatgctctataaatatgacatgtccagacactggatgttccccatacaatagatgctctggaggtaccaggtcctctcacacactggatcttctgcaaacatgagattcttggcagacactagatgttctgcaaccactgagtgctctgtaaacacaacatggtcaagtactcgattctctacacacactagatgctgcaaatcatgcaagtttttcaatttaattagaatatctggagaaaatacttgaaattcagagtatcctggaggcttcgtgaattaagtattcacatatgggataaactgtcccaggagtttttctgttctgatttctgagtcacaaagccttcagcctgcttatatatggctactctattcggtttgggacacggaataatatccccatatcaggcctacaccaaggtatagaacattgtgggatgaaccggacacaccctggggactgagaaactatatggagccattgttagagtaagctggtgccaatgcagagaggataaaagagaatgcatgtttttttttttctcctgcctttacaggttatatttcttttaacactttaaactgtcaaataaaattcctcttggacaagctcttttcaaaagacttgcttttgctgttcctgcttcttctgtaagagtaacagcatttccccttactcacctgcctctggtgctggctgcacagagtggacacagacagtggcaaaggtttgatggagaagctcagcacgagaaggtctggctaaattgcttcctcactgatctttccagttggcctttgcagcatctttatcctttggtttgtgaggctgagcaatgcttttgtgctgctgtaaagcctgcttttgtgacatgcaaaaaccacacagccgagatatccttgggaaattctcagaaaggaagagggatatgaggttctttgtcagatattacaccagacccaaggagatttctgttattggaaattacaattagatttcttccccttcacaatggaaaagatactgtcgtagctctcatatagtctagtactgattataaagacacttctttccagatcagcctgaactaactgtagaccatgaaaaatcttcattacgatgtatatttattgatatttcagatgctgacatttaaaactatttattttaaataattttaaaatgacaaatttatgaacactcacatgttctaggaaaaccattcaaatgggataactttgtattttgctgaagaatgtcatgttttgttcctggtggcatgatgtgtgccccctgaggtctgcattgccatgtcaaggtttgtctcatttgctgggaaaccacaggaatggatgatctgggttgatctcacaccctagtttctaaatacattgcagtgtgaaaaattcagagaacagtccacatcattaattttctcattgttcattgacttttataattaccttcaaatatagcttaatgaataaaaaaattatattaagcaataatgtagcatttttatgtagttcctatgtgtgtatgtgtgacatccatctgatgataaatgtaaaaattgaaggtctttctaaaatatcaatgtatttattgctttatttattatagaattacagtttatgaaacaaatgtaaccactgctttcaaatccagaataacacatatgtctccaaagagactattgtcactttttgggaaatttaaaggtttgtttttctttttgtttgtaccaccaaacttagccttttggtagtctacttctaggaaggtgttattgcggcaatgaggagcaatccacttctcagtggtaggagtatatttttcttctgacgtgtcttctcccatgcattttggtttctgtctgtcctaaggcaggaatgccagctcacactaattgaggaatgcaaacagtagaaaggaagggctcggtttctttggattgtttggaagatctatactatcagttgaattcctaagaagttgatttaaaaatgatagttacctagctaaagcaacatttttggtcttcatattctagctgcagttcgtaaatctttgtccacaaagggttcggtttttattgagttctattatcaagatagtagctgtaagtataaaaaaagtattgatttttgagacatgaagtgaccagtgtgtgtggctggataacaagaggtgacatttctgagtctcagtgtcatccttggagaaggcggtgatggtttttcctactgagagctcctgtatcaaggagggtgccatccgtaaggtctggcaggtctcacgtttgagtgctccttcctagtctcatttctttaattgttatccatgggcttcagctgcttctctgagttccagcttattaaaaatgggagtcagctaatgaaatgtcatttatataatacagaatatgtttgtggaaagtataaaaacctcaatttcctgattattatagcagtttatgaaaaagaaagaattgattatttcaagttcaagtatgcatcggttagaaaagactcaagaatctctgcttctgccaacactttaaagctgaaatttcatgaaaggattttcccagcttcacttgtgaaatttctacatccttgtcttagactaagtcaccaagcctttatttgaatctcaataaagaggcagtgaaggacccttgccaagagctattagttctctccatgaatccctactcgtaaattgctcaatgtcaaaagcttgggaaacccagagccttggattagttcggggagctgattgacagacacagagggaggacctggatcttgtgctgtcacttaactctgtgaacttgagatgcattcactgccctctgggcttctgtcttgctctgcaaagtgcagggccagaccctgaaattgatgattctgtgaccctggcattccttctctggaccctggggcacatgtgtccagctgattgagggaccacttctagcaaatgtccctccctggtggctcatagctccagtgagctcagaatgagacacttaaaacacagatgtttactccccacttccaagtaggctaaacccacaggagcatctggggtcctctggtccttggtgctgctctccaggtctgcatgtcagccctgcatgcctgtggcttcacagagcgggtggaaggagcagggtggtgggtcagaggggctctgcctctgagtcactgtgagatttgacctgctgttctacttctccacatggttgttttcaaatgaaatatgaagcatgaacacttgaatgacagagctgtttagaggattacatatagtacctaatatttctatatatcctagcccagtgccaagtctaacatagacatttataaaatagaaatgattgtcactgtcatatgtgtgtttccttttaaccctattttgacaatagtaactgtaacaattgttgttggatgaagacttgcaaatcccaacttactaggtgatgtcaaattaaatattgaaattaagttataactacacatactggagttaatatttaatgattgcctgaaatcctgtattacatcataaaataacttttgttgagtgcctactacatgccatgcactgcactaagagtaattaaaatttattatgtttattctctctgtatccctgcaaggcagttttcattattacctctgcttggagatggaaaaaaaatcagcctgagaaagattaatgaacttgcccagtagcaagttgccagtgggggactggaccagcatttgagaactggtcctctgggcacaaatagaatttaatgacacaactccatttgtataatttatttgcccaatgttaagtgataaatgataagccttactttactcctatttaggttgaagtgtagcttaaaagaaggaggagctttttgtctttctatagctcttctcttgatttacactcttgatttttataatattgtgatcatttcagccaaccataagagtactattaggagatcatcatgagcataggaattaatcgaagataaactcgtaacacaaatcttaactctacattttggctgaaaattacaacacatgaaaggaagaaagatataaaatgttatgttgtatacatagaattacttcttaaattaatgcaactcaaaatttcctcaaaggtttagcagatttaccttattttttgctgtatcagagccaaagacagcgtcagatacagcaaaaataatttacaaagaacagcagacttagtatttggcagcactatatttcttactgaaatatcatgtaaagcgtgaaacaattgaccacaagctatgatttaagagagcaacagggagcacaggggagatatttatttcctagatacaaaagaaccagaccacagaaagcctggaaaggtcaagaagaaagacattataatcaatacatgctgtcaaaagggattctgcgagggtcagtcagagttgatataacacactaacatttgtttgtgtcaaataatggcacaatggataatcttcagagcaaatgaaacgtggccattggaagtttaaataggttgtgacacatgaaaataatgacaggcattacaaaatatcacatttttgtgtagcacattagggtctgcagaatgctttggggaaggtcgtctcgtgttttcctgattttccaaatgagaaaatcgagacctgtagaaaaccagttaggtacccaaaaaccctgcaactggagacagcaagacccccggtccaggtctttccactcagaggtcctgagacaatccagggtgctgtgtctccctcagcaagtatacgaacaagaacagtgagattaatgggaaagatctaatatctcatacccatgaaagtagaccattcaaaagccccaaacaggtatattttgtatttgtttagctccagtcgtatttctcaacagtctcagctgtgtttgcctctggccagtgatgtatgtgtaagcccaattttaaacaacctcactaatacaacaaaaactatttgaggctcacattttactcaagttttaaaaagtaggagctgcatatagcctcatctgcctaatattactgctctgattcagaattagagttctgaatccatgttcaggatttttctacaaaccactgcttattgtaaatattttcgtataaattttaataattgtattgttcttaatttggtgatatttaaagcatactgtagatgatttttgtagttttatttcaagaaatgttttaatttcaacttctgacaatgctgttttagtaagtataaataatttaatgatataaatactatatttttcaggatacatttcataaaacattttctgagcatccttgtgaatgctcttgtaagactctatatccttataagactctaatagaattttgatttctgggacaattttatctgtaagtttcctatttggctggtatcaggtgagcagcatcttcgtgttccatggacaatgtattcctgtgggttttagaaatactcatttcctgtcttcctagacttcaaaaaagtatctctagttccccatttaatttttagtactaaaatattttcaagagcatagcaacctccttgcaatggtgtgtacttttattcaaatgggacagctggcacttcctttcatcataaaatatagaggagaggtagcctgagagagattgacagttttacaattgaacagtctgttttaaaattggctgcttgcttgtttgtaatcgttagttccctttgtattcatatttggtgtttcctcatttttgaaccgtggctttctagagattcatagtcctgccttagatggcaggtgggttgttatgaagagatatatgaaaagttttcttcttattcacttatttttgtttatttggttatgtttgggcaatgtcaccccaatatatgctaagctgtggatacttgaacattggcagctcacactgaattatttgtgtttgttaaagggttgttattttacattggacgtagacccatttccaagtttatttgctgcccttaataatacccttgaaacctcacagatgcagaccctatatgaatagtaagctattcatataggctactattgaatagggtactaatgcagaccctatatgaatagtaggctatttgtatggcttacttattgatgtgtctggaagctgttcttactttaacaagccggtggacctggattagatacaactaagtttatccattgctcatgaaaataccattttataatcctagaaaggaaattttctaaaataaagtttaagaaatacataaaatagttgactctaactccactgaaaacatacagaatttttatagataaaaataatattcttcatcaccatcatcatcatctgtcattataattgctacatgccaggtattgtttaaagtgcttcttagggaatgagtgaggaattcctcccaataatccaatgaagtagtattgttgttagtgtaaccaacttatagatgtagaaattggagcaaagaagcgagatggtccaggttgtaggaaggttgccagcctcaaagccagacatttataatggtggcctgcttgtttcccccactacactgtgtggcctcatctaatatttgataagtaattgaaaaggttaaggactgtagttttcataagattaacttaaacaccaatgagcttatagaagtttgttgtatctagctaaatatgacctatatgagattcgataaagtgaatggttctaactaaaaaccgaaaacagttaagcacttattgagataatccctggtggcttcagactgtgcatgtaactgagggtccagaagaatgcaagaaaccttgggaaagccccagatatctagatgcatctgagaagtgatgcccatctttctccttttttttcactttctcctccaaaggcaatgcatacagttgtgcaggttgtgcactgcagaattccaaagggagtattaaacattatggagatgtgagtagcacttctgaaaaagggcagcacatcctggctgccaccctagccctgaactgagtgcataaaaactcagtgtgttcttcaaagcctccgagacatgtaggatcccaaccattattttggactattttcttcatcatgggaataggagctgagagtgaaaattctggcatcatagcttggcccctgtttaaagtagattttgagacaagacaggggtttagggcaggtggttttttatatgtcgacagcagcaggtggagaggatgacagggtgaggcaggaaagagggaaaagctcctattagggtttgtcaccaaggtcactgctaagggcagcagaactgattttctgagaagcctgtaaatgcctctcgggagtgtgtcaccttcccagctaccattggttgaggatgcacccaggctgcactttcactaacccagcagtctcctggggcttcagagaagactcccaacatggaaagccacaggaagggaagtgtgtgccccaggtggatgtgtctggcaaagaactgaccaccattttgcccgcagctgggaccacaggaggctgaggggctgtgcggccccaaaagcacatctacacctggctttgtgaaaacaaatcctgaccatagtagaatggaccaataagaacaggatttctgaggctgcagtccaataattggggttaaacacaatctggagccctcctgccttacaggtcccatggactggtgagaacttcccagtcatcgcatagccatggatacccattattaggccagatggcactccactttctgccaggcatatttatttagcacacggcttctccattgtgtggaccaattcttgcctgggacacatgaaagaaaagtcatttttctggaaaggttctctcttctccatagagagagatacaggacaggaaggccctttctttctctgcacacagagtgtcgagagtgaagctggagctgctgcccactagctggcagccttgagagtagctaggtcagggaggaggaggacaggagcaaagcagggagacagagctaaggacaccaaggggctcatctccccaaaatccaccttgttgggcacagcctgatgtgtgaaatcaaaagctctggtggcttcagctagtctgagtcaaaatcattctaactgctttgtatttcccctcccctttgtggaagctacccttcaaataccgttcagtagctgatggggaaagacatgtccctccttaataattgctgtatctgatggagatgatctaggattttcaagtgacccatttccatgaaagctaaagacatgaccttgacctttatgaagaaggttgcaacctgaactcttccattgcattgtggttgtaaaatccattcacttatatttcccaatattcttccgtaaagggaataattgatctcccttgctgaaactggatattatatcttcacaaacactggaatgcaaagtttgttttcttttttttaataaaatatctcagtgaagagcttgcaaatatgaaagattgtcaaagtgaaaatgccacatgttgttaaaggatgcttaagctttttgagaaagttaatatcagtacacaaaattgagtggtacagcagatggccacaaaagtataagttttctaaaatttggcactgaaagtttcgcaatcaagcttaagaatgatgtatggcacagatggagagaaaagaaaaatgatggattataggaattaatccatcaagagtctgcctctaggacatataaataatcatctacaatctctggaaattgcaattggtatggagatctggaatatttcacaaaaatgttttatttataatgttggaagactctgttgtacatttctatagtttttaaaaattttttatgcctacaataattcaaatacagtgattgcaaagttaattgaaagaagttttcatgaagagatttcctactgtaaaagtgacttaaattgtacacacacacacatttttcctttataactttccaataaattccatgataaagattattcaatacttgatattaaaatacctagaacttatatgtggagacacaataatagtatttcaattgtaataatttctactaaatggccacaatttaaaaaatattttataggcctacacgagtaggcagtacatgcagaacaaacagattctgttaaaggcatagcaaatgctcagtcagatggaacccatgtctctggttttttaaatgtcagattttttaactgttaaaaatgagtaattaagagtgactctctagatttaaagtcttaatagaagtttatttaaaaacaatcagacaatattcttttccaaatgcatcttccgtcattgattgtagtgctgctgacggatttgagctaatcaattgattatccataaagaacactcactgggctttttagtcaattaaatgttcccttcaaattggacacatgtttttggtcaatttctgtagctcaccttgtctacttctgattctaccgagcacttgctactgaaattaaaagacagtagtctcctggagtagtgttgcttgttcattttatttatttatttatttatttatttatttatttatttattgagacagagtctcactctgttgcctggagtgcagtggcatgatctcagttcactgcaacctctgcctcccatgttcaagtgattcttctgcctcagcctcccgagtaactggattacaggcacttgataccacagtcagctaatttttatgtttttagtagagacggggtttcaccatgttggccaggctggtcttaaactcccgacctcaagtgacccacctgtttcagcctcccaaagtgctgggattatagccatgagccaccacactcagcccttattttttaaaaagagatttggctatccagccaacttaagtgatgtactgatgttgtccctcttaccaacagccaagtactccctttttgtgttgtgcaacttgtagcatcaaggctgggctcttgtattcatttgcatctttgtatagctcattctaccttttaaagtcctatttcagtccatcaccttgttgtacaggctgggccatggttccaggagacattccatgccatatggcacttgggccatgactgagtgagagtaacactctccccaccccaggatcccaatctgaaacctgtgggtctaattgatattagctctgctcattcaatgtacagaaaaggtggagatcacctgagacattacccattgtaggttccatattgcagaggccagcatattgcctctcagcagactcatttccaatacctttctaaaatgaagtaagtagagaattgaacaaaaagcttcagagacatacatctgctcaaaagatattgtcatctccttaattgactatgctgcttatggcgtggtcttcatttggtttgttcaggttcaaatccctgcatacatcatagtattaagagaggtttacctgagctcacactctgtacctagaatctgagcattttggttttttacccatttttattccaccatttatttaataaagaataagcttctaccctgtgatggactctggggataccagtgtaaataagggaagtgtggtctctacttaaacctggggcagtattactacttgtgaggcttaaatcaaaatgctctgggtacctgtcttttatttacattgttttggtgtgttgatgctactgttcacagtatgctttttcccccctctttttaaagtaaattttatcgtgtatatttaagatatacagcatgatggtaaaaggtacatatagtcatatgattactatagtggaacaaattaatatatccaccttctctcatagttactcgtttttcctctctatgatgaaaagtctactgttttttcatcatagagagtacctgtcctaacaggcgtaaggtgacatctcatagtggttttgatttgtgttttcctgatgaccagtgatgttgagcagcttttcatgtaccttttggctatttttatgtctttggagaaatttcttttcaagtcccttgacatttcttaattgggtcatatatattttttttatcatgttgtatgagttctttatataccttggatattaatcccttatctgatgtatactttgcaaatatttttcccaacatgtaggttgccatttcatttggaaacagcttaagtgtccatcaatagatgaatggataaagaagctgtgggacacacacacacacacacacacacacacacacacacacacagtggaatattatacagccttaaaaatgagatcctgtgatttgtcacagcatggatggatgtggcacacattatgctaaataaaataaaccaaacaaagaaagagaaatagtgcattatctcacttagatgtgaaatataaaaaacaaaaggtctcatatatggagagagaaaataaaacagtggttgttaggttggcaggagagtgcagggggaatgaggagatataggtcaaataacacaaagtagcaaatatgtagaatgaacaccttgaaagacctaacgtataacattaggactatagttaatgatggtgtgttgtattcagaaatttgctacatgagtacacctgttaggacaggtactataaaaaagacaggagataacaagtgctggtgagggtgtaaagaatgtagattgtactctgttggtggagatgtaggccggtacagccagtatggaaaacagtgtggagattccttagaaaattaaaaatagaattaccataggaccctactagccgtcttctgggcatatacccaaaggaaattaaatcactacctcgtaaagcacctgctttcccatgttcactgtagcattatttgcaatacgcaatataatcttaataccaatgttcaatgaacaagaatgaggcatgctataggaacagttcacatgtttatacaaatgcagccagagactttcaaaatatgttttgattgcattatactcgtttggtttgcctcatggcaaaccatgcttcctttggtagaagtgacagaaatgcttaattatatcaacaatatgttttaatttgtgttttgcttaagatttgcagtttccatttttaaattatttcatcggagtgcctccaatggtattactgagcatgtgtcatttcagttgttaaaacaacttgcacacataataatttttgaggcaacttgtaattaaagaagaaacaacaggtgttggagtgtgaaaaattatttcaaaacattgactattttttatagattccattgtttctttcttcccaaacactatccctttagtaatcctaaaagtttttaagaactggagcctagttcagatctcttctacgtgaatgtgagaaagggcacaacagcggctactatatttttatttttaatttttttatgatactttaagttctggggtacatgtgctgaatgtgcaggtttgttacataggtatacacgtgccatggtggtttgctgcacccatcaacccatcatctacattaggtgttcctcctaatgctatcccttcccagccccagacccccaccgacaggcctcagtgtgtgatgttcccctccccatgtccatgtgttctcactgttcaactctcacttatgagtgagaacatgtagtgtttggttttctgtttttgtgttagtttgttaatatttctaaagaggaatacaaggttatatttagaagccttcaaaatatgtcaatataagtaaataaatagctggttttctctgtggcctgatagtgtgccacagtaactgtcatttctgaacacttgtcccttcatttccctccatggcatatttttttttcaagatctatttgacttgcagaatctcgtgaggttctactgtggaaggaagagttgcaaagaacactcttcacattccatgtcacattcctacagtattttataagccgtgctgcatgagaaagtaacatcccacacactattatttggcatcttgcttctatcatgatgtaaagtgttttccacatctgtttcagtctatcctaatcccacgaaattgccctatttgagattattagaaagcaatcctcgaaggacctctaatgtcattgtgtgagaaaaatgacagtgactgaaagaaggactgtgaaatctgtcttataaaattattcgggctccgcacataaagtcagaagctctggaacaataagcctctcaaactcaaaagagagagatacaaaatggcagaggcagacagatggaatccagacatttagaggagcctctgacatttgctgggcagttttcattatgaagctcatttaattggtttatttctcttatcttcttgcaactgctaatagctttcagtaataaggccttgacgtctgaaactgaagaggaagaaagaaactctgcctgttacatgcatcatctttgatcattaatttctctaatgcttggtgtgatctcacatgatactgttcatttgaaataattttgcatgtggaagaaaagaaaattctcaatgacttcaatgactgattcatgtctgtggtactatactttgcagaattttcagatctttcatctatgtatttagtcaatgaaaacatgttgactacatactgtgtgtaaagaattggtgcaagggaacccatgtagatggatacagtaaactttctcaaggagcctcctttctggcttaggagaaaaaaacataattcaaattgctaaataataacgaagtaataaatgccatcagagcaattatgagagaacactgagtggaacatgaggaggaggaagtgagggtcaagggcaccaacaggtgtggagggtcaagggcaccaacaggtgtgggcaggactcggccaagttaagaggaggagcttccctgaaagtctctgtgtgcaggctgtgaacccaaggacatgggattcacacctaacactggaagcacagtcacttgtgggctacaggatgtgtacagggatgcggcaagggacagatctggaaagtgagtagtcatcattcctgaaagggcttgagtaccaggcatgggggtgcacagtcattcggtttttttttgttttgtttttttgtttttttttgagacagagtctcactctgtcacccaggctgaatctcagttcactgcaagctccgcctcacgagctcaaccgattctcctgcctcagcctcccgagtagatgggactacaggcgtgcgccaccaggcccagctaacttttatatttttagtagagacggggtttcaccatattcgtcaggctggtcttgaactcctgacctcgtgagccacctgcctcagcctcccaaagtgctgggattataggcatgagctaccacgcccggccattcagttcttttagcttgctgtcacagttgcataattagacctgtaccaactttcttgggttaaaatttacacagtagaactctgttaataattcaaaaaatatgttacatcatgttttaaattattttttcttacagggaagaaagcatgttgatcttactatctaaaagagggaagctatctgattgtatatacatacataatgttatggtttcagatatatgtatgtagccatattctcctttcccacaatcattcttcaactttagttacaacttccttccttatcacaatttatttaccttagtaagtactcctaatcttaaaaaactcaattttaagtttaatgtttcttcaaaataagttatataaacttggatttagttcaatttcagagaagaaatttccactacactattagatgaactaatttgtttcaaagcttactaatactaaaaaatgacattttatgattttacaatcagggacaatatttttttcactattgttttctcaacaccttgcagagtgtagggtagtgaataaatgaacctagttatttaatgtatgtgtgattttttaaaaaggtaatggcaatttgggaaaagagtgtcaccacctttccaaatgaagtgattattcttgtgtattatattgttcttatctactcttgggttcattcttactatctcttacaatgcaacacattttgtgttctcattcaaagagattcttcacactaaaatggagctactcttagtccacatttaacttttctttccatgatatttgcttatgaacatctcatttcctgttcatattcttaaattatttcaaattctttctaattagctttgcagggctgctccaaatggtaaaatgttagcactgaaactccgtgttcctgcagtaatagtgtacagtcattaaaattggttttgatattaggtaatacttggcagggatcttccaggaccttatcaggtccccacaggcaagaattgattgagcacatgcaactattatagagagcctcattagaaaagaaatctgaatctcatactttaaaatggtgcgaattccaatatttgagcttcctcctgtaaataaaattgtaaacataatggccttgagcccttttggggccatcaccctgtgcattcgacaaatacagtcttatttcccatgctgcacctcatgcacatcaaccccagtctagtcatctagtgcagcttagttgtctcacaataagcctggaacaaccatgagtatgaggcatcgctcaggatgcagctgggtggaatatgaatctggttgacttgctgagcttgaccttaaggagctctcactctggaatcagaaagatcccaagaccgaataatacagatgcctgatagaaagtatcatagttgaaagcaagccacaggtgttcaaagaatggaaggattcaagctcataactttaagctccttgtacatgagccaggcttctctgaaaaagtctcatgccatcatttgggttttcttgggtggttactgagacttcaggaggtcagtgctcaacaggactgtcatacaaatggtgatgccaagatgtttgtttcaataagaggggttgtcattggaattggctgaggctctgttgttttcctagaattgtggtagtggcttgcttatggtcctgagggtgccgcattatgtccactgaggagccctcatggtttatgtgacagaatacaggttggcctgtgggtcttcagtagggttgttgtgttttgaactgcaaatctcatgaaaacaaatgggtcttttagcctgtgtcttaaacttgaaatagaaataattccgacccattgtgatttatgctgaattttgtaaaccacaaatctagtgcttgtaaggagatgtacttccatgtgtgtgccttcctgaagagatttggcaggcttctcctcgggtgcacatatcttacacaaacttctcaggacctacactgctctatccttgtctggattgtcatcctcagctctacagagccctgtttttctcagatgtaccccatgggtacatctacagtataacaagataaatctggacaagggaaacaccatttcattctgatacaaatcgttgatttttaaaattctgacagttggcttctatcttttacttcatgttttgtggggaaagaaaagtaatcaatggacattgtaagtttttctaagtagacttggttccttttcccacaacagaatttgaaacttccatttgttgctttagcactgctgtttgtgtagcagaggcctctgagtaggggtgactgtgagtttactgtgagcttctcagcttgtgcttccttggtttgagaggaatctgaattaactcccagcctaagcactgaaggtaaaaatgataagctttctacataactacttacaacaggcctcctattaccaaaggaggttttacaagcctggcactttgcagacatttcatttatatctcagtggaggacagatatttgcttggcacagctttacattataaatcatgctctcgtaactatcttagggtaaagtcactggtgaacacaaagtgagaggaagttggtgatgccggggctttcctgtgcccttctgtatgagggacgaatggagactcttggaaaatcgcttgagattccaaactccccggttgcaggtgccctgtctctttggttcatcattgcatcctcaggacattctcagtgcctggcataaagtagctgctccatgagtagtttcttaggcattgtgtgaaacacattggcagcattcagattagtggagaactgtctgtttcaggtttgaggccagctgcacagatcaaacagttgcaccagaagtcccccaaccgtcatcatatttgtaaggagacatgcagagaagagttctttcaacattttaagttgtattatctttctcttctttacttaaactttcacggcatttttcagggccacctttaggagtaggcaaaggcattagaagttaaagagctatcagcagatggaaatggaagttcgttttaaagcgaggacttttgtagcaggttcacccaagctaatatgtccagtgcttggttactgggtaaatggagttgggcctgagaattagaaataaatggcatccagaggcattgctatcctgaaagtgcctttgtgtgaagtagaacaggtttaccctgctgaaggtcccttcacctgggcacagagagccctatttcaagactcagggtttaagaggtgattctgtctgaatttccacgctctcacacagctccttttgtgcagtgtacagactgtacaatcttgtacagagtaaattcatcaggatttaaatataaattacacatgtatacacacatatttacatttcacttatatttatatagtcatattcacaatatgatatttataatgaccaagtggagaatcttgtaaataatacattttatgttaacaagattaagagagaaagaatgttacaatcatttcaatagatgtagaataaacatttgataagtttaacactcatcctaatatgaattgtgagtgaataattcatagagtgaatgggagcttctttcaccttatgaaggatacctattaaaatcttaccacaaacattatcatacttagtgatgaaaggttagaagcctttctgttaaagtcaagaaaaagcctaggattcctgccagggctgctagcgttcaataccatattgtactggagatcacagccaattcaatgcaacaaggtaaagaaataagggtggtaaggtcaagagtggggataatttatcccaaagattccttccagccctcttgcctgcatctcaaaggtcagaggttattggttaatgactggtcatcaaatgtactgcgatattcacccattgcagtctttggtgaaaggtgccatgctgagcctttatggggggagttggtggggggctcacaactggatgcactcctggcctctgacccatttgaactctagcagattgatctttacctctttttatcttttaaaagttgtttattgagtaaagagttattcagtatttttaaagattttgaacaccattgaacaaaagttatgaaacattatccaagggatggccgcttgttttctggtgcatggatcgcattagcgccatgtcttacagaagaagtgctgtgaggtttgatccttgccaagtgcctgctgtgtgataaatagcaagtgtccagtgcttggccaaaaataaaggaatgagaaatagataagtacagtcttctcaagtctcacagtctgttagggagacccctgcacagacaggtcactggatattgcatccaatggtagcacaaagaaggagtagtgttttcaggtaaatttaggagaacagaatcttacgtgaatgacagcagctctggcaaaagcatggaggcctgaacccacagcatttgtgagctatcagactgtgccatgtggctagtatacaggccacgggagtgggaggggttaacacagtgcaatggatgagacttttccaaatatcagagaagctaagcactttgacttttattctgctggtaacaagaaactgcagaaatacaattaatactaattagcccagtgcctttgaaactggcaccatgacctgttcaaaatctcttatatgagagtgtccacactcctatttggattataattttgtggaattccatgagtgtgtgtgtgtatatatatatatatatatatattataaatgtaggcttcctgctgctgctgtcatttttgtctgcctgtgtaaattcttgtttgaacaaccatgcatctcattcccgacattttgtaatgtactatctgaatatgattagaaaacttcagggtgtaataaagctgagtaacctctaatattgaggaacattctaaaagaaaactaacttttttttctgtcacagtataagagaaaacttagatttctatattcaccccaacataacacttacccttattctatatacttatatttataggaaaattaagaaattaaaaaaatactttctttcttttcttttcttttttttttttttttgagatggagtctcactctgttgccaggctggagtgcagtggtatgatctcagctcactgcaacctctgcctcctgggttcaagggattctcctgcctcagcctcccaagctgggactacaggcacatgccaccatgcccagctaatttttgcatttttagtgcagacggggtttcaccatgttgggcagaatggtcttgatcttttgacctcgtgatctgcctgccttggcctcccctttgagaggccacttttgcacttttgctgggattataggcgtgagccaccacgcccggccactgtcttcatattttgaaagagcaggtgtttttatgaaacaccttattgaattatttgtctaagtgaatagaaattgaagcaaaaagcagtcaatacacttgcttaaattttgcaatgtttcctaggagagaaaaataaataaaaacatttatccatggtacagaattctgtgtataacaactggagcattttctataggcctgaaagagggctttgaataagaaacatcccaccttattaggcaacttctagaacagatttgtaactgcatttgttggtttagataaccttatatatgaactggcatataagtgacctccattataagttatgatattataatatatgaaagtgtgtgtgtgtgtttatagtgataaggagaatgatttttacagccagaaactaaagaatgtatgtacagcatgcattaggaaaaataaatataaatataaaataaataaatataataaaaataaacatctgtggctaaaaatacaaatttaaaagaagtttgcccatttaattatttaatcaccattttatattttagaaacacacagcagaatgattttcaaatcatatttaagcagatgaagacccagtctttaaacactgatttggataattatttattttataggaaacttcaagataaatgaactgttttatatcattgccatatgttaagtattttaaagtctagaaatgtttaagttcaacttatacatttgatttaaacatcctgactattttaattgcaatgtagtgctcagttatgtgaaaacagccatgtcggtaatggcagccaggattggggtccgatttagggagcaggtgagcaacagggatattgctgacccatacctggtagcaaggatttagatgatgtcctcacatcgtgctgtatctggctgttcccttgatactttctctatcagcttagtcgtctatctttcagattgtcacacagatggaagtagagagaagtccacagaagtgggcacagagaaagcagcagagttgctgcctgacagtctaaaacttaagttaaaaaaacaatcaaagaagacctaagaaatgtgtttaggctgtagcaaaaaagaaaataaaatcaaatgcattaatagtattctcaataataaatttaattataaccccaagaaataaattaagttcagaaagaaatggtcataaatctcagaaataaatctatcaacagcattcataaacggattattgggtcatgatgtcatcacttcatttagaaagaatatttgcttttgtgagaaaacacatttattctgcttgcagattgggaagctcctggctaatgttgctccaggctttggtaggtatattagtccgttttcacactgttgataaatacatacccaattttgtacattggtcaatttacaaaagaaagaggtttattggacttacaattccatgtggctagggaggcatcacaatcatggtggaaggtgaaaggcacatctcaaatggcggcagacaagagaagagagctcgtgcagggaaactcccatttttaaaaccatcagatcttgtgagacttatcactatcatgagaacagcacaggaaaaaaacccacctccatgtgggtccacccagacccacaccaggtccctcccacaacacgtgggaataatgggagctacaagatgagatttgggtagggacacagagccaaaccatatcactctgcccctggtccctcccaaatgtcatgtcctcacatttcaaaaccaatcataccttcccaacagtcccccaaaatcttaacacacttcagcattaactcaaaagtccacagtccaaagtctcatctgagacaaggcaagtcccttctgcctatgagggtgtaaaattgaaaggaaattagttgcttcctagatacatttgataaatacagccattccaaatgggagaaattggccaaaacaaaggggcaacaggccctatgcaaatccaaaatccagcaaggcagtcaaatcttaaagctccaaaatgatctcctttgagtccatgtctcacatccaggtcacactgatgcaagaggtgggtttccatggtcttgggcagctccaactctgtggctttgcagggtacagcctccctcctggctgccttcataggctggcattgagtgtctgcggcttttccgggtgcatggtgcaagctgtcagtggatctaccattcttgggtctgaggatggtggccctcttctcacagttccactaggttgtgccccagtagggacactgtgagggggctctgaccccacatttcccttctgaactgccctaacagaggttctccatgagagccccacccctgcagcaaacttctgcctggacattcatgtgtttccatacatcctctaaaatctaggtggaggttcccaaaccccagttcttgacttctgtgcaatcacagtctcaacaccctgtggaagcttccaaggcttggggcttgcaccctctgcagccacagactgagctctatgttggcccctttcagccatggctagagtggctgggatgcaggacaccgagtccttaggctgcacacagcacagggaccccgggcccagcccaggtaaccactttttcctcctaggcctctgggcctgtaatgagaggggctgccgtgaagacctctgacctgccctggagacacttcccccattgtcttggggattaacatttggctccttgttacttatgcaaatttttgcagttggcttaaatttctcctcagaaaatgggattttcttttctatcccattgtcaagctgcaaattttccaaacttttatgttctgcctcccttataaaacggaatgcttttaacagcacccaagtcaccacttgaatgctttgccacttagaaatttctcctgccagatactctaaatcatctccctcaacttcaaaatcccacagatctccagagcagggggaaaatgccaccagtctctttgctaaaatataatgagagtcacctttgctccagttcccaacaagttcttcatttccatttgagaccacctcagcctggaccttattgtccatatcgctatcagcattttgggcaaaaccattcaacaagtctgtaggaagttccaaactttcccacatttttttgtcttctgagccctccaaactgttccaacctctacctattacccagttccaaagtcacttctacattttggggtatcttttcagcagtatcccactcacagtatcaatttgctttattagtttgttttcacactgctgataaagacatacccaagacaagggaatttacaaaagaaagaggtttattggacttacaattccacgtggctggggaggcctcacaattatggtggaatgtgaaaggcatatctcacatggcaggagacaagagaagagggctcatgcagggaaactcctgtttttaaaaccattttatctcatgagacttattcactatcatgagaacagcaagggaaaaacctgccctcatgattcaattatctcccaacaggttcctcccacaatacatgggaattatgggagctacaagatgagatttgggtggggacacagccaaaccatatcaggagggaagccaacagaaacatcactggagaacaaggagccccactcatgctgtgggctttcaaattaaccttgtctctcagttggggctgcatgttctgggaaggccaccatcatactctagtcttttaatttggatgactgctggaacaggaggcacacatcttgagtatttacaaaaccagggctcaaaaattttaagctttattaaaaaataacatttgcatccaactattttgataacttactatttttgactagtaggtcttttattttctttgatcaagattttcaacttttattaaaggggctaagatttctctaaggttttccttttgttagcaatgatattccacttttagggcatggataatttaggcagaattgattgctcaaggtaactaaaatgctgtatgtgttgcaattctagtgccatgatcaaggaagacaatggcacctgtatatgaaacaagtcagtctgtcagacagagagtcctgaatcaggtggttaatggggttggccagagtgacaattactgtgtgctagtgttatgtaacactaagtccctcttgcatcttaactcctttcataagtagttggtgtgaggctgatggcacttccacatgtcttccttaaacttcatgggtttattttcaccattggtgtctgagaattctcaggaggaatctcagcttcttgcacatggtatagatgttccaacagtgataactgaaagatggatggatggatggatggatggatggatggatggatggatggatgaatggatgaatgaatggaaaacctgatattttgattatcataactgtgttgtaaatagaaagtatcacttaggcaacactacattgacttttagtttcaaacatgtacgtgtttaaattatggtacttaggtcattatccataagttctggcaggaaatattcatgcagtaataagaatctaattaaataacctgagttattttttaaagtcatttaaaatctgaatttaagaggaacataattaatttcccatagtaaattggccaataaaagaacaaaaaatgcagttccttgggatttaaattgtaggaaagtgatgctgataacacattcatattttccaaagcccagatccattaaatgatgaaatcccagcacagagagccaagaaaacacccaagagttccaaatatttgcatacaatgaaatgaaatgtcacagggacgttgaccatagctgtgcatgttccaaatacatcattcatgatgtgagaactttagattaaataaatgtttctactactatcttttagagcagtaaatcttaactacttatttacagaatatgagctgataaaaagacagcttcatgtaaactctgataaaatcatatttagaagataattttcctttggatgagcacaaatggagtaaaatgatacccctagaaacttggatgcaagttaaattgaaacttattttaccagttagataaatgcaccctgctgtggatattcctagtaggataattatggggtattgtgaccatctgcattttctaggaagaaaggatgatttctccagtggtcattttggagaatccctgatgcttttgtggtctgcatctgatatttgcttccagggctccgtgtaaagatgccatatagaacaggctctatgctaatcactataaacacattatctcacttaacacttcaaaattagcattgtggatgactttctttctatcccattttatagatgagaaagtggaggaactaggttaaggattgaagggagtagaacccctgggcagaccttggtgggctctcctgcttataacacagaacaatgaacttgggagtgagcagagagcatcacagtttagactgattagcccgcttctgagtgaactcagagaagaaaattgttttcaagacatcaaccctaatgaagaatcaactctttctgtcttaggtagtcactggaaactcagttacctaccaacagtgttaaaggaggtggatattttagacaattttccccattaaaatacagaatcaatgggctaaggattttatgaacataagactccatcctcaatcttttgaattctgtttacattgggcagaagaagggtaacttctatacaatttcaaaacagtagggatgcacccctattttcagtttttaaatcagtaaatcgattgtagaatctgtcatacaacaatgaaattctcacatcttttgagaacttgtttgattccagatagcattctccctggcagcatttgcaagaagctcttgagaaaaagggctccaagagcagctctgatcactcatttggagaaacccatttaactttctttaacccaagacttctcagtttttcctgacaacagatgcttttcctgtagcactcattagtaccctgtggagtcgccttttaggaaaaactcttccctggaaggaatagaacaccgctttaagttctgtgaattctcttaaagcagaagatacttactcaacacatttccctcaaaaatagtggactgaacttcagagttttaatggaattgttaaagttgaagtacaaattgtcaacacatgcatagttcatcactattctggagagttaaattcaaaaatatgagttctgaacagtatcaggcaccttaaaataacatgaattgtaaccactggcctcaccttcctagataacttgcaggactttcatcaacacctcaaattgcctatgtaccattaataataagtaatggtcatcttttttaactgaaactttttcatgagaaagcattggagaaatatcatagcgagaggataatgagtcttccatttggaaaattccttgccagtgggaaactggatgtatatatctctatctatgtctatatatagatatatacacacatatgtatgtatatacacatacatacataaatgtatattagggttttattgctaggtaataaattagcacaaattcagttgtttaatactacatgtatttattatctgatcattcagtgagtcaaagtctgggaaaattcaaactgtgccctcagctcaatgtctcacaggctgaaattgaggtgttggccagagctacagtcttttctgtggctcagggttctcactgagtgtttcaagctcactgggtatttgtaggatttagttgcctgtagttttaggactgagatcttgtatttcctgctggctataggctagagggtggcgttctctgctcctaggctgcccttagtcctagccatatgggccactcaccacaaggcaacttccttcttcaaagccagcaaaagaaaatctctttctagtaaggtacgaggaggttgtggattattgtaacctgattaagagggtgactatcccatcatcttcacaggacccaccaacactccaagagagaagattatgcagagcatgacacccaggtggtgggaatctcggggtttcttagaattctccccaccataggtgtgtgagtgggtgcttcctatcagagggcccctcagatcagagctgcgttacaatgaaggagtcagggtgcaggtgatggaagaagatggaccagctgctctgaaggctctaagcaggactgttcacctgtggaccctgaggacacacaacaccacatgcctcatgaaatacaagaagactgagtagtgcaaactacatcgttacccctgagtctttgtggaggtctttagtagttttaccaattgagtaaaacaatagaagatgctacaattgtttcatcctaagttcattcagttttttttttttttaatttaagagttctgggatacatgtgcagaacgtgcagttttgttacataggtatacatgtgccatgatggtttgctgcacccatcaacctgtcatctacattaggtatttctcctaatgctatacctcccctagccacccccaaccggctcccctgtgtgatgttctcctccctgtgtccatgtgttctcattgttcaactcctacttatgagtgagaacatgtggtgttaggttttctgttcttgtgttagtttgctgagaatgatggtttccagctttatccaagtctctgcgaaggacatgaactcatccttttttatggctgcatagtattccgcggtgtatatgtgccacattttttaaatccagtctgtcattgataggtattttgggttgtttccaggtctttgctattgtgaacagtgctgcaataaacatacatgtgcatgtgtctttatagtagaatgacttataatcctttggatatatacccagtaatgggatttctgggtcaaaaggtatttctggttctagatccttgaggagtcgctacactgtcttccacaatggttgaattaatttacattcccaccaacagtgtaaaatcattcccatttctccacatcctctctagcatctgttgtttcctgactttttaatgatcaccattctaactggcgtgagatggtgtctcattgtgtttttggtttgcatttctctagtgaccagtgatgttgagctttttttcatatgtttgttgcctgcataaatgtcttcttttgagaagtatctgttcatatccttcacccactttttgatggggttgtttgtttttttcttgtacatttgtttaagtaagttctttgtagattctggatattagccctttgtcagatggatagactgcaaaaattttatcccatctgtagattgcctgtccactctgatgatagtttcttttgctgtgcagaagctctttctttgttatttcttgtcatctgcttgcttttgaatgtgtttgctgttgcttctctagctcttttaattgtgatgttagaatgtcaattttagatccttcctactttctcttgtgggcatttagtgctataaatttccctctaaacactgctttagctgtgtcccagagattctggtacattgtgtctttgttctcattggtttcaaagaacttatttatgtctgccttaattttgttatttatccagtagtcattcaagagcaggttgttcagtttccatgtagttgtgtggttttgagtgagtttcataatcctgagttttaatttgattgcactgtggtccgagagactgtttattatgatttccgttcttttgcatttgctaaggagtgttagttttaaaaagcaaaaaattttaaatggcatccaaatgatctaggagaggaaaatggtatttaaattatttgccattaattttcaggtaaaaagcaagttggtatatatttaagccatgcgattcacatttatttttatttatatttatagtttctgtatttatattttttatatttctcaaaagctcaaaacttaaaaatgttagatatcaatttaaacagaaaatattaacttatcatagactaatcatcaggtctttgcaaactatttactattagtggcctatgctgctgaatgaagagtttttaatgcaatataaatttttatcaatgagatggtttcccaaggacatgagtatggctttaccctatgtctgccataagtactctattattctaattttattttatattttcttgccaaaaaatggagccagtttggtcctatacaagtatgtttatgtgtctgtaaccatcccatacaaatcctattattataggcagaatttttttttctaaattttgtttttcttattgttgcatatgtatgactgtgtgtgtgtgtgtgtgtgtgtgtacatacccagctgaaattttctggtcagaaggcagaccaatatttgccactttttttttttgtccttcaaagaatctggggtaaatgtccccatgcattattgtaaaggcaaattcatgacagtcctgctgaaaccttaatcttaaataacacagtctcgcttagacttttgttatgtattcaatgcttccaaagttcctcataagaactcttaaaatctgtacaaattatcatcatgttctcaagcacttatagtatgtttaaacattttccccttaaaaatggaagattagaaataaaaggcagatgcctctgctcaaggtcaccgatttcaattgttagcttgagaaggaaacgtttcccaaaggacaggcatttgcttctatctaaaagtagttactcctctcattgcaagatatttgctaggaaaaagatatctgaattcctggcttttgctctcagagagtgagaatttaaaggcattacagtgagacaataaaataaatagatggatcttctcatttgagatgtaagtttatggaagcaaaatgcccacaaatcacagcctctgtaataaagatttccagtgacagcactgattttcttattctcctgagctttaggctgttataaaaaggaatgcctaaaataatgggtaaggaggaaaggtagttccatttttgtacgtacacgcacatatatatgttgtgcacatacatacatcacttttgagcaagaaagcagaggagtatgtgtttgcttttctgcacttagaagaacccaggttggctacaggttgaaagtgaatgcggccattcaaaagccccagagattttggctcagttactccccacttcgagccagtgagggtgtcagttacccaggtgagacctgaagtcgcatccatcccaggctttgccctggggaagctcacatgcttgggagaccgccttgcaaacaagtggcataataaaggttcatgatgcatgataaggtatgtagagagtactgtagctacttagagcaaacctgcagaaattcagttactgcatagaatagtgggattgtggatgattttctacttagaaatgctcactttttggttacaatattgttttcacattttttcaaaacgtttctattgcattttattgtgattctatgactagtaagagtagtggaaagaaaccaggaatatctaaaatatctaaatcattaacctctccccagagtaactagcgtatactgagtttgtctttcggcattttgaatatcgattcttttccccttctatgagccagatccaaatacatgcactgggtgtttatttgggatggctaagtaaatctaaagcaaggttgtggattgcaaaggcattttggtgttaggagatcagcttctctatcctcttatatggcctttgttgggaggtattacaagcatttaaagatgttttgcagaggattggatggtgagtaagtaagaaacagtcctggaagccaagttctcctaagttaccctgtgactcccacacttctccaaatcccatggaaggtgattgtatgataacttcctcatgttcaaaggcctgtgccagcatgaaaaagcactgtgaccaaagaaactgattagaagagacataagtgattttaaaagaatgaggaacatgcacaggctacacacacacacacacacacacacacacacacacacacacaaagatcgtaatgcatagtcaatgcactggctggctatgtggtagataacagtgtcattttgtggacatatatggtggaaagtgaaaatgaatggatggtgcatgctttatgaagcatttatctacaaatactggtcatattcagtcctaaataagcaaacataaatgccatgaaaaaaattacgatgattttactatatacaggaatgtataaactcatagttgttttggataccattttttatttgtacaaatttgtagtgtacacatgaaatattgttacatgtatataatgtgtgtgatcaagtcagggtatttagggtgtccaccacccaagtacaatgcatttctgcttaattatagttaccctactctgctatcaaatactgaatttactccttctatccagctgcatgtttttaccttttaatccatttctcttcatcctcctctctttcttccacttacctttctcaaactctatttactatatttctctacctccatgtgatcaactttttttggctctggcatataagtgaaaacatgtgatatttgtgttttggggcctgaattatttcactaaagatagtgaccttcagctccatttgtgttgctgcaaatgacatgatttcaagataatttcttttttttttttttttttttgagatggagtctcactctctcaccaggttggagtgcagtggtgcgatctcggcttactgcaatctccgcttcccgggttcaagcaattctcctgcctcagcctcctgagtagctgggactacaggcacgtgccaccatgcccagctaatttttgtatttttagtagagacggggtttcaccatgttgaccaggattgtcttgatctcttgacctcatgatgcaaccgcctcagcctcccaaagtgctgggattacaggcgtgagccaccatgcctggcctgaagatataatttctaaatagcaaagaagccaccatgtattagaaagaggcttgtttttctgagaccatacagttttgtacctctattgaggtatggttggcatacaatgcactacatgtttaaaatgataaaattttggtcagttttaaggtatttatacattcataaaaccattgacacaataaaggtagtgaacatgtccatcaacccatttcctcatttccttttgcaacacctccctgatacccgtcccagtactccctcatctcagataagcactgattgctttctgtctctatgcattagttttcatattccctaatgttatatgaatagaattctacagtgtcacacctttttttttttgctggcttttttatgtgcataattattttcagatgctttgttgttttgtatattaagagttcatttcttttaattgctgattaatattccataagattattcgtttagctatccatctgctgatggccatatgagttgtctccagtttcttgtctattacaattaaagcttttgtgaacattcaggtacaagtgtttgtatgggcatgtgtttcattttctcttgggtaaatatagaggaatggaatgagtaggctatgtgatatgtatacgtttgacttcttaggaaagtatcaaacagttttcaaatggcttgtgccatttacaatgctatcagcagtgtatgagatagagcaaacctgcagaaatggagttactgcatagaaaacagtgggattgtggattaatttctacttagaaatactcaactttttggttataatattgttttcacatttttttcaaaacatttctattgtattttattgtgtttttatgactagtaagagtagtggaaagaaaccaggaatatctaaaaatctctaaatcatcaacctgtcttcagagtaactggcatatactgagtttgtcttgtagcattctgaaaattgagtctttttccgttctatggaccagatccaaatacatgcaccaggtgtttatttggggtggctgagtaaatctaaagcattgtgtcctcctcagcatctgatactgtgacacgattttgggtttgggggcttttgttttttctgttgtttgaattttagtcattctaatacatgtgtagtggtttacttgtggtttcaatttacctttttctaagtttacatacgcttgttttgccatcacatatctttgttgaaatgcctatacatatctttcagcagtttttctattagttagtttttatactctagttttaacttttaaaatacataatgggtgcaagtctttttatcagatacatgatttgcaaatactttctctcagactatatagctcatcattaattttcttaacagtgatccttaaaaggcagaaacttcttattttgattaattcattttaattgttttttttattttatggatggtgcttttggtattttatttagaaaatttttgcttaacctaagaccccacaggtgttctcatgtgtttgcttctaggagttctttggttttagatattgggctatgatccatttacatcaattatcatagatggaacaagttattgatcaaaattcatgttttcacatgtggatattcaattattccaacatcattttcagaagagactatgctttctccattgaattgcctttgcacatttacaaaacaaaccaataagccataaacaggtgggtcaattcctagactttccattctgttcttttgctcagtctttctatcttgatgcttataccacagaatcttgattattgtacctttataatgaatcctgaagttagaaagtatgtcttcctactttgttcttccttgccaaaatattttgactattctagataactttgtattccatatgaaatttagaattagcttgttaatttctaccaaaaatgcctcctggaattataattaggattgtagtgattccatttcctttcattgtaaaagtcatgcacatatttttttgagatttaatcttaagtattttatgttttgatgctactataagtagtgttcttttaaaattttaatttctggtagcttgttgctggtgcatgggaatgaaataatattttatatttacattgatcttgtgttctgcagccttaataaattaatttattacttctagtagcttttttttggtagactccataacagtttctacatagacaatcatattgtatgagagtaaaaatataattatttcttacttttaatatggatgactttcgtttctttttctttcctgattgcactggctagaacttccaggataatcttgaataaaagtgataaggacagacatccttgccttgtttctcatcttaggaggaaagcacacaggctttaaccattaagtgtgattcagtctgtaggtttttaatagatatccttcatgagatttaggaaatttatttgaattccaagttgattgagagttcttataaggaattaattttgatttttatccaataatttttgcatctattgagattattacatgagtttacttctatacagttcatatgatgaattacgttaattgaatttcaaatgataacccagtctttcattgatgacatgaaagccacttgatcatgaggtgttaaccttttgatatattttgggtttgatttcttaaattctttttaagaatgttaacatctacattcatgaggaatactcattcatgaggaatagaaaactacattcatgtagttttctttctttctgtctttgtctggttttgatatcaaagttggcctcatagaatgacttgggagatactgtctcgtttgcaattatctgcaaatattttgtatgttacagctggcatgttgcaagttgtttcttccttatctcttcgaggtcttccttgaacatatgggatgcagttataattactgttttgatgctgttgactacagattctgtcatctgtgtcatatctgcatcagtttcaattgactgatttttctcttcattacgggtcatgtttttggcctctttccatatccggtaattttagattggatgcaagacattgtgaatttaaactggtagacaatttttttgtcctaaaaatatgctaaggttctctttgaggacataattaagttatgtaaaaacagtttgatggttttggtgcttgcttttagtcttagttacttgggatcaaagccacatttagtctgcagtaatttttccccactgtggaagcaaggccccttttggtatccaaccaatgacccttgaattatgaggtcttttggttttgctctttgaagcaagcactgttcctggtcctgtgtgggtaacacacagtgttccctctgatcatttcaggcagatctttccctattcctgtgtagtttctcacatgaacttgctgattttttaagtcaaaacctctgttacctgatttgtactcaattgaaatcgtgatgggtgatttttgcacatcactggtgtgttcattttgtgcaactttctcctttccaataatttcagccactttggcattctccagctcccaaacctgtcttctcagtctctagcctgtgcctgggtttctgctccccatgctgtggcctgggaaccttctcaaggctgtaggttgtggcactcatgggtctcccataagttgtctcccattactcagtgatcactgaccttcattgcctgaagtccagtactttaagaaccattatttaatataactttttgttatttggataaaagggttaatccagtttctcttactccatattggtgggaaacagaagacactctgtgaccatataattttgaatgcaccacattcctttatataccttccttactgggtacaactaaactaatttccagaacttccagtcaatctttgttctgtttgccacaagctcctgggagcatggttctacttccatgtagatacttgagtgttttggctctttgcaagcacaattcaattactttgttatttctctaatgtgaattgctttcagtctcagcaggccaagcttagttactgaaagagaacttgataaatgcatatggaaaccataagtattccatatgagaataaatttgatttacatattcagttgtggatgagatgacttgaagggtaatttttgggcttcactctgagcatgtggtatcaaaattctgcttgggttgtctctgtctctctactttacttgcaatgtatgaaatatgagatattttaattttctcaagggaaaaataaacagcaaaacaggaggtcccacttaactatctaaatctgttccccaaatgtatgcaaatttcatctcagtagacttatctgttacttaatcaatatgatttatccatttaccaaatagtgttactatgcccaagattggtaatataaaataaacgtgacaaagttcttgcttttgacaaatttgcagtctattagtggatgcagaattataaataggcacttaagctttaaggaactacatgctttgattctctaaatcaggcctatggtgatgggggcctgaattagaagaggcaattaagatggagaggacagaaggaacacaggaagccatgactgtagtacttggcatagaagtaagggagaactggcagagtgtctcccgggttgcaggattaaacatttaaatgagtgcttttatcactgttgactggaatacataatacgtggggaacatatttggaggaattatttataattgctttagtaagcattcttatctcatattttgcaccagaatattaagaaccttaggtgccaaatcataatagttagcttcctgaaatcctttttaaaatcatttatctctttagtattaagtgcagttttgttaaagttccatttacatttggatagttacagcagcagttctctagtaaattgtaacatacatattcagttaagccatataagtgatcacaatagaattaaatcacttcatgattttgctcattaagataaaacaaattggccataccatttctcaccatttcataatttgatacttcaagtgaatgtatcataattaaacctcaaaaagcacttgaaaggagaaattctgagtctcatgttaaattttgaaccatgagaaaataagaacataagaacagactgttgttggaggcttagatctgaagagactaaactgatctttcttagccgtgagctgtgcccacctctgggaccaacacacagatgccaatgcagacacttgagccagctttcaaacacatttgcccctcatacatttcaaaaattaaacttcatctccatagaaagaatgaagtttgcagtgtgggaaacctaagaattattggtggtatcctataaatctgtttatgaagatgtaggattttactaatttataggtaatgctgcatttgttaagacctaaagaccagcacttttcaaacagaggcccataaactgcacatgatttttgtttgtttgtttttttgagatggagtctcactctgctgcccaggctggagtgcagtggcacaatgtcggctcactgcaacctccgcctcccagattcaagcaattctcatgcctcagcctcccgagtagctgggactacaggcacctgccaccatgccccgctaatttttgtatttttagtagagacagggtttcaccatgttggccaggctggtctcgaactcctgacctcaggtgatccgcccaccttggcttcccaaagtgctgggattacagatgtgagccaccacgcatggccgagctgcatgtgttttgagcccatttcagcaaggaactccaggattcttatctggccaggctggctcggagtgagggagggaagggcagtggcatatgacattctcaatccagaggtgagagcatccccacactagaggcacagagggtccaagacaagggtttatggctttcctgtcatgtggttttcattccaagtgaaagagatcacacacgcgttgtgcctggcttttcacatgactgggtttatggcattcattggggctttttcatttaagaggcagcattcaaaagatgccataataaaagatgctataaacacaagaaaatgaagtcatctatctttctagtatttgttgatgtagagatcatgcaggccgggaggaatgcctagagagtattaaatcaaagaaacagcgatgatcgccttacatattttctgttaaaagcctatgatgtcacaaaaatcctgagtgttatccgctgtaaaaaaaataaaaaataaatgcattgtgagtaaagaaagctagttagagtatttaaaacagtacaaaataaagattgtattaggttcccaggtaaagttggtggcatggacacacaagttgctttctatcccactggaaacatactaatacagtgttagaggggttgatttttcaaggcatgaatgcgcaaagtcagaaaaaaagagaaagaaccatgttgtttttaaaaagtagaatctggaaatacatcgaagaagcatgaattcaagtctaacagaggagaactatgtggaagacaatgcttcccagtcctgtgattcttagaaaggcctgctcgcaaggctagctgttggctggcatctgggaatctggatttcaggaaggtttctaccattcccagatggcaagaatggctctctgtgcttaaattgtctgtacaaacaatgtggtgtatactgaaagcttccttgggggaatctgaacttttggtacatgcaaaacaaggatgcttctgcaaccagaccccggtgaaaaccctgagcaccaagtctccagtgagcttccctggtagaccaccttccctgtacgtcatcacaactagctgctgggcgacctgagcacatccttcatgactctgctgagagaggactcttggttgtgctgcctggctttgtctgcacttctaccccatgtgcattttctctttgctgattttgctttgtagtcttttaccgtaatacattttagctgagaacactgctgcacacagagtcctatggatcctgctatctaatcatagaaactggagggatcttggggacccccagcacatacatgaaaataatcatctcaatgcacaccagagacccctcagagagcttaggaatccacagccccattttttttgttagtggcaaaacaacattgggtgacttctgtttaagaagttatcagacctccatacctctctcccactccaccaaggggactagacctgctctgtccagcagatgataggaagcttattttctggagaggaaaacagagcgtctctggacctctgagcactgggctcagttaactgggtgcttcagaactgagaacggcagagtgagataagtgggtgtctactggacactgagagttctgccctcttcctccactcagctcccagatcctccatggctcagcctccagcatccagacaggcaagacactggagcagtcttctcaggggtctctgaagagtccagcaggaaaggtttaagattctgacaaagattcttaaattctgtttaaagatctcaaccagatctgaccaggtctacagacttctctgtgctacagaccttccagttaaactttttagccctccactctaaatcagagcagaaaacaaagactgttcagatcacagaagaaacaatctaacaagaaagatagagatccaaaaaagcaaagggaattcagcaattagaagatacagaagctatagagaaagactacaaccttgaaataattcatcaaagtactcagagtattcaaatcatcaatgtgctcaaattggagaaagtagtgtgaccaaaaaaataagaatagcatacaataacagggaataatcaagaaccaaaaaaaaagacacaaaagggcttttggaaatttaaaatgtagtagagaagatgaatatttcaatcatcattttgaaagataaggttgaggaaatcttccagaaactaaagcaaaagatgaagatatggaaactatgagataaaagatgagaaacgtgaaaatggataaatgagtttacatccaaaagataagagatgcagcaagaaaagggagggagagcatgaaatgaagtaatcaagaatatttctaaaaccaaaggaatttgtagattcaaaggttttaccaaaaggacccaaactcaagtttagctctatggagataagtatcaaaatctgcaactgaaagaggtggaggaatgatagagcaatttattttattttattttattttatgataaagcttaaagagtgatttaattcttattttattaataaaacattgttaaaaatctttaatcctgtggccatcactaggtgtattatgtgtatgggtttccctccagtgaaacccgttggtgtaaaatggagaaattatgtcacactgtatccaaggtcaactcctgtatccctcctgttgggctctgtgtctgcagcaattgtatgtagaatgcttgtcaaataaatcagtaggtgctccaggcagattttcatcatctccacgtgccagacctccaaagccactgcatgttcagctacccaggatcctcctacctgtggttacaagggaggtacctgggagggagggaacagaacttacattttagtgtactctcaggagaagctcagaagggccttgaaggtgttagctgtgagatgatgggaaaccttatacgtaaaaaaagtctcttgcatcattttatcttgtggctcccctaccactctaacacctcacatctgtgatcccaggtcttaaaacatccattaatctcaaactgaatattgtgaggtttacaaatcaatcttttaaagaaaatagctaaacttaacatcggaataatgggtacttttagctactcattaagtgaaaggaagacgatttttatgggatcggtgggtttttttcccacaagcaattaagtttgttgtctcattcccattgtttacacaggagagactgtggggattccttttggagatgtcttgaacactgagcattctgttgaatacctaatttaacataaatgtgtttttagtttggtagagtagctgtgagtgtcttaggagctggtgttttagagacccttatctttccctaaaggaaaggagcccttcgtgaggttgctctgtttaccccgtatagtaacactcgtctgcgcattctccccaggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatggtgagtagtgattccgtggggactgacccacttccatggaagggcctttgatcttttctctaaggtcataaacagcaagggggcattttcctttttggttatttatggcttagcagccttgaaaacaatgatccctgtagagcacaactgactgtaggacaaattgaaagaaaggagccttactgtaagaagttagatattgaagtgatactatgaaatcaggcccccagataacactatatttattatagacccagaatcatttgtgtgagatttattcagtatcagaaaatgtactggggaagcatcactgatctttcatacatcttctggcactaaaatgtaagctgaaaaaaggtttttctttatttatcccaaaacttcacaaaggcaatggaagtgcatttctctttgtacctataaaaggatgtttctgtttttaaaaagcacattgtgtaaggatactagaatagtctttgaaataactttgctccttataattgagtaaatcccttgaatgccatagtaatagcatggagaaagccctgaggcagaaaccagatctggcctctgcctggccctaacaccaagtggtccttttacctggggcaattcactttctcttcctagagctctgctgtctcaactgcagaaaaaggaattgagcctggtggtccttaagagcttgatgctttgctttgttcttcatttctgtttttcagcctcctctaattgggcaaaatctcttccaaaggaaaagataccaacagaaaaggaaatagatactcatagatgggtccttggtacacagtttgatgagaacagtgattgttatatcttgtggccattcttagatctgccttagcatctttgcacaggtgattctaccttattctcccaacacgaaaggacagccaccatttacagagaaggggtcttttacccagagtggatagcctggacaagtgccaccgagctggtgtgttgccacgttggacagaatttattgtgggataaattcatggaggtttggtagatctccttggtgttgccacagggaaggctctgagacagtgtggctctgtgtgacggccaccagctgctctcgtgtcacagatcaccatgacttctcctgggagctggtgaacagcctggatgcctggaggcccagcaggtgcagcaggagccacttgctttacaagcctgcttcctcatcctattgctctcactgacattaactctctcctctcctcacaccactgctcactgtagttcagtgattacccaagctcattgttccttgaagcaaataaaaaagtctgctttcatacagtattttatgtacaacttaaacaaataccactcacctggaaaaatgggtaacaaaataatagtcactctttttaattttgtaaactcttgctgtatttagaagagaaggtatatgatgaaataccaagagaaagataactgaggacttaaatatgcacattttataaaggatgatcttgtgacctccacctagggtggtgagatgaagcacaaaatttaaatgcaagtttcagttatcttttagaagtttttttctagtacaagtatatcccatgaatccttttcaggaaaagtatatcccacataactttttaaatgactaagccccatgaaattttttggtttttgcttgtttgtttgttgagacagggtctcgctctgttgcccaggctggagtacagtggtgtaatcatggctcaacctccctcccctagctccctacccccgacaggccccggtctgtggtgttcccctcctggtgtccatgtgttctcattgttcaattcccacttatgagtgagaacatgcagtgtttgggttttttgttcttgtgttagtttgctgaggatgatagtttccagattcatccatgtccttgcaaaggacatgaactcatccttttttatgactgcatagtattccatggtgtatatgtgccacattttctttatccagtctatcatcaatgggcatttggccaggtttcaagtctttgccatcgtgaatagtgcctccataaacatacgtgcgcatagagttttattcttctgtatctcaatggctttgagttctcatgaccatttcacattttggtattgatatcttgaaaacacaaaatgggactcattttcctctgaccacataaaatgaggcttgatttgtgcatagtttttctttattgattcaccacagaatactaatttatcacagacagacaattctaattcaatttctctgaagagtatgctgccatcctttcagaaacagattttctaagtaaacaacagagttgcttaacaacactgagagctgttggcacacttgtcttctgagcacacttccccggaactttactgcatacttttagagttatttgttaaagcttgtgtcacattgcctacatttgagaaaattattgaatactttttagtattgtgagtgggaagacattttcataaaattttgactatggctaattacgtgacttaacaagtgaaagtgctcactgtacacatcacccacaatatgtcctcaaagcctgttggctgtgattcctgccacagcaactccccactcaccccacagcccacctgctgctgctgctgcctctcttggctccttgggaaacacattttgttaggtagtgtgctctaaacttcatagaaacgtttgccaatgtcactcagtgctgtgttcagttctagggcatgagttccacagagcagacaggagtttctcaggcctgtgatccagaagcagttgacttggccccttttaccagcattaattcacctttgaaaggttaacagctgaaagaataggtttagaaaatgtctgaattatgtttcccttcctccagatggaggtccttgagggcaggctctacccattgtgtctgagggcagtttgttgtagaattcccaaggaaagtgagaaagttgtgttttctttgtaagaagtgtcttcaaaaagtaaacgaactacctatatagaatctattatttactgtgtaaaggttcaccacattcacatggagttcttaatttcaaccttatttcatagtaattgcaggaaacaagcttgagagataagaggctatcacaccactgatttttggctactgaagtgtaaaaagagctcaacggaatgtgagagggtagttctagaaataaggcagacagcagatacagaatgaaagtcagcatggactgtagttcctctgaaacttgtaacagaatcacacttcacctgtttccttggcagggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacattttgccctgcccaggtaagtggattgtgtagtctacaaaacatctgaaaactcaagggccttggagagtcttctaatttaccaggcctcacgcagctccctggcttcgtgtttgagatctgtgttcttaataaatgtcttggctatgcgtggttgctcatgctggtaatcccagcactttgtgaggccagagagggggaatcacttgagcctaagaactcaaggctgggcaatatagccagacctcatccctacgaaaaatacaaaaattagccaagtatgttagtgcacgcctgtagtcccagtcattctggaggctgagttgggaggatttctgtagtccaggagatcaagactacagtgagccatcatcaggccactgcactccaccctgggtaacagagcgagaccttgtctcaaaagtaaataaacaaacaaataaataaatgtcttgtgtgatgtcatcacctgttggattagcccagagtggaaaaaggaaagaaaaagaaaccccttctcccagcagacctgaaaccaaatcctaaatcattccaagcaatattaagaccattctctcagccctcctttcagacaagcatgcaactttagttgtctgtataaaaagatctgataggccgggccacagtgggacctccctgggccctgggcacatttgtctgcaggggccccccactccctaatgcattggggaaagacatcatctaggctagattgtgttcatgtttttttcttctgattgtaaaaggaactaaaactttcctatgagctactcgaaggatatggactctagttgttgtgcctgatggaaaagccggcctttctaatgtggtctgaaatatctggggcctttggagtgaccatcagctccttctggaggctgatcccttcctgggccactgatggacccagccctcccccacatggcctccatgtaccatcaggtggtcatccagggtcacgggtatcaaacatgcaacccctggaccctgggcctgccaagccagttcttggtcctcatgtcttctgtcacaaaaggtctacctcattaattaagtcctccaaagacgcaaactcttctctcctgtgggcctagcagagctgtttttctgggtcttcttcctggggcctggcttttcattccactgaattcccaagcaagcacagagtcatgaaaatgagccgaaagagcccccgcccagggcttttgctctgacaatgcctgaaacactcctccatctttccctttaatattcaagcccctgtttctgcctttctcctgccgcagctcagggtccctagcacctaaaacacttccaccagaacttcccacttcctgctctcctgtccagaacccacggaaagtcttcagcccacacgtcatggccatcctgagggctgatctgtgactggggaggctgccttgacttttgtctgaagctccatgaggacagggactcctggcctggtctcactcatggcagcaaccttagctcccagcaggggcctggcacatactagaaatacccatcagggattgttttttaataatgaggaaacaaagagttggttaattgatctttcttcattcatgtcatttctcaggaaacatttttgagtaaccgactgtgcactgtttacagggtatacacagatgcagtgttatgatccaggtcagaaagaaacttaagagtttagggagagtgcatcctgggagcagcgtcaacccagtatggccactggctactgagtttatgacaaccaggtgcagtggctatatccaccaaggagccagccccttggtggatttcaccaaggagaaatcatggcagccacagcaagcaggctgcccttaagctgggtctcgagggacagaaacgagttggtgaaattgacaagcagagatgggaaattgggaggaaggctcattctggagttggatacaacatttttaaaggcatagaatattaacatatttctagtagatacaactttctgagttcttacatcaagaaactggcttgtagcagatactcaatgaaaattcattggattgggtgcttggaagggtggataatggatggatgaatgcatagatgaataaacatgtatataaaactgaaaatatatagtttccagatttgtagctgaggctcccaataatgtttctgctcttatcagctgcctggctcctcctagggtgtctctgcttgaatttctccagcctcaggagactcctcctctgcccacccagctttcccagccaagctgatgctgagaggctgggaaaggtcactgaactgttctttcccacagccccagtaaaaggagtcctcctctgggggctgagaggaatcctgtgggcaagctcactagattcgggtccatgctataaactggaacaggggcagacgtcatgggaatgtcagggtccctccacccacccttgtctccctgggctccagaccctatccttgttgccatgggtaggatgtgcagattcctgcagacacttggatgttgtcctagtgcacaagtacaaagggtcaccactcatctcagagacactctattaacatgatctgttggttgctctcattttagttgatttggtggtcaagccaataccatgtatacataactttaatatgttgaaataaccctgtcctcattttcgttttaaaagccaagattctgcagagtgttgtggagttattcagagtggcccatgtcaccttgcactaggcagtgggtgagtcagggctgagtggtgcttcccctgcctgggaaattcctaaacatatgatcgggcatgacccagcagggagggttggaagtgctaggggtgtgaatgctgagctgcacagtcaccaggaagccagttagaggccgattcctgtctcactcaggatactctcccctgtgaatttactcttctttaaccctgttgggttcatagtggacaattacaaatggacactgtattttatttaaaaatatgtttcctcattaaaattaaatatgaaaataaatcagccgggcatggaggctcacacttgtaatcccagcactttaggaggtagagttggatagatcacttgtggtcaggagtttgagaccagcctggccaacatggtaaaaacttattcctactaaaaagacaaaaattagcctggcatggtggcatgtacctgtaatcccagctacttaggaggttgaggcagaagaattgcttgagcccaggaggtggagtttgcagtgagctgagatcatgccactgcactgcagtctgggtgacacagtgagattctgtctcaaaataaaaataaaataaaccagagaatataaaaacacattttaaattaatcaatgaaaaaattttacctctaagactgatgtgtataaataaactataataaggtttctaagtcaagcccatgctgaaataatcatttttttcaccttctgtgggtccatctaactagtaccttcacctacataatttacgccagcattgagaaatagctaattatttcttcttcactccttttcctcaatgcatatttgatttagccttaaagactccagactttgacctacaaaggtacagacaacagatgtttttttgttgctaagtaatgttcagctaagaggaaagcaacctcagagtttggcacatgtaccctaaaacttaaagtataaaaaaaaaaaagaaaagaaaatgaaggtaaaaacctaatgaagtaaacacaaactcttttcatcagacttaactgagatggttctgttttgtattttgcaaacaataattctatgggggaaggaacactaaatctaatggagggacagactctgagtcaaaagaataattctggcagttgtgtgtcctatagataaatctcttaggcatctctggtgtgctcagaaccctctcttcctttgcattcttggagtccttgagtccatactttgaagtggagccaggcagggggcagttggtgtaggaaatttctgcttagagatccttaggagcagagagcacagctgtcctgcagtgcaaacctatgtagtccagacctcagtatgctggagaatcaataccacatttgcccatgtcccgagagactgtgagtgaagggcttcacatctctgatcacacacaggaagcctgttgagcaaatcttagttatttagtttttactttgctatttaggtctctggcaattgtacattggttactgccattgtttttaatcttactgtagtgggtggaatatttagctagaatctctacaacaagaatgttatcctcttctgtcaagttatttcatgtataaatttcattttatcaaaaataatttcctataattaattgctttgattccttgaaagaaacatggatctgagtttgtgtttgtctgatcttcccatgaaccagtatttcttgagctaacttgggtgatgattcaagccatgaggagattcctatgtgatttttagcaacatgggaggagttatgggaagccctaacctgtgcttgtgtgtcaggttctgtgctcagcctgccactgttccagccccagcttcccactcacttgcccaggacctaacctctctatgcctcaagtctttcatttctggaacaacccccagggcagttgtgaggatggagatggaatattgaatgagtttattattttaattattactattactaatgttatttttttagtccaatatagttcacatagcaggggaaaaaaatctattttagtggctcagcctcactcaggcccctgacatgctgtgccttccacagtggcttacatttgttttgttttcttggccctgcaactttctacttccccaccaggttgtacaggctcccttgtgatgaaggctatttcattaagatctgtgttctgaaatgtctattttagaaatgctttggcctttctaatatgaattgttagtacaataatcaatatcctacattatggctccatgatgtgggttgaaacctgtaacataaagacagggtcaagaggacagaaagcaagcaccgcattagaattggtctggggacatagggcaattgcagactaagcaacttccggacagagtaaggaagtggttccaggtctcctttgagttccctctgtactagaaacatccatttccccagttctttgactgctgaaattggtagaggtagagtgtgatcttgtgatttgaactcccaagtgggaatgtttcagcaactggattctgttccaaatgctctcttaaacggttattcaaacaacagctccattctctctgtttaacaataaatgatcctgtgccaggagaatttaccatgataccagatggacagttggtgtatgtgtgagagaggatttattagactagatcacatacacattggcttacatgttggtagaaatgtggacaggaataaatattgtttggaatatcacaggatatattatgtacatcagcttcctggtatgagatcattagatgttgcatgattatggaaccgttgaaatgagcacatttagtctctgtttttatttttgttttcgctgtggtaagaatactcaacataaaatctacctacttaacagatttttgagtgcacaatacggtattgttaagtataggtatacaacgatgtatagtagatatctagatcttactcattttgaataactggaagtttataccagctatacagcaattccccacttccctctcccccagtccctggcaaccaccgttttactctctgcttctatgagtttgactattttagatacctgatctaagtggaataatgtattatttgtctttcagtgtctggcttgtttcacatagcataatgtcctcccctaggttcatccatgttgttgcatgtggcaggatctcattttttaaggttgaatagtatttcattgtatgtacctaccgcatttgctttatccattcatctcttgatggacatttaggttgttctgaaattttggttattgtgagaaatgctgcagtgaacatgagaatgcaaatgtatctcagagatcctaatttcagtttttttgatatatacccaggattgggattgctagatcttacagtaattctattttcatttttttattttgtgatggagtctcgctgtgtcagccatgctggatgcattggcaccatctcagctcaccgcaacctccgcctcacaggttcctgcgattctgctgcctcagcctcctgagtagtgagggtgacagatttgcaccaacatgcacagctaatttttgtgtttttagtagagacagggtttcaccatgttggccaggctggtctcgaactcctggcctcaggtgatccgcctgtcttggcttcccaaaatgttgggattacaggtgtgagccaccatgcccggcctctgtttttaattttttgaggaccctccacattgttttccgaggcagctgcaccattgtacattcccaccaacagtgtataagggctccaatttcttcacatcctcaccaacactgatcttttgttttttggataatagccattttggcaggtgtgaggtgatacatcactgtggttttgatttgcatttccctgttgattcatgatgctgagcatcttttcacacacttgtcggccattcatctgcaggtttatcattccatacagaggccagggatctacagaacacatggttggttatacatcaggccctgacacaatctagggcacacattagacccttctgagccctgagctgccttgtgcgcatttagaaagccaagatctaagacacttgccattactataagtcacaatgacttatttttgccctggtgtatggggcatgcaagggtactcactgatgccaagctccaatttaggttacaaacagaaaaaaactgtcagcaagtgcttccttcagtgagaatagatatgggagagagcttttttttttttttaatttttaaagttctaggaaaacacatgcctggcttttttattgctgatattacagccagtatcaaatacttgatcaattcctctaactgtctgatataccgtataacttttagggaaaatactgttgaattctgcaagtttgtgtaaactattgaatcacaaaatttccagttagattgcaaacttatttctaaattgggttcaaatatttttgttttctttttactttctgcaaattataatattgtcataaagatgatatttttgctctggtttctcaaaaatgctttctttttacctttgccaatatctaaaaagaaacattacaccataatgatgtaatacatcatgacaggcatattaaaaaacaatctaagttattctagctaaaacaatcttatgccctgaatgattttggcatcctcttgctcctgtttctttgtgtaggctacaaagaatgttaaaatatgatactgtctacatacagcaatagtgagtctctcctcagctttttaattgagttagctgtggttacaatttgtgcttaaccccagattaggatctaataccttgtttgacaacgtcctgtagctttgtcctgggactcagcaataacaaggaagatctggctagtaagagagaggcacagtcaggagttagctaaactgaaaatcatatttgacattgtcacaagcccaagccaacatgaggtcttggttttagcaagatcagctaataaaggactgactcttaaagtctcccagattcaggtgggccacctgaccccagcattcagcaggcgggtctacaggtaccaagagcccagcctaaagaattcaggaggctaacttgagcaggcagagacatgtgctgggttgtgagctgtcatggaaatggttagtcaaggaaccagttcggcctaactttcacattgtaaaactgcacccttaatatctaatctgacatatggctgcagattttcagattcctctctatagtcatttaaacatagtgtcaagtctgtgtggctgtacttaatttggtcattctgtgcctgaatttaccgagcattcttcagttaccttcctcatgggacgtgttagcttttctctatcccactgtcagggagtaaaccataatccaattagtaaaggagctcgtgacttgaactacttaccttggctttaagtcttgtctggctagttagatggcaaaggtgagagctggctggggctttacatcaataaccgtacaaggtggttcatggttgttctcaggggctggaattactatgacagctcgtgcactctgctgtcatgtttgtacttagatacgattgatttagaaatgttttctgaaacagtgaataaagggaactgaaaaagtgtagggaggaatctgtaaaactggatctgtcaccaagaggaagactccaaatgcagccctgcgaggggtcagaagccttgttgctacgtgtgcctatgcactgaagcctttctggagtgcagattccattttgtttcccttactaaacagaatccacttagcttccatttagtaactcctttcacttggttgggattggattatagaagagctgtgacattgtgtttcttcacagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccaggtaagcggcacctcacctactgcacagctttcagacaaattggcctctttccttaatggataaatggtgtaattgatgatactgcatcatggtaagtactgaaaggggggtgggcaagttagcaacatgctattacccttgaagtgactttaaaacatagcatctataataaaatagttctcactgagctatagattcagaactcgtgttcaaagcctttagcccagcaatgggagagtgctaaaggcttcaagcacgagttctgaatctatggcatgttacaacacccaatctccctaattaggaaacatcccaatttattcttgactttgctaattaacactagtgacccacaggtgacaccttgctgtgttgagggagaaagtccaaggaaaggtgggaaagaacgaacatttttagtgccccccatggagtctggaggtctgagtggggaaatcgcctgcagcctttttgtctcaaaaccagcctgggtgcagccacatgtcttccaaagatctccagacctgtgttccaggaatgacttctaaaatgtgacaaggggacactaagcactcttgcaggatgcttcatccatggtcgatgggctgtaatttagaggtagtgcaattaaaggaaagaaaaagcatgacatcaaatcagtaagtggaggagcacagcaaacaacagaaactggtgatagcaaagcattcttaaagccagtagcctaataacagagtctgaggttttgttgttgaaaatcagggtggagagcagggagcaccgctgtgaagtgcacctcataggagccagccttgggcccgtgggtgtgggagctcctcgcttcaagctccctgtggctgatgcaggcgcttggggcctccaccaccaccaccatcccagaaatagcttggtttactgacatgaaggaatgacctggaatgaaaatgagctattcttttcttggtctaactttgacattgaaacacacaattttttttagcttgctcctgcacatctttctagaaggttctatgtatattgaaaagggccttaaagccagattctcactgtcattccaaaaactggcactttctgcatttctaaggaaacattttaccctttaactggagcaaagcacaagtttgattttcaaattttccctgccactacaaagtggatgcttctatttaaaaaggggaaaaaagcaaactgcatagaaaaatacctttttatcctgattaaaattccataaacaatatccagagttttttttttttaaccttcttacttatataggagtcttactcctttcttttcacacatctgtatgcctgggtgaatttcacacatcctagtaaatcttccacttcgggatgaagtatcctttcaatgcccctcttttggccttgacccaagacttgtgcattgaccttatctcttcagagacagcaaacacgagataagatgaattctacatcaagggtcacctgactttggcatgttgactctgcggaattgtttttataacagaaaagaaagtaattgtgtagcttcagactccctttcagcaacccaggactctcatgagcacacaattatttctctcgcctgagcacagaggaaggtggagaattttcaggaatgtttcaggaaagcatttgagtttctttgaggggagcattacccatagcaaaatggcatctgcattgatgacttatgtaccgctgctgctgatggtctgcacacagctgggtctcatggattcacttattgagtgtctaaatacaattactttataacgttaaaataatgtttattttaagctcatgatatctgatcaaatatataacagcgcaggcacttttattcatcctcgtgtgtactgtatgtactggatctgttagatgatacaactacatcttactgatgcacagaaccattaaaaatatgctatggaatcctggaatccagaaatcacatatgtaacttgccagtgagtctaggatgattgagcttactggccattccgccccatctccccttttctggtctctgcagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccaggtaagagcagaggtatttatcagtaagaataaaatcatttccaacatggagagagaaaatgattcataggtcagagttttatttggcttatttggtgaaatagagatgattccatcaagccccatggtttcaaggtgtttaaaacgtaggtctatagataactgcagatttaaacatgaattcagttcatgaatttaagatttcttaggaaaagtgtcttttgcagtttatcaactataatgcaatcagaagactttgctcaaaaaaatgaaaatatttggttattattaaatatgttttggttatttggttattttaatattaggttaaatgtttaggcagtgctcgctgtgtatgcactggcacacagagaaaaagcaccattctctttatgctatctttaatatacttgagaaggtagaaatgcatcattattctcctgttggagaagaggttggccctcattcaaccagcttctcatggtaaagtcagtgtgtagttgttggtgatagctgatcacttgttgcatgctcactgtgagaaggtgctatatgaatgcatagatcattgcgcatatgtccactgtgtgccttaggactgttaggtggaccagcctcttacaaataaatagtagagttgaattctataagccagttttctttgttttctttcgtctgtgcaaaagatactattttagagaaaattagcataccatacctcagtcatgtacggcacagaactataagagtggttgttattgttttcctttttaacgatagacatatttttaattcttgttgtctaacaaaaaatcagtacaggaaagaatggtgtttctagactaccgagtgatattttatcctcaggagttaaaacatgtatgagatgtggcctctctctgcatcctactgtgggtttcatgtgtggcatgccaagagcatcagtggcctcctgaagagggacttcacttgttctggagatgtccttgagctctggtgaatgggccctccctctgccgggaaggtgacaacactggctttgatggaacaagtctcagaagcaggaataccacaggagtactctgtgtgttgggcagagtggggggatccccccggcaagacaccttgtaatggaaaatgagcacattccctgctttcagcctgagagaccatagcattatctttctgtgataaatgaatcttatctctccccagtcaaggtgatttggccaaatccatatcaggttggttaaaacaagcaaagaaacaagtagaatttttctgataattaatcaagcttttgaaactttgtgtcacataacattcagaatcattagacaaacatacatgaagcatgaatgtggactgtcttctgaacaccttttacacattgtgattcgacttttctttttccagaagtatctgtggcaagatccagtagcgtagaagagaaaaggtgtggaggtacgttattccttttaagtagttgtaatggatgtactgatatattctaatcatttcccttcctgcatgttttctataatttttctgcctcttggccaagaatgaaaaaccggagaaagtcatggatcccaggcattctaccttggcataaaggcttaatagtcaatatttgatgtaccgatcggtggttctcaaaatggggtgcgtagacccacgtccagggcatggcctgggaacttgatgggaatgcagatcctcaggccccaccttgatccacagaatcaggacctcatgggaaggtcccagcagttggtggttcaattagccttgcaggtgattcttatgggttctaagctttatgaaccagtggtctcggtattcactatagttaatttcatgagtaaagtagaattcaaacaatttgtttatatttataatacaaatccatggcagctagcttccaatctccaacccactgaaatgactaaattgtaatgaggcataaggttatacctatagtgctagaggaatttttcaaacctcctgccaccctgaatgtcaaagacaacattatctggttcaagtacatgataaatttggactttacagtctgtgccttacatatacccataaagtacttgtctgtgttgtgaacatgcctggatggagaggttggctgtccagccaccaaggaacagcccatgtccgcctttcagaatccgagccaatgtctacattgagaccttaacttccacatgtgtgactgatgatgatagattcccatttgctcccctaatccgttccacagggtgtctcagagagcccagcccaacaggcattgcctctgacatgttcacatggaacctgaagcttcataggcatgtttcaggaatgtacttatcattcctaactaccattattaactaccttgattaggagcttactggctgggcatagtggctcacgcctgtaatcccagcactttgggaggccgaggcaggcagatcacgtgaggtcaggaggagttcgagatgagcctttccaacatgacgaaatgccatctgtaccaaaaaatgtaaaaattagctggcatgatggcacacacctgtagtcccagctagtggagaggctgaggcaggagactctcttgaacctgggaggtggaggttgcagtgagctgagatcgtgccactgcattccagcctgggcgacagaatgagactctgcatcaaaaataaataaataaataaataaataatagaagagctcactatctgtgacattctgtctgctcagtcagcagtctgttagttcattcattcattcagtcattcattcagtaatccttgctgaacacctgctctgtgtcagttttgtgaaggccattgagcttaggatgggcacccacgcagtcccagcccctctgacaagcaatcatatcatcagagaccccagtgcctcagaagggcaatgttaggtgtctgagctaagtcagtggagtgagttcactaactaacagttgctaacatgggatccaactacaagatgaatatgcaaacagttcacataaaaatgatcataccaattagtaccctctaatgtttttagatcactaattgtgtgctatacactgttttacatgttatagacaagaatatggtgcaaagcccatttggtcctcacaaggagcattgatgtaggcaccaagggtctacagttcttcatgtaacacctctggaaatagagaagggttttggaactcagcagcttttagatgtttgttagaagggtatgtggggcctttactctatattacgtgacacctgcacagggcctggggttgttctacaaccaatctccttaacagtgctgctgtgagatgttgaaaaaagtgaagatgctaagggtcttcctagaagttctggtcaggtctacagaaaatggttcaggtcagtgacattttaatgccagatgactgatgaagcattacttttcagagattttgcacttgggaattatagaaaaggaacagtgcttatgtatttaatctgcattttataaatggagaccatgagacttagagggatgatgtcactggcccaagtgcacacatggaattcagccagtgggatccagtgtgagttttgaacccaaagcaccgtaggaaacgagccctgacaataaaattatccaaaagcattgtgttcgggaggctcgagccacagtagccctggttaggtaacacacttggacaacacccagggtccaggactgtctgctgcctgggtccaggacagtgtaggtcaagagtggagcagagtttataagtgttcccattctcagggaggccatgcagagcctgaggctcaaacagctgatgcctcagcagagctggctaggtatttgtgcctgctgccagacgtgtgcagttcactttcctcctgctgagcctcacagttaccctgtggaagaccttcaagggccttgagaacccaggagaacctggtgcaaagcccatcaccaccctaaaatactactcctgtgtgtctgaaccagctgagatgctattggttaaatcagaggaagttgaactattctgagatattcagaatggaattttttttttagatcttcaggctgctggcactggcacaatggcataggcagtttagatgaatcttattgtagggctaatggttgaaaacagttacctagcaaggatgtttttgacaacataggcatcttcacttgtttattttttcattttgttgaaaatcaatcattgtacaggaaattattagccaattgaaccaacagggtagttggtctgtattccatctttactgatcaaaatcaacagcagaaaatcatattcaaaggaaagaactatagtaagcacattcagaacaaatttaatgggcactgctttccccatgcagaaaatcagaagaaatttaatgggcactactttccccatgcagaaaaatgtgcttcaattcaaattttttgtcttagagagctatttttagttgcatgagacacaaagactatataatcatcataaagatgtcagctggccccagcctttcccaggcacctgctggaatgattcatttgactaatgacacagtatctgcatatggagactatcatgcatcttccctatgttataatgaaacatgagttaccggtgcagcaggaagtatttccttcagaagaaggcattgaccctgagagtgctaacagctctgtcagagagagaagaagtaagaacttgtgtgaaatcagctcttgcttatctaagtatagcgtcattgttacagttaaagtcccagtggctgctggtgaaatgtcccctggatactttatctgtctgtcccaggttggcagttctccagccctagaggcttcaagacagagtcaagaaaggccaaagatgctgaaaccattgaccaactaagctggaagtgaaaagttgaggtggttgtgagtgagtgagtgagtgatcaggactgtgctgggaactgcattatccactggcacttcagtggtcaggaatgtgttgtgagttttgcctgacagtgagtcagagagaaagcagcctcccttcacagtgtccatgcacccgaaggggcagatccagctccaaagtcctgggttcctggaacacattgtctggagcagccaaggagcacagcttagagggaaaagttcagggtttagggacaaagagagatatccgacctctgccatgtatcacaggtgaggccttgatggcatctcctgactgtaggttcagcttccctggggcctatcagccactggagggttgcatgaggttcaggaaggactcaaacagagccccgtagacctaggccaggtgggcactcactgaacagtgaccctccctttgacaccaagtattagagccccgtgggtccgcattggcagggtggaatcccttccaggtagggaggatcatgagcacagggaagacagctcagaaaatccctggggaggagacagactggggtggttacgatgcacccaggctcttctcattatctccagagcctgaaaggccttgctctgcagccaggtagacttgccagcatcacagtgatgctcagcacatacctccaatcgtctcactgggtgcagggttgacaggtcagggaaaggtattagtgacactgcccctcaccctggtggtgtgtggaggagacactctggggaaagctggtgtcctcaggatgtgctctgagcaggtggcacatgaggccagtaccccatgggcagcagccacttggttctaacaacacagaggaagataacaacacagaggaagataaggccctgttttactttacccaattctcctgaagcccagtgatgtggcactgacgagatgctgccttcatttgtggaaaagcttgaaactttaatagtagtatttcaccaacatacacaaggaatatctgttgtcttttgtttgctccgacataacacaggtcttggtatggtgccttgaaatcacttgagccaatcctattttagagatataagtccatgctggcaaattttctgaatgctttgtattcataactgcaggaaaataatgagacagaagagatgccattaaataggaaaacattaggggaaaagaaggtcatttcatgaccatttaaaatatcatattttgttcatttaacacaaatcccttatttctttttagtaaaccattttcttgacaagaccttcaaaatacaacataagtgagaaaagtggtacgcaggatagtatttacaccacaccagcacacatgtgtgctgagtatctccggaagggcacgggagaaagtgcttataatagttacctctaggtataatagttacctctaggaaaggatttatttttcctgtagacccttttgtactttctaatgtgtgcatattcatactcaaaaaatataatgaaaagtgtatgtgtttatgtgaatagaaaacattttaaataggatgaaatggagagagagctaaaagcagtctggcttgcaggcgagcagtagattagaaaagtagctgcttctcccttgttttcaggacacagccctgctgcacagggaggctcaacccattgaggtgcatgaataaacttttctgcagaaaccctgtacaccatggattaggctgcacttgaagcagaacactgttgtgcaaacctttaaataataataaaaacatgcttctggtagagtattaaagtttaaggtcactccaaaagactatcattcataagagaatgaacttaaaatatcctgtgctctgccaggcacagtggctcacacctgtaatcccagcactttgagaggctgaggctggcagatcatctgaggttgggagtttgagactagcctgaccaacatggagaaaccccatctctactaaaaaatacaaaattagccaggcatggtggcacatgtctgtaatccaagctactcgggaggctgaggcaggagaatcgcttgaacccaggaggtagaggttgtgttgagctgagatcatgccattgcactccagcctgggcaacaagagtaaaactccatttcaaataataataataataataatcctgtgctccctgtgtagaagtttcttgatggccatgacatttccaatgaaagactcttaagaatgataatttccttaattttggaatggggatgaagcttttcattttgactttctcttttcatcctagtgctttgagtagctaggcaggatgttcttttcaagtgtggcatcactttgctcatgtctccctagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggtaagtgaattttaatatttctgctaagtgcctggttttccttaacacttgtagggagtattttgatgccctttctctgctgtggtggtttcctttgaaactgaattttctccctatgtgagaataagaaacatctttagtccttacgacttcaggtggctgggagaacttatgtcccaggagccacaatgtccatacttgtctcttagccatgtggcctctattctccaccacctgtatggagacacaccaattgacttttccccttggaccctgcttaaaccaagatccacaagccatgagcatctcccctcactcagatggtagatctggggaatgaagcaccaggaattaataacacgcccctcctggcctctcagaaactagctcctagagtagggaggaagcccaaagaggaacacgagctccttccatgaacaacagctttcaaaacaaacatttggatctcaagaaaggggctcctctgagcatgattccaacacatcagcttgtctctgatcactgttactatgggcatcagaaggtaatttacccagtcctgtgttcccactgaagattcagcagccacttttaagataatcagaaatgtttctctcatgaagataaaggacgttgaaggtacggacagctgtccagtctttaacgaatccttctagaacatttgtctgatactttgcccagactaaccctggacagatggccattgggcaccctccttcatcttcattttaatcctctcaatatatatgttctacctggctcagttgaagctctttgaaactgcaggtgactttaatgactattaatagaaaatggctacagtgatcaccttctaataagttcaggatgaaaagcaattaaggcatttgaaacctgaggcccttacttaaataagttccatcaaggtctccgataaatgtcctcacccatggtcatctgaaagctgcttatatatctattcagttatatgaatacgaatttagttatatatattcagttacagtcaaagtgtctgttaatttgaaatcattatagttttaggttttctagagatttagatttagattttcttacctcctgcttctcgtggtaacttcataactaaagttgaaaacttaaccagaagatatcacaaactgccaaccttattctggtaattaggcaagtcctccatggggcaaataatctggggaagcaaataaataagaaaacatattttaaaatatggagtcttagcagagagctcaaattcaacataatagtcatccttgttatattatttctgaaatgctactcagcattcttaaacctgtttttttttaatatattttccaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaataccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcctcggctggattttcatcatcagatatttcaactcatctcatcagtttcttgtaagaaaaaaacattttcactttgtagcacattttagttatttttgagtcttcttccctaatagtttgtaagcttaaagggacattttattttccctggtaaagaggattctaatatttcaagaatgtttcactggaattgatgggaaatggtttctaaatggcatcgaagctggtctttaatgagtcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccttcctgccttcttttcttctttcctttcttctttctttaattcttcctttcttcctattttcttggtacaagtggaacaaaaaccaacacatagttttaagctacacctttctgcacctgatgtaaaatgacattaatcactatttaacttctaaaattatttctgaatacagttggagataggctggttttcatgaggaagctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagtccgttcatgtcatgtggtttgggatgaaccaggggtctggccccatcgggtcacaggtgatggcaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctc

SEQ ID NO: 36752 - DNA, 87543 bp, Homo sapiens
cctcgcgcgagcggcggcggtagcggcggcagcggctgcggccaagctgggtccgagcatcccgcggctctggagccgcccggcccggacatggcgaccgtccgggcctctctgcgaggtgcgctgctccttctgctggccgtggcgggggtcgcggaggtggcagggggcctggctccgggcagtgcgggtgagtaacctccagagcaacggttcgaagctgtcgggagcggccgccacagcgctccaagatggcgcggggcagggggcgggggtgcgcgcgacccccagaccctgcccacgtccggcgaccccgggaccccaggtctcagcgctccagaggctggtgccgaggcggggcgagtgaggaactctctccgccccaagatcttctgggcggtgactcgggtttgaggccttggtctgtcacccaccgacacgggccccctcttcggcactgaccccttcgcttgcctctgctgcttgtcagaaaagggtgcgatgcccccgcccaggatcgtcgcgaggtttagatgggatttcggatacgcagccgccctaccgcggccctagttagttattgttacttgttacttgacccgcacttggttcataacgaccttggtggcggtgagcactgacggtccccacagcccgcgtggtgggtcctggactcgggcaggagacattaaaaatcagtaaaccctgtcccccgggggctggcaggcttgaggagagaaattcttgctctacaagaactaaaccaaggatggataggaaactgttaagtgcttattgattgcttcccgcttgctggccttttgagtgcacgccgactccttccgtccaaaagctctctcggtaggagatggggtacagcaggagattgaagtaactcgaattcaaggcagaaatgtccagaggaaatgaagggccatgtatgagtgcacagagggagagaggacatcgacctaggatgagtggaaagtggagtgattccccctagctgtactagacattgaaagatggctaggacgtgtgcatgcaaaagtggtgaagtgcattgcttacagggagacaggcagagacaccttaaaaaaaaaaaaaaaaaaagcaaagtcagccgggtgcggtaggctctcccctgtaatcccagcactttgggaggtggaggcgggcggatcccttgagcccaggagttcgaggccatcctgcttaacatagtgaaaccccgtttctactaaaaatacaaaaattagccgggcatggtggtgtatgcctgttgttccagctacccgcgaggctgagatacgaggattgctcgagccccgggaagttgaggctgcagtgatatgccactgccctcggaagtgagaccctgtctcaaaaaaaaatcaaagtcagttccaacaggggtattaactatagctaggtttcaaatttagctgtaaactatcccaaagaataaaagagaaaatgctgtgtattcttggctaaatcagattactttcctgggccccatttttctccctgttaaattaaaagagattgaactgaaacacttacaaaattatgaaatactagttgtccattctcctcccacaaccagtcagttctgcaggaggtagtacagtggagtggttaagaacattgagcaaattacttagctttaatctttttgtgctcaaatagccacatttattataaatggtacctcacagattttattatgagaatcgaggtaatacatgtccagcatttagcgtagtaagcagtgaaatattagctattaagtatgttcgggaaatactgcagatggtaccctgtcttataaattcacaaaacacattagattcacaataaagggtccaaggattcctgtggtaaaacaaacaaacaaacaacaaaaaaaaaaacaagaaacttttttgctgggggaatggcagtgattgctaatgagtatgaagtttcttttgggagtaatgaaaatgttctaaaattagatagtggtgatggctacacaactctgtgaatatactaaaaacaactgaattgtacatattaaaagggttaatttcatggtatacaaattgtagctcaataaagttgttaaagaaagaaacttgtttgctcataaaattctttttttcttcataacacctaaagcgcacttcagaaaatgctgggttagttgatttctaaaggcccttctaagctctaaaagttcatgacaacatatagtttgcattgtttgataaaaaaaaaaaattccaagtttgatctaaaagtgagacatgttccttatactaaattctaggaagcatgtattgcctggttccttactaaaggacattgagtaatataatggacaaaggcttccactgtgaattgtagaaagtatagaaaatgcttttcaatcctaaacagaattaagaacacaatataaaattgtatttcagtgaaggctttgcttgtattcctgctcagtcttccttcccttcttaaccgcatccaagattgggtacttctgtctgctctggtataaggctttgcaggttattgaccccctctattatacaactttgcaaatcttattaccttgattattcctattcctgggggatggaggtgtgaaagtgaaatgacttgctcaatggttttctctttggaggatgagaagggaccctatcctgcagtatcagcatcgtgtgtcatggcacctgataatggctccgtttttatttaagttgctttgtaatagtacaaaagagggaaggatataaccttaagggccaggtttcagtaagttgacatttaaggaattaggtaatagtaaacctagaatccagaagaagaaagtaatgaattttaagttagaaaaagcaaacgcctatctggagcaaagtaataagaagcagattctcttaccaaagaagtatcttggcccacactgtagaaagagctaggattggtgatagaccagatatgacagtttattctggtatgcagctgaaagtttctgtctggcatccataaatttaagcaatctttcattaataatacttttcactgtgtgccacttgtagaagaaaatgggaagaggtcaaggaggttatttttatatattataaatgtggtttttaaaagaacaaaagagatattatgaggtttgtttatccaaaaaatactatatgagtacttattatacgtcaggcactgttctaggtgcagagctgctgctccaaggagcttacattctgagaggtgatagacaataaatagataaatatgtaacaaaatgatttctaggtatgataaggatgccatgaaggaactaaaccaaatggctaacacagagaattgtgtgagtagttctttgtgtaaaagaacttcaaaagagtttataagagctgcctctttgagaaggtaaagtttagaactgagatccgaaggctgagaaggtggtgggtagtcttatgaaagacaggggtgaggtccaggaagtgcagaagccttaaggcataaggaacaaaaggttatatggttggaatgtagtgaccaacagagtatgctagggctagatggtgcagagcattgcaaaaaaccacataaggattatggattttattctgtgcacagatagaaaccaatagagttttaagtaagagtggtatgattttatttctattttagatcagtattgctgctgaatgaaaaaaattattgtagtggggtaagagtataagcaggatgactagaaggccattgcagtagttcaagcaggagataagggttgactcaagagtagagtggtgtggagataggagaggggatatttaaaatatgttgctgatggattagatgtgggaagtgagggaagaaggaattaaggattactcataggttttttttttaatcatgagcaatttaataaaagttgatgccatttactgaagtagggaagatggaggaagagcattttggaggagggttgtaaggtaaggaaaggagagaataaaaagttctatttttgtacatgtttaggatgaatattagtaataattgcactagggccattgcttattaagccaaattccatacttgtgagtaatccatttagcaaatatttattaaactattaatactgacagacactgtgataggcagaggtataaagtggtaagcaaaaataggggcttaagtttagtgggaaattcagacaggaaattcaccccaaaatgtataatacctacatggctaatattatgtggttatattagtacatacctatttatatcctaaatctgaagaatatatttgaggaaaaagcatatggtttcatcaggtatatagcacatagtatgatggatgctgtaaagcacataggtaacttgaacaagactataagtggagtattaagagatgtgttctgaccatgagataattgggagctatacttttagatcctttgtttagagatgggagccctgctgcagtggggaagggaattatctaaaaatactgactgttgaagaggacttcagaagagtcatttgctttagttgtttcataatgatcaatgtctaggttacagctcttttgactctaaggaacaaaacccaaaataagtcaggattagggggctggttatatagcatttaacaggaaatcacatggaaagccaagggtaggaaattcagcacatctctacctcagggactgctacaggaactagaaagttgacaggaaccaagactgacaggaaattagacttcccgtgtgttcttttagagacagtctttatctcacatggcttctctctgtgcatctcttccagtttcctctctccctcaatcagcttcctttttttttttttttttgcacatagtttccacaccctcataaaatgtcagcttcccagcctcagctcttcttgaccttatagctgcagagcccaccaccaactggctgcctgcctcttacctgagtatgatttagtccaatttatcttttgatttaaaaatcatatgatgttttctaaattataggtgagttaccatatgaaatatggtactgaaatagtattaatatagtgagagaaatttttttgtacttttttcctgttaaaaagacattgtataactataggatattactacttttttttttagtaggttttaggggaacaggtggtatttggttacatgaataagttctttagtggtgatttctgagattttggtgcacccatcactacagtgtacccaatgtgcagtcttttatccctcatcccccgctcactcttcccctgctgccaccgagtccccaaagtccgttgtattgttcttatgcctttgtgtcctcatagcttagctgccacttgataaatgagaacatacaatgtttggtttttcattcctgggttacttcacttagaataatggtctccaacttcatacaggttgctgcaaatgccattatttcattcctttttatggctgagtagtattccatagtgtgtgtgtgtgtgtgtgtgtgtgtgtgtgtgtgtgtgtgtacacatataccacattttctttatccaatgggcatttgggctgattccatatttttgcaattgctaattgtgctgctacacacatctaccacattttctttatccacttgttgattgatgggcatttgggctgcttccatatttttgcagttgctaattgtgctgctataagcatgcgtgtgcaagtgtctttttcatatgacttcttttcctctggataaatatctagtagtgggattactggatcaaatggtagatctacttttagttctttaaggaatctccctactgttttccatggtggttatactcatttacattcctaccagcaatgtaaaagtgttcccttttcaccacatccactcccacatctgttatttttttattttctaattatggctattcttgcatgagtaaggtggtattgcattgtggttttgatttgcatttccctggtaattagtgatgttgagcattttttcatatgtttgttggccatttgtatatcttgttttgagaactgtctattcatgtccttagcccacttttttttttttttttttttttttttttttgttgagacggagtctcgctctgttgcctaggctggagtgcatctcgtgatctcggctcactgcaagctccgcctcccgggttcacgccattctcctgcctcagcctcccgagtagctgggactacaggcgcctgccaccacgcctggctaattttttttttttttttttttttttgcgtttttagtagagacggggtttcaccatgttaaccaggatggtctcaatctcctgacctcctgatccacccgcctcggcctcccaaagtgctgggattacaggcgtgagccaccgagtccggctccttagcccactttttaatggactgtttgtttttctcttgctgatttgtctgagttccttgtagattctggatattagtcctttgtcagatgcatagtttgcaaagattttctcccactctgtgggttatctgtttactctgctgattatttcttttgctgtgcagaagctttttagtttaattaagtcccatgtatttatctttgattttgttgcttttgctttagggttctcggtcataaagtctttgcctaattcaatgtctaggtgggtttttccgatgttatcttctagaatttttacagtttcaggtcttagaattaagtcttgatcaatcttgagttgatttttgtatgacgtgagagatgagaatccagtttcattcttctacatacagtttgccaattatcccagcaccatttgttgagtaggatgccctttccccactttacgttttcatttgttttgtcgaagatcagttggctgtaagtattttgctttatttctgggttctctattctgttcctatgtgcctatttttatacaagtaccatgctgttttggtgactatagccttatagtataatttgaagcttccatttgaattttaggattgaaattcaaattttaggaactagaattgttttttctagttctgtgaagaatgatgatggtattttgatgggaattgcattgaatttgtctattgcttttggcagtatggtcattttgacaatattgattctacccatccgtgagcatgggatatgtttccatttgtttctgttgtctgtaatttccttcagcagtgttttgtagttttccttgtagaattctttcacctccttggttaggtatattcctaagtattttattttattttttttttttgcagctattataaaagaggttgagttcttgatttgattcttagagtggtcactgttggtgtatagcagtgctactgattttataccttgattttgtatcctaaaactttattgaattcgtttatcagatctgggagctttttggatgagtctttagggttttctaggtatacgatcatatgatcggcaaacagcaacagtttgacttcctctttaccaatttggatgcccttgatttctttctcttgtctatttgctctggctaggacttccattattctttattagtcagtgaatctaatttttgagctgagcactgtgctaattgtaccaagaagcttacaatcaatctggggataccaagagaacccacatgaaatgattagagaagagttaagtgttaaagtttcctactctcactagaatagtagggtcttaaataacaaaaacatcaacatggcctagagttgttggagaagaaaggcttactaagaattaagatgatagttaagccttgcaatatgtttggagtcagcaggaagtgggcatcaagcatttcaggcagaggactgcattctaggtaagtgtagattttctttgctaaaagtaatagaagtttagggaagggaaggctagagaaagactttgaaattttagaattggaatagcaggaagccattgtaggaccttgattagaagagggatgtcatgaaaggtctgttaaaaaaagtaatctggcagtcatattggtactacaattgacttaatataattggctgctgcagcagtgcaatatgaggcaagcagtggagaaggatgtatgtaacttgcaaatgattcgggaaaaaaacaaaatatgtatctatccatacatacatacagatagatatggcagtatgacaagatgttagcagtgttgaattgaggtggtgagtatgtgggtaatcctctcactatttggcgcttccttggctgactgtatactttatgcagatatacccacgtgtatatttttaaagggttaaatgtgacaatttcatgaatgtatttataagttaaagttgcagttctcatttaaatgttttttaagtgattgtcattttccaagttgttttgaaaattaaaatttgattaaaaataagattttacattaaaaaacagatttttaaattaattttttaaatttgaatgatctttttccagtatcaactcagatttagtttttttctcctgaagtgtgtaatacacactcaatgcacgtgcacacacacacatctatgtatgtatatgtgtgtgtatatatatatttatacacatacacactgttttagttgttctttagggagacattaattagagggaatcttttttttttttttttaggaaacaagaattgcttttcattaaccaactgaattatagcttttgtgagacatctgtggcaaaaatcccttttaacttcaaaaatcctataattctatggatatttcttagttttggattagggtgtgtatttgtttttttaaagctagttggctttagaagctgcgtttttctgcatgtggctggagcatgtgcttcctgcttacttgcctgtctttagtatacacatggccaaaaccagcagctgaaactcgatgtttctaattattggataattctgcttgcatattttcaggctacactaataccttcttaagcccaaaaaatgtggcctttagtaatcaatttttaatttttattttataatcacagactattggaataagaatgcaagatacgacactcatactgatgtctttaatgaagataacacctgtgttttttattttcatcatagcagtgtcaaattttattttgaatcattccatctttatctgttcaattccattttatgaaaataagcagagttttaaactattattcttgaagaatatgttaggatcaaattataaacccagaatatgtctagaattcattatcttctcttatagaaagcattaggcctgggagagttttgttttgttttgttgtattgtaatagttgaatgacccaattaatcccttttagttgctctgaaaaagataaagacccttaaatgccacattaattgcatttgaattcttctcccattgataacgaagtcatatgaatggatgtctatttgtagacatttatttcttgaaaaatatgcaacgttaaagattctaataagctttagctatttcaaaggaagaaaaatgtgtgcagatacaataatggctaagggtaagaagagagtgtagaaaatgtgacggagcagaggtcccctgtcctgttcgtggagagtggcaatgccctcaagagaagacatatgctgttacagaagaacatttggttgggaggaggaaagaagttattaccagaagactttaggcttccctctttcatcccattttgtcagaagtatcaaaaagtcttttggaaagactagaaggaatatatgccaaaatgtcaacagatgttgtggcaggacagtggaaatataatttttctttttcttcttgttttccaaatttttgaggttttttaaatgaaaaaaagaattattttaaaaatttaactttgagggatactcccctatagatttgaccttcaccatttaattggaaaaaaaggcttttatagttatatttttagtaagacctctgttagtggagttttaattataacacattttgtgtttctgtttgaaatagacctttgctccaagaaattgtttttcaaaaatccctaggtccaaatcagactcctgtctgcctgattgtttactttttgctgagcctttttctgtttattgggaccatatgttatcttgaattacctttgcttacgaccagcaggattttctgccctcacatgaactttgtgttagaggctagtagtagaaagtgccaacttctagagctcttcaaaagagcacatcagtgtcactcaggagagccttttttcctgactatcctcccagtctaatgagggtagggacatagcagagtcttaggagatggatgtagtttcgtgtggcattgcagaggagttgttataagaaagcgtcggccaggtgtggtggctcatacctgtaatcccagcactttgggaggccagggtgggcggatcacttgaggccaggagttcaagaccagcctagacaatatggcaaaaccccatctctactaaaaatacaattagccgggcatggtggtgcatgcctgtaatcccagctattaatacttgggaggctgaagcacaagaatcacttgaaggtggaggttgtagtgagccaagactgcaccactccactccagcctgggtgacagcgcaagactctcaaaaaaaacaaaaacccttatgagtgcttcggtcctcccttgtgttagcccttcatagaaagtaactacagccttactacaatcaaggcaccttttttttcttctgaaatgtagtgaaatttttatgtgtccttcagaattttgtaaaccaaatgtttagaacttcaagacatgttttgacatagaaatagtattagaaagccagtctcaaaaaaaaaaaaaaaaaggctagctaaccccacaagtcttttatgaaactgatctatagtaatatggcagtaacatcctagaccctgtcgttgttttatggaaaagtgatttccagtttaaaacttagaaacttggttggtaagatctgaagaggacttcttttattcatttgtttactcattcatttctcctcaataccaatcctacttttcaataaaaaaagttctacttttatctaatatgtatactgaagttgtacagatttcatttgaagagaggattatgttgcatacacacgcacagacacacaggttgaatatatatatatatatatatatatatatatatatgtaaaaacaggtgttttaaaccattgtaccagatctacctgcctgaaatgtagtatttttccctcctgtgtcttttgacttgccaattctagacagctgctgacaatgccaactctatcctcttttcagtcttctgcgctctacaacagttacatgcctctgatgattatcgctatagccaatttatgaattcctctggagccataatgctgcttggcaacctttttccttttctctaatttgacatttctttctctaagttgatgaagcagtgttgttttgaacacaggtttgagaaacatatttatagttgtttcctttctctattttccaaagtggctgtttcaggcctctataatttcaactcaagcccccaaccctatctcagccctatctattttcagatctaatcactatttcactgagaaaatgaggtgctgtcaatttccctgttaatttatcggtgtccttgaattctttactcttgtctagattttgtcctactaccaggtggtaacctgggtgaagttagagagcataacttttgttcactattgtatccctattcctaaacacagtgcctcttttaaaacccacatgcccttccaggaaccacctcatttctctatattctgttttacttccaactggatataatgtaattcagttctgccacccagaatcagcatctaccccgcaagttaaagggcatggtccccaacaagattgcccttaatccagacactagctttagttcaagggtccccaggccacccacacttttgaccaactggctataaatccacggttcccatgaccccctcaggttcaataatttgctagaccaactcacagaactctgggaagcactatactttaaataatggttttaatataaggggtacaattcaggaggaccagtcaaataaagagcctcatagggtgagatctaggagggaatgcagagcttctatgtcctcttatggaatcaggtgcatcatcttcccagtacatcaatgtgttcaaccaggaaagctccactgagcttctatgtccagagtattgattggggtttcattacataggcatacttgattgaattattggtcatatggttgagatcaatctgcaatcccccttcaatccctggaagttgggagatcaggttgataccatgtggctaaaagccccagctctttaaacacatggctgttctttctggtgttgccagcctccatcctgaaactatctaggtcaggggtgtctaatcttttggcttccctgggccacactggaagaattgtcttatgccacatgtaaaatacactaacactaatgcaaaaaaaaaaaaatctcgtaatgttttaagaaagtttaccaacttgtgttgaaccacattcaaagctgggcctgggccacatgcagcccatgggccaccgtttgggcaagcttgataggtgagaccatgggtcaccttgttagcataacaaagacactcctattactcgggaaattccggtgatttagagtctccctcccaggaaccagggagaaaggccagtcaaattatttattatacagtgttctacaactgctcaaaagtagacttcctcaaaagaattgtctgtattttcttgaattgtctcttgaactcactgcagtcaggcttttgccctttatttcacattgataacatttatttaaggtcatcatcaatatcttccacattgccaagtactgtgatcagtttgaaatccttattacttgatagcagtatctaacatggttaacatcttcttgaaacattttatttggctttttggacaccattctttctcttaattatcttcccatacattgaccgttctcacctgtctctgaaggagggaatgcattgctcagttctcagatcttgtccttccccagatgccatcatggctttaaatatcatctacatagtgtgtctcccaaattcccatctccagtttggagtcttcccgaactcatatattcaactccctactcagtatattattttagatatataataggcatctcaaaattatatctaaaactgaatttctgatcatctctctctctctgagatctcctcccttagtcttttccatttcagttaatggtatttctagatatttctgttttcccactttcttggaccaaaaaccttacagtcattcttaattctttttcttccatatttcacttccaatccattagcatatcctgtcagctttatattcataatatatccagattcggactacttaataccatctccactgctgccaccctagttgaagacactacagtctcttatcaagactacttcaatagcctattagtgtttcctcccttactcctgtgtattatatttttaacacaggaaccagagtggtctttttaaaatgttattctgattatgacatgctgctcaaaacccgtgggtggttttccatccttctcagagtaaaagccaaagttcttaccatggcctatagagacctgtatgatctggtccccctctctgatcgcattatgtcctactctacccttcagtcattcttttctagccacactctttgctcttctttgaacacaccagaaactttgcacttgctgtttctgccttttggaaaattcattgtggctcgttcccttactttatggtatctgcttgagtgacaccttttcagtgaagccttcctagcctgccctataaaatacccactcacttccacacacacatcctccttactctttaacttgttttattattgccataacatttaccaccatttcacattcgtattctctctctctgtctccatatatatatatgtatgtgtatatatacatatatagtttaatatctgctctttaagtttcaagagaacagacttatgtttttttgaatgaatgatcagtgcctagtacttaagctgctcataaaatttttttaagttgataaatatcttggaagaagaagtattccctgtttctttccagggatagtgccttctcataaacacttggttttatcccctttggagtcctcttgagacttgttctgtcagaggaacattagctctctactgctcttttctgtctgtaaagaaggtcaagtcttttccactctgaaaaagggagaaaaaatcttggaaccttgcatctttgtataattactactttgtttccttcccatcgttgctagacttcttatgactctatttttgatgtctgtacttactcacctgtggtttactccttaatatcattcacttctaccagttccacagaaagaacctgtgaagctcaccaagtggctaattagtaaacccatttccttttttcattcttcagtctaacttgactcttgtggtgcatgacactactcctcctgtgatgccactctcacggttaacctgcctttctgactattccatctcagtctctttcctttctttccatatctcagatgttactcttctttagaatctgatgctatgttctcttctcactagaaactctccctagacaatatcattcatttccatatactcctttatgctgatgagttccaaatttggatctttaggcttggctttacctgcactccaggcctgaatttctgagtttactggaatttccatcaggatattctataggaacctcagattcacatgctcaaaacaaaattcactatctttttatcagttgactttttattattggtttaaaaatagctctagtccatatggtaattgtaaggattagataagaaaatgcatacaacaaacttagtcaaattctgggacatagaaagcacacactaaatagtagctattattattacatgacagtctcccctattagactgcaagcttcttgaggacagggaccatgtcctcaaacctaacactgtccttgacttgtaataggtgctcagtaaaggtttgttgagttaaaattaataataataataatcatcatctactgaataaatggtttgtgtaaccatctgaattagcttagtcatcttgtttaacagtggaacaacatttgatgtttattttttctccctaggtgcattgtgttgtaatcattcaaaggataaccaaatgtgccgtgatgtatgtgaacaggtaagattacataataattacagaggcagccagacacagtggttcatgcctgtaatcccagcactttgggaggccagggtgggaggattgcttaaggccaggggttcaggaccagccaggacaacatagcaagacccctgtctctaaaaaataaaaataaaattatagaggctactagttatacaactatttattaagtataattgtttttggagaagtctgttggatagtaccttaactaattgtccagggttcacatcaccaataatggggcaaagtgactgtctgctgacatgatacactgagaaggaaaatattataattgcataatttgaattatgaagaagtagtcgggcaaacccagtttgaggaatattcctcaaaacatcagcgcctgtactctttaaaaatgtcagtgttataaaaacaaagaaaggctaagaaactgttacagattaaaggaaactaaagagatgtgacaacaaaatgcaatttgtgatcctggattggatcctggaatgaaagaaaattgctataaaggacattatcaggataaattggtaaaatttgaatatagactggatattaaatagtagtattataccaatactgtgatcctgaatttggtgattatattgtggttgggtgtgatggtgtccttgttcttaggagatacatactaggatttaggaatgaatgaacataatgtctataacaaatgctaacatagtccttcaaaataatagtatgtaataatagtttgtgtatatatacagagaattaaagcaaatgttgcaaagtgtttaggatgggtgcatcttgatgaagaccatgtaggtattcactgtgctattcttaaaagttgtctgtaggtttgaatttttctggttgaacctgtttatgaaagttccactgaagcactacccattcataaagccctacctttctttcaggcttggtcatgtatgtctagccttagcactcgagaaacaatagtctcaatcatcttttagaggagtcttcaagtaataacctggatcttgttatttttaaaactgagagaactacttaactgggactataacttctcataagcaataataatgtagacgtagaaagattttgcaagatacggtctgattataagacatgacactgattcagctcatctaaatggctaccggagaattcagtgacatgtcaaatcactattgcaaattaagtttgctgcacatttactgccagaagaatagctttttaaagcaaaaatggccccttgatgatatcataaggaagcttttaaagtagttctgctactttgggaaacatgacttacctgacttttcactttgtttcttgctttttctactgatgttctatagggtgaatgatttttaggaggtatcttgtaatgaggcaccagcagcaggcaaggtctaatttcttaaaatctggaatgctagaaattatataacttagcaaattaattgaatactatagtcaccctaataaagaacattcttccccaaccaagttcttaactaattgagaaataaggcagataggtccaaaaatattactcctattactggttacacagatgtcgaatgtgacttttatctctaggcacacactaagtgacagaattagacttactcccagaggaggagaggtaagggctgtgttacatatgtttactttcccctactaaactcaatggtcggctaagtcgccatcctgatcatgggagaagtgtatcaggggtgtggagagagaccagggctgttaaaactcgtagagctcacttcaaagagaaggaaatgctgtgagtgaggaatcattatttcttcaaccagtagggaatgcagacaggatggagtcttgatgacatttagattttgaactgagtaaacagcattcttgatgactctaggaggttagggaaaagatatggtttgaggagaaggtgagctgttgaattatcagtgaaaaccactatgtgaagatagggatttggaattaaaacttttggaattagaatttagataagaagtcagggctggtagcttatcatattcagcaaaatatgtgtgatggtttacagtgaaactgtcagcagtgtcagatgccaaagaaaagtcaaggagtttgagatctgagaaaaggcccttagtttaaaaaaaaaaaaaaaaaaagccaattagtggagattttaaaaacatctccctgcagcagggatttttgtttgctttgtttatgatgaattccgtggtgcctagaacagttaaaacagtatctaacactcaaaactctcaataaatatttgtagatcaactggagcaagggagctaaaagtcacactgcaggcattaaaaattttttaataaaaatatttacagttatgtaattttttggacttacaaaaatgtattcagtttttgtatatgtcttacctgtatatattatgaattccttgaatatagggattgtgtctcatttgcctatgttgtattcatgtccctgctcatgcaaactaattagttaatatttttgagttgattggtgaagaaatgggtacaatgaaaggaaaaagctggaaaagttagtaagtgcaggaagtaaagattagtttcaagatggaaggtttttacttgtttaaagacaaaggaaaaatgagttataacagaggaaggagataagtatgggtaaaaaacttctcagaattcaagactgtaaaccctatggtctgataatttctgccttgagtggcatacaagtttggttattaaattttttgctctgagatgatttgtataattatagtatatattctagtatgtattctgaataagcattcatctttctttttaagtgtgattactagttgtttagcaagaaaagtgactttatattcaagtctaccttattatctgaaagtttacatagtacctgctggtttatttaagctaaatgtatttctaataagtatgtgtttatcagtttaattcattctactttatgggatcataattttagagacagaagggacccaatagattatctaactttttaattttgcttattagctattcaggaaaccagaaactgggacctaaattttattttacacttttccctaagtgccatgccctttactatacccctttacatgcattatttcatttaattcttacacccagcccttgaaaaaggtattgtcattatttgtatattataggtaaagaaattgaaatatagaagacttaaataacttaccaaggtcccaagccaattagttgaggaacagggactcaaactcaaatgtgtctgattacgaagtccatacccttagccaccaggatataactacctcctatgaggccaagtagtttgcccagtggtattcagagtgtatttccaactctcagttctatattctttccattgttctaacctgtttcaagtacttgtaggttttttgccttttttgtttgtttttgttgttgttgaggggagatggaattgcaggaagaagaaatgagtgagagagcatagccttccctgtgctttttcctagtctgctaccaatgtcatatctttcgttttttcttcctctttctcttttccattctttcttatctttcattattgtctttttcaatcgatttttcttttctttcactcttccttttgtctttttataatagaaaattttaagtatatacaaaggtagagagaaaagtgtaataaacccccatattcagcttcaatattattaagtcatgaccagttgtgtttcatttaaatctccttttactttccccactatactgaggcaaatttatgtagcagcaaaatctcaattgtcatattatttgatccatagcttcagtttggagctacaaatgatatgtcatttaaaaaaaaaataaccacaatactgttattacttctttgaaaatgtaatattcaaaaatctagttattcagatttcttaattatttaaaaggtttttttagtttggatcagaattcaagtgatatatatgtattgcagttggttatatgttttttaaatatcttttgatctgtaggtttctccttgcaatttatttgatgaattaatttgatcatttgtcctatagagtttcccatagtccaaactttgctattcacatccccctggtgtcgtttaacattttcctttttcctctgtgtttcttagtaattggcagttagatttagagcagagctatccaatgacactttctacaatgatgaaaatattctagacctatatggtagccactagccacatgtgccaggtgaacacttgaaatgtgcttaaagagactgaggaactttaatttttaattttatttaattttacttgatttaagtttaaatacccacacatggctaacagctaccttagccagatccagagacttagttttgtttaagtcttcccccaaaaatgtctctttttgtgatgttaacagtcattgtgataattgtctaaatgcattaattcactaggcgttgcaaaatagtgatattctatctcttttcacttcttaattgtagttggtagttttggaggaaaatggctaataaataagctaactggagataaatcctttttcactgtccatagcattcatggattttaccgtctcagctatttgcaggtaatcatgaaggtctgtctgatatgtgtaatgatttattatttactgaaacaccaaattgtaattgcataacgtcctatttggaagtgagccatttggcttggtgagtgaacctttgtcagctcatcagcatcaattaaaaaaaaaaaaaaaagctttgtttctatcttacagcattttatggagaatttatgtgccataatgctgtttatgaatttgatcttcaccagtatcacgggtttgatgacagtctatttttcattgttaccagttgactaaaagtaattaagaacagtttagaataaacttatcttttttttcttccttctctcgctctctaacccccagcctctaaacaggttggtagcctgggtttctccactttttttggtcaatagaaaagggtctagacttgctgtatttggacttttcttgcttatttgcgaaactaatcaatgctttttaagaaatgttacctcagcttaacttagatcattctgaaggttttccacttataaaaggagccaggcacggaggctcatgcgtgtggtcccagcactttgggaggctgaggcgggcggatcgctttgagcttaggagttcaagaccagccatggcaacatggtgaaaccctgtctctacaaaaaaatacagaaattagcctggcatttgtggctcatgcccaaggtcccagctacttgggatgctgaggctggagaattgcttcagcctgggaagtggaggttacagtgagctgagatcacaccactacaccccagcctgggtgatagaatgggactctgtcttaaaaaaataaataaaataaaagaacatgaacagacacttctcaaaagaagacatttatgcagccaaaaaacacatgaaaaaatgctcaccatcactggccatcagagaaatgcaaatcaaaaccacaatgagataccatttcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagatacatgcacactatgttttttgcggcattattcacaatagcaaagacttggaaccaacccagatgtccaacaatgacagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggggactgttgtggggtggggggaggggggagggatagcactgggagatatacctaatgctagatgacgagttagtgggtgcagcgcaccagcatggcacatgtatacatatgtaactaacctgcacattgtgcacatgtaccctaaaacttaaagtataataataattaataaataaataaataaataaataaaaatttaaaaataaataaataaaataaaaaggaagttggaaaatattctagacaactgataaatctagaggataataagttttacctcttcttatttcttatagaaaaatgccacaaaaacttttttttttttgtcaaatagattttctcctcaaaaagtgaatcccgactaaaacatctgttgcagcgagccccagattattgcccagagacaatggtaagtcttattgtaacttaactgtagaagcttctgtctaaatgaaactatccaatgaattactttcagagttagcaaatttttaaatgtgattggaatttgtggtcaaaataaaatgttaagtttaacttaaatacttaaaaaaaatcttcatataaattgctagatagaatattgtttttcttcttttattatcctatgatataaatctaaaaacaatcttaaatataaatgtgttcctatctttaaatttcattatagtattttatctggggtcgggcgtggtggctgatgcctgtaatcccagcactttgggagtctgaggcgggtggattacctgaggtcaggatttcgagaccagcctggccagcatagtgaaacccgtctctactaaaaatacaaaaattagccagacatggtggcacacgcctgtagtcccagctactccagaggctgaggcaggagaattgcttgaacccaggaggcggaggttgcagtgagctgagatagcatcactgcactccagtctgggcagcagagtaagactccgtctcaaaaaaaaaaaaaaaattatctggaacttagaattttatttattattatagtttgactaattttatgaaaactataataactaaatctgtttattttgattttggaaaattgaatttgggataagggaaaatatatgacttattatcttccaattttctgacatactgtagatatattgcttacctatctgaatcatgtaactttaagaccttttaaaggtctctaatacttgggctgtcctcagtgtttgggatgctcatgtgccagaccaagaaagtgtgagtttgtttgcaagagcctctttagatatggtggcttatattatgtgaaggggaaaataagttgatgattaaatagttctgactgacacattccctttagtcttcagttttgtctataggcttggaaacagtgattccagtaagtatcctgagtaactagactcatcgttaatgctctcagatgggaaaagaacaaggaatatttctgtatctcagctttgttccccccgaatagctgattgatgtgcctgtagttctagaacattgactgtgtagacatagccataatcaaattagctgttcataatttctgtagaaattaattgtcatatttaggaactggttatctacataaaagccttttgttgggtacacttttaggttgaaatttggaattgtatgaattcatctttgccaggtaagcaataaaagtgtaacatttagcacttaattttaaaaacttactgtgtgaatgtaaaattggtgtcattgtcctggaacctaatttatactctggagtttctatcctctccttcccttcaacacctaaattttttttttctaagacacagtcttactgtgttgcccaggctggtcttgaactcctggcctcaagtgatcatcctgccttggcctcccaaaatgctgagattacaggcatgacccaccatgtccagcccaaattttcaaatacataatttattctcattcactcagtccttaactttgttctcttgtctccacttctgccattctactgaaactagtctttgaaagattaccaggatctcttggttcctagatcttcgggctctttctcagtactactctctttgactttcttgaaacacttgatattattgattactacctccttatgactccaccttggcctcagaacctattctgccttgccttttttttttgcagatggagccgtaaggactatggttatttctgtgtgtggtcttcttcccttctgtcttcacattcaccttagtaatctcattccttcccagaactgttaactaatcagctctgagaaggtgactctcaaatctaaatcattgtttgtaacttctagatatctttgtagacatctctacctggatctctgcatccaggtgccatctgaagcacaaatccaaaatcaaactcataactgcacctcttgtgaatgatactagactggaaacccccaagttatattttactccttgttctttctagttccattgactctccccttgcaaaattacacctgtcctgtctatttctagttcaagtctttattcttacactcgtgggatagaatattataataaccttataactgatgtttcaacacattatatctttctttcctatcctcttcaaaaataatttatcaggggatattcactcccatcagaataaaacccaaactctctagcctgacactcatgatctcccaggattacagcctatttgccagccctggatagagctaatttcttaaaaaaaaaagagtataccttatgtatctctgaattctagaggctatcgcactgtttaaagtttgtatttcaaactggttgcctttctgaaattgcccacctccttgcctgtctcctagttatgcttgtacccagcatccttagtatcctgtaattttctacacacacacacacacacacacacacacacacacacacacacacagttgctaacaaactgtaatctcccaaataggataaatcatatattttatttattccataatttcatagcccacataacacctaacagagtgccttgtacatagtaggaccttagtaaatataaatgctttttggataatttagtatgttctaagaggccactggatacctggaaacagcagcatacttcattatgatataacaagtcacagagtttatgacctatgttgattccatttaaaattctttccaacatgtgaggaacctgaatagcaagcagcaaagatttagaagaaactatactaggcaatgaggctagatgtgaatttgttaccctttgtacccttaagacacatagtgataagcttataatatgcagtatttttggtcaatttttataattggggtagtttattatattttgagagctttgtctatctgtgaaccatttatttgccttgttttactttttagcagaatgcttctatttgttgtgtgaagtcctagtttcatttggggaactatgttacttactgccttgaatccctgacattttttttcaaatataaataataatccaacttacttcagatatagatactcaaatttatgttttacatagaagcagcataaggcaattttaaaggagataaggaggaatttgcagcattcctgcaagcataaggcttttctcttttcataattatttcttgcatctcctacttttttttttttttttttgagatggagtttcactcttcttgcccaggctggagtgcaatggcacaatctcagctcactgcaacctctgcttcccagtttcaagcaattctcctgcctcagccttccaagtagctgggattacaggcatgcaccaccacacctggctaattttgtatttttagtggagacgaggtttcactatgttggtcagcctgatcttgaactcctgacttcaagtgatccacccacctcggcctcacaaagtgctgggattacaggtgtaagccaccacacccagtcttttgttgttgttgttgttttggttttttgtttttttgagacagagtcttgctgttgcccaggctggagtgcagtggtgcagtctcggcccactgcagcctccacctcctgggttcaagcagttctcccacctcaccctcccgagtagtttggactacaggtgtgtgccaccatgcccagctaatttttgaatttttagtagagatgggggttcaccatgttggccagactggtcttgatctcatgacctcaagtgatctgcccgctttggcctcccaaagtgctgggattacaggtgggagccactgagcctggccctatctcctacttttgccttaggattcattcactgacatttatgattgcaaaaggagtttaaaagcaaattggaagcccgggcgtggtcgcttacacctgtaatcccagcagtttgggaggtcaaggcaagcacattacctgaggtcaggagttcaagaccagcctggtcaacatggtgaaatcccatctctactaaaaatacaaaaattagccgggcatggtggcagacgcctgtagtcccagctactcaggaggctgaggcaggagaattgcttggacctgggaggcggaggttgcagtgagccaagatcgcgccactgcactccagcctgggcaacagagcaagactccatctcaaaaaaaaaattagaacactttttataattttatcatctttcagtttcacaatcatttggttggaagagtcactgctgaacatcaattgaaccagaataatacatggtcattttgccccatgattaaatgtgcccatcaaagccagatatacctgactcacaaaaattgcccctatttactaagtatcagtttttaaacaggatcatgaattttatgctattctaggtatttactgttttgaatacagtaatacttgtgccctttcttgttagtctgcttatgttaaattaaaatctttgcctctgattaacagtctaacagtaagaaagctctcttccttgctttccttcccttgtacgtcctctggtaaagatgttacctacccaagagtgagaatgacttaaagagcatttagggtgggagggaaaagagaaaaaacaaaagacctgataattatgctgtgagggactttgaaagagactgatagcagtggaagtaagggtaaagggaggtccttaataattttgaggccctgctgtctgaaccagttttcttatggacagctgctttgacttttagtagtagccttgaaacatctggcatgctatctctttttattgctacttatgaccaaaacatttaaacattttgtttttaaggtgtgtttaagaagtctgatggctgggttggcttaggctgctgtgaactggctattgccttggagtgtcgacaggcatgcaagcaggtaacactgggtagtcaggctctcaaacatcatggagtgcagtttggttttagctgtgcacatgtcttgggccttgcccacctcctagctttgcagaggtaacccgtaaaaactgcaaatttagcattttttgtatagaccatttccttttagacttgctgtttttttatttatggctgctgcatatggcctcagcctgcttttattctttcttatcattccttgtctctgccatgcaaaaaagaatattataggaatttaggtcatccatactttgcctgcaatcatgctgaatcaatgctgatgatggctgggtaaatgtaggctatgcttggatgagaacatttgacacagttggctcattttttcatctccttttctctgtttcatcatggctttaccctgagtgtgttcttatatcccttctctgctcctaagatgaatctgactcatacactgagttattacttatctttgatttgatatagttctgccccaattcagcttaggtgcctgagtttgtcctcactttgtatgttttagtagtggtttctcagagaggaaaaactagcctcttggttcctctactgcaagtggcagaaatagacttaactgggaaactagaagtggttagatggacctgaaaccacagttggaaagccttctcttattttcttcttctagggacttatctcagataagagtatatgagatatggtatcaccttcactttcacagagacgactatcctatagcctgagcaacagtctgggcagcacatgacctagctgtctgctgctgtcctccaggcattgaggtgaagctgagttgcagaggatttgaagtataatgaatttagtgagttgtaaaacagttgctggcccattcttcttcttgttctccctgtcctcatcagctggcctgttctaaattgcactggcctaggtgatagaacaggaagaatggagcaaggaaccagagctcacagctctggaatggaaactgactcatgtggaaaaacagccacccctcagcagattttttttggcttcttttatatagaaagtatatacttaaatatggcaaatagcttgctacttctctaagcaccagtttcctcatctgtagaggggttagtatcttctttataaacttgttaagagacttacacaaaaataacttgttaaatgcctggcatagtacctcttccctatttagttgccccctccgttatatactcagcaagttcagaatgaaagtttagaatgtgaagagttaaagaaaaagcaaaatgtaaatgccctggcagagcttcacaagaaaatttgctacagagtggaattcagctaaaaaaaaaaaaaaaaaaaaaaaaaaatcctctgatttacaatttccttcaaagacatctagtttctgaaataacaaaaggactgtgttgttatgtgaaattaaagccataaaagttagagcaaagctctagaatattgagtagccctacagattatgtttgttttaaagaaattgcatgaaatttgtttgttgtattttaggaaatttaaaatatttgaacataaggttttccttgatgaaataaaggatactatatcagtaattaacaaatgctaatttatgttctttttgccctgtgctgaatagcatgtataataaattaatggagaaatttgttggtttttaggcatcttcaaagaatgatatttccaaagtttgcagaaaagaatatgaggtatgcattttatttaacaaatgtggatagcctattcagatgttatcagaattaacaaaattacttaaatttttaaaatgaatttatttttatacaacttcccttttaccttacagaaaattttgcattgacaaaaatgtcatttactgtgttcggaaatgttatgattttagttgatttttgttgaaatgaagtattaattttaaagaaatgcctaaatctcacatacaaaggatttaacctataatatttttataacaaagcaactagttgtacccaaggttgtgaaatagtttttctcgtgtttcatgttctcttttgtctcatctcctatctcttgacccatccaggtggtattcatttctataaactacctctaatcataaagaaaagtaataaaagaaagaaaatcacagggctagtgtgaatagctcagactttcctagaatcttgcatttgggggaaaaaatactaagttacaaaagctatattaaatctgaaggactctcatctcaatagtgggatttctaacactggtatctagatggggtagatattaaggcaggggtatagcggaagtattttacaccatacaaatatgtgcagaagattgtgcctgatatgaaaaaacctcctcattggggctactttgttcattttctagaactctgttcttaaatgtgacaatattacagtttttgtagtgtaaggctatgtaattaaggatacttaagtgcatatatctcatgcaccatttttatatacaaacattgggattcctattgctgtgttttcttggagaaggtagaataactctcttaactacttctaggttatagtttttattttttttcttttctcaaagcctgtatctcttatttttaaacttgacagtcttatttatcttttgttcctttgtactgtttgctaagttgtatctattcctctgaagacaaatttccaaattatagctctcctccgttcttattgaaaggagccctgctacagagaagtaaaagatctttattttcttatctctctatctttgaaataaccagttttagtttctcttgaacaaagtggctaactgtgataattccttcttttctcctacatgatgtctgacactgtccatcttccatagcctgtcctccgttattttagtgtgcttccttctcttgtctggatttctgcattgccctaggaagtctgccagtatgtgttgatgaaggacaagacaggaaaggtaagagagacaaactgtcctatgatagaaatactaagaatagtttacttttcccagtctatcttccctaatttggcctagaattaagcaaccattttccaaaaatctgtatggcaaaaggatccttttgtttttatattaaaagttgatcccacaaattcttcaatataagactcaatttgatttcttacatgttatttagaaacgaaaatagagataagagtactttaatgcaggaagggttctgcattataaacctcacataacagtcactgtcatgattgttgaagtctagtctagacataaaagctatttgttataaagtgaattgggtaaatttggtgtaatatagcctattttaagtggactggttgtttatcaacatcagaataatttatgaaccaggcttttagtatcttttccttaatactggaatgatccctgggatgaacttgtagatgtatgagccatttctataggcttgcaattttaagggtagcatttaccctggagagtagttttatgtatagtttgatttgagtttcagagaatgagtaattacatttggaggagctaatgtttttcttttttggtaagctgttgtagagttccttttgaagggatttgctaagaaatttacttaaagttttaaaattttaatgccatttaagattttgtcttgttctagccaacctaagataaaccagtttaatataaagcattgttacatcagattttatagagtctggtttttttcttatgcaaattaacaagtacctgttgaatacttagagttttatatattagaaacagcattaactggaagcagacttagtttagaattctgattaagcaacttttagcataactccaaatactaaagaattatatttaattgagtcaggctaattaaaatatatactgcacacataagggctcagggaaataagaaagcagagcaagaatgtttggagttatcaggaaaaacgttgcaaatgagagaggcctgaaaggattggtataatttgggtaaagacctaaagacctaagactgtggatcaaaggtatgttatcaaaaatgcacatggcttatgcaggaggaaaagagaagacagacctattttgggctgcaagtctatgctcagataggtaaagtgggaccaaatcctaaaaagatagcattttgaggctcaactcattattaatgagagggtgatgatgaagattctgtaaaaggagaccaatatataacaaataacaaaaccaatattttagaaacttaaattcataatcctgtgcaggctaagttttagatcccacaaacccctctagcttagctaaaaagaggtaatagcttagctaataaatcccagactaggataatagtaatagagtcaaatattcaagaataaatcagagattcaaaggcagaatccatcagcaagattcgttatgatggattgaatatagatggtattcagggagataatctaatcttttaagcctagtttcctggcattcatttactattcttctatacttaaaggtactagttaaaacttctctttctggcaatagggcaggcttgctacctggaccagtcctccaggtgaaaataacttaaaatgctagatgaatttgctggaaagaaaatacggaatgctcaagccaaaaactaaatgaaggcaggaatccagagaagtaagaacagtaaagaaggcattagctttgagggcatttgctgaatcaatttttatagctttgtagcttcacgaggctcagaagtcaggagacaaatcctgggttctgattgaaggtggaaaatctaagtgaaatccccttcccttcccaccaataaatttgggattccaaagggactatacacttagtattagggtgaccaggaaatatgctcatctccctttccagggggatctgcaaggaaaactgcttctctccaacattagtcttattccattgaaaattcataaccctaagctggtcttcccatgagtttgcagcccaaatttgtatcaagtgagtgtttgtaaaacctcaagctgagaatttatttcaagtggttctgaaatggtagtggccctcagatgcttgagaaaaggtaacacagatcctctctggaggaattgatcttgtatttcagacctcttgggatttccacggataaagtcctaaggaaaaataagcagttcataataaaaaaaagtcacagaactcaccagaaaacatgatttgttaaataaaagccaacaggaacaatggtgaatagaatcagacctaaagatacttcagatatagaaatgatcagatgcagactaaaatgtttaatatgtttaagaaataaaataggcttacaaatatgaagagcaggccgggtgcggtggctcacacctgtaatcccagcacttcgggaggctgaggcgggtggatcacctgacgtcaggagtttgagaccagcttggctaacatgatgaaaccctgtctctactaaaaatacaaaaattagctgggtgtggtggtgcacacctgtaaatcccagctactcgggaggctgaagtaggagaatcacttgaacctggaggtggaggttgcaaaaaaaaaaaaaaaaaaagaagagcaagcatactttaaaaagaatcaaagagaatttccagaacagtataattgaaatacaaacacaatggatgggtgttataatagtttaggtacagcaaagaaagtaaattggaagatagaactaaagaaattatatggaaaagaaacacagaggggcatggggctgaaaaatagtttaggacacaggaaggatagagtgagaaaatcctctctaactggagtactagaagaaaaataaataggatgggcaggagcagtgtttaaagaagccctacaaatacccagcaggatcaaagggaaaaaaatccacatattatagacagacatcatagccaaagatcttaaaagtagtcagaaaaaaaggcattgccttcaaagaagaccaacgactgatttcccagtagcaacagaggaagccagaagacagtagaatgattcctaaatggttccgaaagaaagtaactatcaatctagcattctatatccagcaaaaaggtatttcaagaaaggcaaaattaagctagttctaaacagctaaaacaaaattgcattagtggagcctttctagaagttctctgtaaaggaagttctaaaatatctacttcagacagaaaattatttgagatgcaaaagagaatgtgaaaatagaaagtgggtaaattaggacacagatttttaaaacaatagtaatgtattactggattttaaaaaaataattaaaacatagtaacagtagcatttatgttgggaaaggaatttgaagaaattgaagcatatgatgtgttagggtctttacactaaaagacccatatctcagaggtgattaggaatccagactaaagatgaggagaattatcatgcccacagtcaaccttgaagtaacccttgaaccttggagtgaatgaaagctccatagaagagaaagtgtaaaaagaatagagagctgggttttgaaagagaatagaatcttttagaatctaatagaatctaaaataatccattcttttgaaaaaaaaaaaatagagagtagagagctgagtttctttagggaactagaaaagaaggagccagatactgatctgaaattgatcaaaatggaatgagatattccaaaaacagataacttcctatcactggaaatgttcaagtaaagacttactggattcatcatgtgaaggggatttttgcaacagacaggagatttgatgatctctcttccaactctgtagctctcttattctgatgaatacctaagaaataatatatccttcactacttaagagtacttcttttgagaatcacacttgttttgattgtggggtcaccagaccctggcctgtaggagctatccaaatcaaccattagcttgataactcctttatgggcatgttcaagtatcatggacttgctcagttctaggttctctgccttttcacaggctttgtcctttggcctacctaaaagtattggttaggccacatggggttcatgaatgtgttgtgaagctacaaccagagatgatattcaaagtattcagcagctgtagttacataggcaccaacagtcagaacagatgctggctgtaaaccataggaatagccatacttgtgcacattggctgattagaactaaaggaaaaatgagttcatgttttccagggggtgtgaaatacagtgtagattctttttgcatagtcttcgttcacaggttggctgtgaacattttcttctagccaccaaaattatgatttaaaaaattttttggttgttgatggttaattttctttcttgaatgtcacaataagcttcattaaggtaatatgaggctgatgaattcccagagactggcaatggctataaagtgatgagataaattttagtttgaagtttgtaaatccattttatacttttaatggcagaccttacctgccattctcttaacataatggccataaatataaatgcctttacatttgctgtgtgagccactgaagtacaatgctacaaatttgccatcatacgttttatatttttttacttgtttcttccttctttcacagattcttctctaagcttttctttatattttcagaaatgtcattttcatgtctctcctttctttgctagctttcttcaatacacttttttgatgttatatcattaaggaaggtgagaaactatgaaggaaagttagtagggggtatttttgtgaggactaacttttttttagtcttaaggcagttaagttttaaactaaacagttgccaatacaactaaaatattgttctgccatggggctctggttctgtgagaatgctaaaattaagactgttgaggattctgtcttctgttagtcccacctatcagtacacagctaaatgtatagaatggtgcaggtatgtgttaaattttaattttgggattttcacattgttcaaaattcaaaatggtatacaatgaattatgtttcccacagccatccagttcctaaagttactagagatatttgagatattttctgcatataaaagtaaatatatatatgtatagtcctcctctaccctcctttaccacaaatggtagtttactataccctttgttctgcccctggatgccagtgtttggtgtatatttatgtatgtctacccagactgtatactgtttcctcaggaaatgtcacaataaaatgttctgcttaaagatttctgtgtatctattaattttattttgtttctttttctttcaaattaactttggttctagatttactaccagaagcataaaggaaaagggatgaaaaattagcccaatttagagataagaggagcagggatatcaggaccaacaggattctctggacagctagaagcctcctaagcttcagtgtgattggatctgtactgcagtggttctaagaatagaggagaccatctagttgtggcagatcacagcctaggctatggacagttttgttccttgcccagtcagcttttagggattttaacaaaaggaatcgtgtgatactttgccccagcaaagccctcaggacctaaaagtaaagcatcttttagtttatgctgaggcaacttcaagaattgccaggatatagtaaatagaagactatgaatgagaggctttataaatggtaaaatgctgtaccggtatactgtatcacagtagatttgagccgttacctgcagctgatgagctccaaaaagagcgaaacctattaggtcctgcagtactggcttaagatagtattaaactttgtatgttgttttggtttgtcgtatttgttttgtagttgggggaagggagtaactcctatttagtctccttgctgctagtgtatttccttttccagttcattcttctcagaagtcacctgaacgagatgattccaaaagggaatttgatcaaatcagattagattgcgacctggtctcatcttaagtggccaaggttttccccttaagcaatctcatctcccatagatttaattgttcttatatgctgacaacttcagaatcttcattgctaacctttttttttttgagctcctgaacactattggatacatgtacttttgatgttcccttggaacaacaaacaatcaaaccaaaattgattgattttaaatcaaccaaattgattattactttctctaccttttctgcctccccttccctcccttccacccctaaacagcaacacacagacacacacagacacacacagacacacacacacacacacacacacacacacacacacatccatcccaaaacaaaacttatgatttttcttgcatttcttgtttggttgtaccaatatgatccttccaggcacatcaacttaaatgcctgagaggtattgtctactctttcctctttctcatcacctcctgcaaattactgtctctcaagcctaaagagttgccttctaaatgtaccttaaatcagtctccctttcagatcctcaggtattgccttagcttaggtctttctgccacttttctggatacctataatagctgccaaactagttttcctgtgtctaatttctcctcttatctactatatccacttctagattaatctctttaaagaccaaatttgatccatgtcactaccttccttaaacccttcagttgcttccctgtagaacacagctcatgctcctcagcccagtatcccaagcttttctcagtctagctcctggttcttctctctgttacatttaagcagcatgctacttatagtttcccagattgaccctgttgttttatttgttagttgtagttgtacaaattgtttgttccacctggaattccttcttctgaatcttggaacaaaaagtatagtatattggagctggcaataccagctccctaccagctagggagtactgcttgttaaatattcagggattttgcaagccagcttgtaacttaaaatcagccatgggtggaggtatttgcagcgtgaacatcagcaaatactgcaaatccagattttctccacaaccaccccccacaaaaaaagctggttccagaacatcattacctctattgaactagagtaacctttgccttaaatcctggtttaaatggtaccactttaaagcctttcctgcccattcatcttctctccacacacataaaattgatcactacttccaagccctttgcatgctttattatagcatttgtcgctctatagcataactatgtttacatgtctctttttaaactaatccctgagttcctgggacagagttcatataattatctttgtctctgtcattcattcacttaacattcattgaactgatacacactgaaccaatatatttaatatgtatcaggcattgttctcagggtacaaaaatgaaaggatttagtctgcaagaagctcatagtccatgggaagagagaaatccaaatagtccattacaatacagtgagacaagtacattgctagaatgtattggagcctggaggaaaaaaccctgcctagggaaatggggaagtctttcacagagcaggtaagacttaaaggatgagcagaaagctgttgcctgtaacaaagtgctacagtcagtacttttatagatagaaaaattttatagactttttcccactctggagaacagaattattcaaggttctttgtaacacagtatatcagctttacgtggaaactctgtgtaaatgtcttacactcttggaatgcatggagaaagtgctcattttctactgtactgtggagaatgttttcattctgagtactatctattatcccaataatgttgtatagtaaaccatcccaaaactccatagcttaaaacagtaacaatttattatttctcacaaatctaagggcttactaggcagttctgctctggccaggcttagctgattccagctgggcacactcatctgtctacaatcagatggcaggtcagcctggggctgcctgctttaggaagcccttggctaagtcagctcagatcttctccatgttttcccctccctttagcagactagctcaggcatgttcacgtggtggtggcaggagtccaagagagaaagtggaaacatgcaagtgtagttcgggcaactgcttactccaagcttgctagtgtccactaggccaaagcaaggcaagtcacatggctaaggccagagttactgtacaataaatagatataaggaaatgtgaaaaattggggccattactgtagtcagttcaccacaagcacatactctgtgctaggctgtcttctagaccttgtgtttctctgcagatgttacttgccagtgaatttgcttccagctggttgggtgccctgtggtgataatgagcaaatttttctgagcagtctagacctataaagctcatttctgttttgagtgttcatttttatttgcatatctgttgaaatgacacattatttggaaggctgaagaaatttaataatcacttgtttagtgatatttccaagtcatgacattaaactccttacatattctagtcatctatactttttgacattcatggtatccacaaggaaaaaacaccttgtagaggtttaaaaacatttatgtttttaaagaacagttatatttaacctctcctacttagcatttcataagctggatttcttctatgaaatgtgaaactttaaactggaagaaatttcaacccatctgtgaaaaggaaacagatttttatttattgaggccttagaaacaaagtagcccctttacttttaagtaatagcatagttaagtagaaagtactgggcatataaaacattaacataacagttaataaaatgtgctcttttgggtctttgtccaaaagtaactaaatcatccaaaattcaaacctgtaatttttttttacaagattcatatgatcagtgttttgttgtcatcatctttatcattgatgaaaatgagagagagctggagtagtcagtagtaaaagggcagtggacagagaaaggattgaaacaagtggacaaatggaggaatgaaccatttttttcaaatccaaaagccaaatcaaattggacagccagatatacgtagcaagcaaagggcagagccagggctagaacccggactgccctaccagtgctcttccatgacactgcgttgtgagaatagtctggtctcactgtattgcaatggactatttggatttctctcttctgaatgcacccaaagcaaggttgaatgtttgttcatagattaatctatttaaccagtttcctattttaaaaatcaatagaaaagggtcactgaagtggcagaaaataaattgcagagcgaacttctgggctagaggttggaccagcagagtctacttcccaggtgcacccaaagggtcttccccaccaaaaggaaaaccagtgtggcatgaaggatcacatagggttccctcaactttgatttactctgtttttgtgccaggtttgcccacagttcatatgctcccaacagtggatcaaagggcttgtactacctggaattccctcttcctgaatccatcctaacacacccccacctagtaatatattggagctgacatctaccagcttgggagtactaattgtcaaatattcaggaatttaatcgcgagagtagggcagggaactagttattgagagcagctaccagaggaaagattttaggatcaaaaataatttttttaggatcaaaatatttttaaggaaaataatattaacctcaagaaaatggtgaccttttttggttacaatttaaggagctgattttaaaaataggggactggttaaatagattactctgtgaacaaacattcaaccttgcattggctgcattgagaaaaacaacccagactattctcagtgcagtgtcatggaagagcactggcagggcagtctgggttccagccctggctctgccctttgcttgcttatacatatctggctctccaactagatagtgacagcttttggatttgaagttctcttgagaccctgtcaactccagtatgctgacatgttctttgcatctttgaggttatggtagatcctcacctcagcacccctatagttttgacctattcttgactaacatgagtaggggagggagagggagcagttatatgggggcacattgggtgtggtattggtaagcaggtcaaaagaggctccataggagtgaatacgaaccctcagttacctccaaaagtcagaaagttacctttcaaaagtcagatggcagacttttgaaagacttaaaaattgactagctaagacttcaagacaggctgacgtaagaaatgaagaaactattaagttaatcctataactcattatgtgtatgtcctaagccctctcagactaatcagcagtattaaagtggtaaaaagatagagttacatatagtaaatttaggagtcattcatcaaagagggagatatgatcagtctattaaatcatgataggtgtaacagaatttattcatcaaatgctggtatactggaatgaaggaacattcttttgaaccttaaaatgggtaaagaggcaagatggtattaacactaaagtgttagtggttaatggtaattttcacatgatgctgccatgtgaaaatagaaaagattagttcaacaaattcaggtaaacttaggcacaaaaggtctattaatgaacatcaagagaaataagagatgcttgaagaacatctctgaactctggatgtgacatcaagggaagcaactgtgccgttttcctttttcttcaggtattgggagactttttctgtaaggggccagacagcaaatattttaggcttggagatcattcactctctgtttattcaactttgccatagaagtgtgcttagcgtgaggtagccatataaaatatctaaataagccggcatgcacccatagtcgcaggtacttgggaggcagcagagtggaggccaacctgggcaacatagcaaaaccctgtgtcttaaaaaaaattttttaatttaaaaaagtaggtaaatgaaaaaaataattaaaattttaaaagtatgtaactgaatgggcatgtctgtcttccaataaaaactttatttccaaaaacaggtggcaggcaagatttggcttgtgtgccatagtttgccagcccctgttgtgagtaaaagctattgtccataagtatttcccctttctaggccttggcctctgacttctattaaataaggaagttggactagatgatttctcacatttcgcaggttttatctcctttagtagtacctctccctgaagctaagtgatccacaggctgaaccacagtgacatttatttgtaaagtcagttttttaaacatccaggttgaacaaatgtataagtctctagagcagagtttatcagtcttggcaccactggcattttggtctggataatcttttgcgggagggagactgtcctgtgcagtgtaggatgcttagcagtgtgcctggcctctactcaccagatgccagtagcactccccacccctcagttgtgataaccaaaaatgtctccaggcgctgccaaatgtaccatgggaagcaaaatcacccctagttgaaaaccacttctgtggaaagttcaaaaataactagaaaaatatcaaatactagaaaatcaggccatgcaacccaagatagccaccaagttatcaaacatatttattcaggtacaaggtcaaaaaaagccaaaccaaagggaacaaagatcttattagaaggaaaagagcaatgagaattgcattcatccagtcaaagagggctagaaagttggtagccgactacctttattttattttattttattatttgtttgtttgtttatttgtttatttatttatttattttgagacagagtttcgctcttgtttcccaggctggagtgtagtggcatgatctcggctcactgcaacctccgcctcccaggttcaagtgattctcttgcctcagcctcctgagtagctaggattacaggcatgcaccaccacgcccggctaattttgtattttcagtagagacagggtttctccatgtttttcaggctggtctcgaactcccgacctcaggtgatcctcccacctcggcctcccaaagtgctgggattacaggtgtgagccacctcgcccagctggtagctgactactttttaatattgatttagatcattttaaaagtgttcctgagtccagtgaatccatttaaatagagagttatctataatgcataactgaaaagtcacactaaaagaaggaaacatgaatgaagagagatataaacaagatcattgttaatgaacactaagaatatttactttttcactcctgttatattgcttgatggagtctctagcagaaagaattcatactgggtgaattgaggaacccttatctatgaggcccagggttttctgttttattttgctttaaattgttaaatcaagtgtggcatattcctacaatggaatattatttagcagagaaaatgaatgaatacagcttcacacagctacatagagggatctttgaagctaggttttaaatgccaatagctgatcctttaacaaatccccatcacctagccagcttgcaatatggctgcaattaaaagccaaaatcgtctcgtttcaacaataagggtgtgcttgatttccttctgcctgtaatttatgcccatattatttcttttaggaagtaattatcctcccattgtgattgattattattcatagctgacaagccctaaatatccaaatggctttgtataagtttttcatttttgtcttgttttgggttttattttctttacattgactttaatacagggtggtgttttctgaacaataatctaagcactctagagacactaattatagtctcaaactcgcttttgactttttctattacctggggcgggtctcttttaccctgctgaggaaacagtttcttcatctgtaaaatgatagattcccaaactctggtcccaggatggctataaaaaaactgtatttcaagtcttgtttaaaatttagatttctgtgcctcacccctagattctgaatctgtagtctagggtaaggtctaggaaactcagatgattccagtgtacagccatgtttgagaacaagtagagataatgtctaaaatcctttcaaatctaaaatgcagtggttacatgaaatatatatttccctagatgtcatttattagattattttctggaaagtttttatatcctgcaaggaataattaagattaatacattgtagcccctcccacacacttacagctttacataaacttggtttgctataactggtcagcttatggctccaagtagtcatcttgatcctgatatatgttggaagatggtttccctttttaccagaatatcatttcataacttctgtgttttcagtcttggatttagggaagaattaaatagttttaatatcatgatttccatgtaaccataaagtggaattaaattacaaattctctctggttgttaatttctgtttatttgtttttcttcaatttacagaatgctcttttcagttgcattagcagaaatgaaagtaagtatatttgtcaatggttgtacaaacagtccaaagatataattagccatctgaagcaatgtgcacagcaggattccgataggctctttcccatggtgtatttaggtcattcatgtattataacaattcccatgtcttaactgtagatctacaatgcagatactaaagctcagtgtgctagaggatgatcacaacccaataaataggcccattttcagaagttaagtacacccatgctatataatgtagcacttgccgagtgctacgtctcagttcattcaacagacgttgattgagtacttggtcagtgtggggcagacacacatctgtggaggacacgacctgtacacaaagaatgctgggatatggtaggatatgagatagtgtcactggataaagtgctccaggagttcagagaaagaagggatcatattctgcaggggtacttagaggtggcttcatggagttggtagctgatcccgggcatgaaggatgggtaagatgtgaacagtggagaatgaaggaaatggagattggaggaagggcttacaggtgaagggaacagtgagagcagacagacatgggaaaacacatgtaaggaacaaagagttctttagctcagcaggaaagtatattgaaggataataagaaacatttgctgtctgtaatttatcttctatcctttctaactgaggcttagttcaagattttccaggtagtctcaggcatgtaatcttatgtcctcccacactggtgaaaaagccagctgaatggaggaatcagaagataggcatcttgtcctgttcctatgtgtctgttcttatatgtcctcaccattccccaccaccacccccaatgtatcctcactgaggtttacagtgataaatgcagccattaatcattgttctttggccaggcgctgtggctcatgcctgtaaccccagcactttgcgaggcagagacaggtggatcacttgaggtcaggagtttgagaccagcctggccaatatggtgaaaacccatctctactaaaaatacaaaaattagctgggcatggtggcacgtgcctgtaatcccagctactagagaggctgaggcaggagaatcgcttgaacccaggaggcagaggttgcagtaagccaagatcgcgccactgcactccagccaggggacagagtgagactgtgtctcaaaaaaaaaaaaaaaaatttgttctttgtgaagaaaatgaactctttggcaataaacacaataagtttggtagtagttgcaagtttaaaagaggcggtacagtaggtatggaatagtttcctggtctgggaaactgagacttgtcctatatcagttcagtcctagttcagtttctttggttatgactttattattatcattatcattatttctggaagtcaccagaatccctgctcatgggtctttggaattcaccagaaacctgattctggttcctccatatctatccctaataattatcaagaatttcctccctgctttctctctctctctctctctctctctctctctctctccttttttctttttgagacaagatttggctgtgttgctgaggctagagtgtggtggcgagatcttggcttactgcaacctccgcctcctgggctcaaaccatccttctacctcaacctccctagtagttgggaccacaggcacatgccactgcacccagctaatttttgtattttaggtatagatggggtttcaacattttgcccaggctggtctcaaactcctggacttccaaagtactgggattatagatgtgagccacagcacccgacccccctgctttctcttaacctcttcctcccatacctctacctctcccttcagcctcccacagactcccttagattcctgtgaggggttcttgttcttctcctttacagatcccacatctgcacccccagctactcatctagctctcccaaaataccttaaatgacagcccattgattttttaaataaataaatccagagtaatatttatttcaaatgagttttcttttcagtgttgaagcaggacatatcaattgtgagatgaagtctatctcaatttaggcaaactcttacagatagatgttcaaactgtacagaacttttgggattttgtttcaagatatacagttatataaatgtcaaatttattaaatgatccttacatcacttagtttttactggccctgttttataaatgtgagggatttggggttttgttttattttggtttggtttggttttgctttgctttgtgtttataaacctctacaaatctaacacagaaagacactgcttcactggttttcaacatgggcactcttggcattttgagagacagtgtttgttgtctgagactgtcctatgcattgcaagacgtttagcagccctaaccctcatgtactaaatgccagtcgtagtccaactccttgtggggtgtgatactgttcctgtggagaaccactggactatagactgtaagttgatgattaatgactttattacactagtgagcacttgaatgtccccgtgagtatacctacagaagtgccgattttaagtgttcatcgtctgtggcatggttttatttctcaaatttagaaagacatattgttccatcattatgatgatgatttaatgttaacaaaaagctgtttccatgtcagtgccttctctttttttctccatagtgggctcggtttgttgcagttatgcaggtcatcacacaaactgccgagaatactgtcaagccatttttcgaacagactcttctcctggtccatctcagataaaagcagtggaaaattattgcgcctctattagtccacaattaatacattgtgtgaacaattatactcaatcttatccaatgaggaacccaacggatagtaagtaaaagggacatattcttctcatttcaatctttggtaaaatcgtttgtaaaaagaagtgatacgttcttgtagatatctgcagtctgggtcatttgagaaatatcagacttcctttggtatttagatttggcagattgaataatattgtcacagccaaaaggggccaagaaagatgaaactgtagagggtatgaggaaacaggaattctcaattctgagggtgggagagttcactgatatggattttttagagggaagttgggtaatgaccattaggatttcaaattatcataagcttctgatctagcagttccatttctcagaatttatctcataagaaaacttatataaatttgcaaaaataaatatatatgcatataaacaatgttcactacaatgctggtataatagagaaaaatgacaaacaacccaaacatccatcaatacagcattgattaaaattgattaagtaaattacggcatacctatagaataataacacttggcaaccaacaaaaaaaaaggacttcttacgtagaagtccaaggctgagtgtggtcgctcatgcctgtaatcccagcactttgagaagccaagacaggcagatcgttttgcgctcaggagtttgagaccagcctgggcaacatggtgaaaccccatctctacaaaaaatacagaaattagccaggttcacacgcttgtgatcccagcttcttgggaggctgaggctggagaatcacatgaacctgggaggctgaggttgcagtgagccaagatcctaccactgcactccagtctggatgacagagagagagcctgtctaaaaaaacaaaacaaaacaaaaaggccaggcacggtggctcacgcctgtaatcccagcactttgggaggctgaggtgggcagatcacctgaggtcaggagttcaagaacaacctgaccaacatgttgaaaccctgtctctactaaaaatacaaaaatcagccaggtgtggtggcacatgcctgtaatcccagctactcgggaggctgaggcaggagaattgattgaaacttggaggtggaggttgcattgagccgagattgtgccacagcactctagcctgggcaacagaccagacatcgtcaggaaggaagaaggaaggaagggatgaagggaggaagggagggagggagggaggaaggaaggaaggtaggcccgtccgagttggccagcatagtgactcacacctgtaaccttagcactgtgggaggcctagatgggaggattgcctgaggtcaaaagttcaagaccagcctggacaacatagtgagaccctatgtctccaaaaaattaaaaaattaactgggcatggtggcacatagctgtagtcctagctactggagaggtagagacaggaagatggcttgagcccaggaggtcaaggctgcagtgaattattattgtgccactgcactccagcctgggtgacagagcaaaaccctgtctctaaaaaatagtgaagtccaagatgtattaagcaaaaaaaaagtaaatcacagaactaaaaatatagtgtgatatatttttagtttatacctaattgtttcactttatatattttccacagtgtttgaattttttgccaatgagcaattattacttttgtaattaaaaagtcataacaatgagaagagagcctgatatcttttaaaaattagggcctcctgatgaagctgcacctgaaatggctcttcagagtctccgctttgtacatcctggaatccattttcttcacctagaggtgaccagatttataaaaactgactgattgaccaaactgaccaaagactgatttataagatgtcaatgttttgatttacactgtgatattgaaagaggctctgtggcttatgtctgtaatctcagcgctttgtgatgctgaggcaggagaattgcttgaggccaagagtttgagaccagcctgggtaacaaagtgagaacccagctctacaaaaaaataataataataattagctgggtgtggtgacacacccagctcctcaggaggctgatgctggaggatcgcttgagcccaagagttcaaggttgcagtgagccatcatcacttcactgcactccagccagggcaacaaagcaagaccctgcctcggggggaaaaaaaaagatgaaaagaaagaaagacttgttttttgtaactcagtagcagtactgtgtgccttgtttggccaccatctaaatcagaactctaatggcttttgacatcctttggtgtagctgtgtggtcaaaatcagaggatgaagcattgccccaataaccttcatttgttttaaaggcagatctgtgctctctgacatttagtctatacgagatactgctggagctaaggagatggcagctcaataaaaaagcagaaagaggttttaagggtagaacaaccgtctccatctttgccaatacagaggaatctggaaaagaaggcgccaaacagatatgcacagatttcttccaaagtcagagaaaactacttcaaagaagcccttctgaattctgtaatatggttgaaagtgtttttttatttctgattctttgagaaaattaaaggcagagccaaactgatatcttgtcagagttcgctactgtactatttatgttacaacttagattaattagcataagatatataaaagctttatgtggtcctggaatgtaatgaaatattgtgtctggaattggttccttccggtgggttcttggtctcgctgacttcaagagtgaagccacagaccttcgcgtgagtgttacagctcttaaaggtggcatccagagttgtttgttcctcccagtgggttcgtggtctcgctgacttcaggagtgaagccgcagaccttcgcagtgagtgttacagctcatgaaggtagtgccgacccaaagagtgagcagcaacaagatttattgtgaagagtgaaagaacaaaacttccacagcatggaaagggactggagcaggttgccactgctggctcgggtggccagcttttattcccttatttggccccgcccacatctgctgattggtccgttttacagagtgctgattggtctatttttacagagtgctgattgctacctttacaaacctttagctagccagaaaagttctccaagtccccacctgacccagaggcccagccggcttcacctctcaatatggtgtttgtgtttgttgctataaaaattagtcatttctctcatgtcaagaacataatcccttttaggtaattgtttctagcaggaaataattccagtttcatctacaataccttttctaggaatatcaaatacctctcctgtgaggacttcttaggtgtaggatggcctttcatttttgtaaggatggtgctaaagatcccatgattggagacagtggtgaattctggtaatagataccttgtccacctaaagctcctcacctttttgctacactgcaaagtaatagagaatttggtagggcctgtattctgcaaatactgacatataactaagagtagtaatggcttccactacactgccatgttctgtgctaagcagagcatgacaaaaaaagaaaaaaaaaacatgcacacatatgtttattgcagcactattcacagtagcaaagacttagaaccaacccaaatgcccatcagtgacagactgaataaagaaaatgtggcacatctacaccatggaatactatgcagccataaaaaaggatgagttcatgtcctttgcagggacatggatgaagctggaaaccatcattctcagcaaactaacacaagaacagaaaacaaaatactgcatgttctcactcataagtgggagttgaactatgagaacacatggacacagggaggggaacatcacacaccagggcctgtcagggagttgggggctaggggagggatagcattaggagaaatacctaatgtagatgacaggttgatgggttcagcaaaccaccatggcatgtgtatacctatgtaacaaatctgcacattctgcacatgtatcccagaacttaaagtacaataaaaacaaacaaaaaaaacagctaattaagccacttatattctgaaaatgtaggtttatattgctgtgacagagctgaagaccatgcttgccaaaatgcctgcaagagaatcctgatgtccaagaaaacggaaatggagattgttgatggtctcatcgagggttgtaagacccagcccttgcctcaagatcctctttggcaatgttttcttgaaagctcacaatctgttcaccctggagtcactgtacaccctcctccctctacaggcctcgatggggctaaattgcattgttgttctaaagcaaacacttcaacatgtaggttagtatttcattttcctttaccaaaatcagtagaaaatggcattttaattaatgattttaagcctagcaaacgtgtgttatattcttacgtggtataggtttagcatttagaaaatataaaatattatttcatccaacaaatgtgtattgagcattgtgtaccgtatacaaaacattgttctgtatattgagtgctaaaagctctgtgttttggggtgtggaggattagcattggcagggtagtaaatatttaagatgatgcaatagatgaattctatccttatagagatcattaagtaagcttacagtttagaagatgttttgatctgacatctaagggacattctctttattaaattatgaaactttgaactttttattatattggtggataacctgggttagcacttataaccagagttaggtggtagcatattggcattcatcttggtgatacacttagagatgaaaaattaacaatacaaatataggatgtaggaattgcagtctagagacaaaaacaaatggagatacctaagatcatggtagaacacaggtacaatagaaatgtgctttattagagatatttggggtaaaaagggaccccatgttactcggatatcctgaaatgaatataagataccaggcgtaaaacaatctttcctgtggtttctaaattggatggacctttagcaaaaaattttgcctagaatagctcatcagactttggtaattgtcaatcaaactttggcaaattttttaaaagacatgaaggtcgggcgcggtggctcatgcctgtaatcccaacacttcaggaggctgaggcaggggatcacctgagatcaggagtttgagaccagcctggccaatatggtgaaaccctgtctctactaaaaaatatacaaaatttagcggggcgtggtggcacatgcctgtaattccagctacttgagaggctgaggcagaagaatcacttggacctgggaggcagaggttgcagtgagccgagattgcgccactgcactccagcctgagtgacacagtgaagactccgtctcaaaataaattaattaattaattaaagacatgaaaaagagcgagactctgtctccaaataaataaatgaaagacgtgaaaaatctccaaagaaaattaacaaaaaggcttaaagggaaattaaattaggcttgtaattaaggaaattagattgcttgtagaagttaataaatatatttatgggaaggatgctgagtgtttctttgaatgcccacaaaaaagtttacacctacgtagagtcactagaggttggaatggccgtgttgtcccaaaagagcttcagtaaggaaggcttttccttctctctaaccttgatacagggttttatggtttgctgaaggcttgcattttcatcagatttcatcttcataaaaccttaggagataattggagaaatttatgtaatttttcttttacacttaataaactaactatgagatgttaaataacctgtccaaggcaaatacagattgaccacccttaatccaaaaatctgaaatccaaaatgctccaaaatcagaaacgttttgagtgctgacatgacaccacaagtggaaaattccacacctgacctcatgtgatgggtcacagtcaaaatgcagtcaaaactttgtatcatgcacaaaattatttaaaatactgtataagattaccttcaggctatgtgtataaggtatatatgaacataaatgaatgtcgtgtttagacttgggtcctagccccaaaatatctcattaggtatatacaagtattctaaaatccaaaaaaaatccaaaatttgggtcccaagcatttcagatgagggatacccaacctatagaaagttaaggactagccagatgcagtgactcaagcctgtaattccagggtgaggcagatggatcgcctgaggtcaagagttccagaccagcctggtcaacatggcaaaaccccatctctactaaaaatacacacacacacacacacacacacacacacacacacaaattagccaggtgtggtggcagatgcctataatctcagctgcttgggaggctgaggcactagaatcacttgaacccaggaggcagaggctgcagtcagccgagatcacgccactgcactccagactgggtgacagagtgagactctgtctctaaaaacaaaacaaaaaagaaagaaagttaaggactagaaaaaagaaagcttccagatcgaggtacctgatgtaacttgatcacagcttccttattcccataatgtgtaagcctcactgatagcagggaccttgtctgttttattcaccattgtatttccagtgctttcaacaggccctcacacaaaatagacactcaataaacattggtggggtgaatgaacaaatgtaaaagtaaagatatctttgtcataggggtaaatatgacagtcaaaatataaggtgaatgaaaatttttacttataattttgtatatttcaataatatgaaaattttattgtaaacatgtattttataaataaaatgaatatcatgtgtgagagcactttagaaatggtataaatgttttagctatatacacatacttaagttgctttgtaatcattgagtactaaaaataagaagattgtgtattacaatagtacatagaggctttggaatatcttagggaatagaaatggctttagtatagtttttcagggagaaactaatgtaccctaagtctatcatgcttcttaaaagaagtcagaggaccatgtcctagttttaccgtctgtgactgaacataaatataagggaatatatctttgcagaggcaaaaccatgtactttaagtaaaagtaaaaaagaaatcagaaagatatagggggaaataattgtgccaggaactaaggatgcacaaatactgtaattgaacattaaatttggcactgagatttctagcaaccttgacaaaaagagaaaaggtaggtgataaaagaagcctgttttccatggaaaacaatcaactttttctggctctagtttctaggaaatagtcatttggtttttttactttttttctcacatacgttccaaagtatatagttcatagagttttagttttatgcaaatcaaatatttacttggttggctcatgtcggcttctgcatttgtgctcttgtttcagggaactctgcactaaactttacagcatgagctggggcaatacacagagttggcaagagtttgatcgcttttgtgaatataatccagtggaagtgtccatgttgacctgtttagcggatgtccgggaaccttgccagttgggctgtagaaaccttacttactgtactaattttaacaacaggtaagacaaattattatacatggaatggaaatattttatcattaattataaataagtgaaataccactttattctgattttattcctgttgggttaaaagaaagtcttctttatgatttaatctttaaatgcagtattccatctggtaagccacctctgggaaaggaaacactattacaaagtcccttccaatctagagatacctcaagcttctggaattcaaagaatctcttctgccgtcagtcccctctcccttctactgtaccaccagtggaagtaattcattgtagaataaattattgtgaactatttggtcatccaaatgtccacttttaaacagtttactttaaaggaccttgagactggttgaggtttcttctctgtgagtcccctgtttcatacaaaaatatttctttacaaaagcaattcaaatagatgttttcccagggtatcaagtatcattagaaaaataaggaggcaagaactgagccttggagcatatcaacagttaatggttgaagaaaccaaagaaaacagaagagggcaccggaagcacgaaatgagagaactccatacagaagcaagagagagagagttactaaagaagaggtggctgatttataagttacaacccagaaataaagagggcaaaagggaagagaatcattcaattgggccagaaggaagttctagatatttttgtcagatggtgtttacttcaagctaacacacatcttattttttttaaagtactcagagtattacttaagagtgagaaaattgagatatctttaaaactggtgatagagtattagccagtaaagacctgatttagagattgagtacatctgaaatgtttgaaagttagactttggcacatagttctggtctggcttctggtaattgtggagtagcttgtatgagaataacagtcctaccaataccaattatgaactccgcacaaaatataaaagaacaattgttttgaaggtattggagactgatcaaaagcaggagggtctacatcttttttttttattatttttgagacagaatctcactctgtcacccaggctggagtatagtggcatgatctcggctcactgcaacctccgcctcctggattcaagcaattaattctcctgcctcagcctcccaagtagctgggattacaggcgcctgccaccacacccagctaatttttttttttttttttttttgtatttttagtagagacggggcttcaccatcttggccaggctggtttcgaacccctgatctcaagtgatctgcctgcctcagcctcccaaagtgctaggattacaggcgtgagccaccacgagtggccaacgtctcttgaaagatagaaaccacactgagcgaaagccacatttgtgcacttcttcctcataggcactttcagtttcttttcatggggagtagagttcaagcagaaagcagcagtcttggcctaaggagtgagacatcagagtttggtcctgccagagaagctagatattgaaggaaaaaaaaaatcccacaagggagggaaccacaaaaagaaatgtcccaaaatccataaacagactccttttaagtccttggctgactcctaaattgtacttttgcaggatgagactacaaggaacccaggggaaggtgaacatagactatagcagttagcatttgctgggcagacgatttagaattcagattatgccaagttagaagggcctagtaaaccccataagggccaaaccttgggagtacatacgacatccaagagctaagagtaaagctgaaaaaccttaacaaaacctgaaactgcctccagaggaaggaggtatttgtcagtaatttaactgcctgctggtgtgaaaacaacattcctccaaagaaggtaacaaaatcctaaatcccacaaagtatcatgcataatgtccattatacaatcaaaaattactagaaatgagaaaaataggaaatatgacccatagttaagagaaaaaacaatcatacccattggtgacccaactattggaattagcagataaagaatctaattatgataaatatattgaaagatctacaggtaaagatagatataggtgagatatggaagctctaaaaaaaaccacatggaaactctaaaactgagaaatgcaatatctaaaataaatttattgtagggaatggaaaatagacacagcagaagaaaaaggtcagtgacctcggagattgctcaatagaaactatctaaaccaaagcacagagaataagtgatacaacatctgtggtagtaacccagaaggaaaggaaagaaaggagcagaaaaatatttgattaaaccttggctgaaatttttccaaatgtgatcaaatacattaacccattttttgggaaaccttagtaaacgctaagtcagataaatacaaagagagacacacctagcacattatagtcaaactgttgaaaaccagaggcaaagagaaatagttaaaacaaccaaagggagaaaaaaagacactttacatatgatggaataacaataaaaatgacaagtgacttcctttcagaaacaatggagaaccaaagaccatcaagtagtatcccaagtagtatccttaaagtactcagagaaaaaaaaatcttatattcaatgaaaatattcttcaaaaataaaggtatttctagatattacaaaaaaaaacaacctcagaattttctgccagcaatctctcactacaagaaattcttcagtctgaaggaaaatgccacatgaaaactcagacctatagagcactgggattggtaaatgttggtaaacatgaaaaatattttttctttattttctttttcttttttttcttttgtattttatttttcaaaagtaattggttaaagcaaaaataataacaatgtattgtggaatttatacatagaagtaaaatatatgatatatgacagtagcaaaaaggataagagagaggtaaataattataccgttataagtttcttacattatttgtgacattgtatagtattaattcaaggaaaactataataaataatggacatatattatgcctagagcaaccactaatttaaaacacaacacaaagaggtatagctaagaagctaataggaaatataaaatggaaaactaaaataatacttgatccatccaaaagaagacagaaagaaaaaggagacaaattgaaaaccacagcaaaatgatagagacttaaacccaactgtatcaataattacataaacgtaaatgaactaaaaacatcgattgaaaggcagaggttgttagaaagacaaagactattattggagataaagagtatcaccttataatgatcaaagttcaatttatcatgaagatacaattaacctagatatatatgcacctaatgtcagatagatgcatatactcaaaatacttaaaaacagaagtaaaccctaaagagagagaaatattcaatcatattcagaaatgttaacacctctccctcactaatagaacaaatggaaaaaaatcagtgaggatatagaggatttgaacaacatatgctgggttaaaaagcaagtctcaaccgctgtcagaagatgaaaatcataaaaagtatattttctgaacacaacagaatcaaattggaaatcaataaaaataaactatattgaaatattcccaaatatttggtaattaaacaaacgcttctaaataatttatgcaacaaagaagaaatcacaaaggaaatgcttgaacctgggaggcagaggttgcagtaagccaagattgcaccaccacacttcagcctgggcaacagagcaagactctctcaaaaaataaatggaatactatgaacaactttatgccagtaaatcctgcaatttagatgaaatggatgcattccttaaaaaccaaaactaacacaagaagaagtacaagttaggattattcttataactattagagaaattgaatttgtaattataaatcttcacacaaggaaaacttctggctttactggtaatgcttaccaaacacataaggaaaaaattatgcaattattacacagaatttttcaggaagcagataacatatcccaactcctcttatgaggctagcattaccttgataccaaaaccgacatggacattaaaaacaaggtaactattgtcctgtgtcactcagagatgccaaaatcctcaataaaagattaggaaattcaattcaagtataggaaactgattttcaacaagagcagcaaggcaattcaatacaaaaataaacatcttttcagccaggcatggtggttcacccctataatcccagcagtttgggaggctgaggcagttggaatgcctgagctcaggagtttgagaccagcctgggcaacatggtgaaacaccatcaatcaaaaatacaaaatattggccaggcacggtggctcacgcctgtaatcctagcactttgggaggctgaggtgggtggatcacctgaggtcaggagttcgagaccagcctggccaacatggtgaaaccccgtctttactaaaaatacaaaaaaaaaattagccaggcatggtggcgggcacctgtaaacttgggaggctgaggcaggagaatctcttgaacctgggaggcggaggttgcagcgagctgagatcacatcattgcactccagcctgggcaacaagaatgaaactccatctcaaaaaaaaaaaaaaaaaaatttgctgggtgtagtggtgtgcatctgtagtcccggctgctcaggaggctgaggtgggaggatggcttgagcctgggaggtggaggttgcagtgagccaagatcatgccattgcactccaacctgggtgacagagtgagaccctatctcaaaaaaaaaattttaaaaggctgggcatggtggctcacgcctgtaatcctagcactttgggaggccgaggtgggtggattacctgacgtcaagagttcaagaccagcctggccaacatggtgaaacctcgtctctactaaaaatacaaaaactagccggacatggtgtcgggcacctgtaatcccagctactcaggaggctgaggcaggagaatcgcttgaacccgggaggtggaggttgcagtgagctgagattgtgccactgcactccagcctgggcaacacagcaaaaactctgtctcaaaaaaagaaaaaataaaataaaataaaataaatagaaacatcttttcaacaaataatactagaataattgaatatctttatggagggggaaaaaatgaacctcaacctgtgtttcacaccctacacaaaaaactgcttccagatggatcatagaactaaacataaaaactaaaaatttaaagctaataggagaacatcttcacaaactttgtgtgggcaaagattttgtagacaggacacaaaatatacaattttaaaagaaaaaaatgaattagacttcaaccgtaaaatcttttgtttgccaaaagacatcatttaaaacttgaagggtcaagtcatagacttgagagggaatgttcaacatatcatgcacaggtgtgtgcatacacacacacacacacacacatatttgtcaaagagcttgtgtatccagactacataaataactcctacaacatcatgataaaaagtaaaacaactcaattttaaaattatgcaaaaaaggccaggtgtggtggctcacacctgtaatctcaacactttgggaggccgaggcaggtggatcacttgaggtcaagagttcaaggccagcctggccaacatggtgaaaccccgtctctactaaaaatatttttaaaaattagctgggcgtggtggcaggcacctgtagtctcagctacttgggaggctgagacaggagaatggcttgaacctaggaggtgaaagttgcagtgagctgagatcgcgccactgcactccagcctgggcgacagaccaagactccatctcaaaaaaaaaaaaaaaaagaaaaaaattgtgcaagaaactttcaaagaccctttaccgaagaaggacatcacaatggccatttaatcaagtatatgaaaaaatgttcaacatcactaattatcagtgaaatacaaattaaaaccacaatgaactatcccttcacgtgttaaaatggctattatcaaaaagatggaagataacaattgttagcaaggatgtggagaaaagggaagtcttgtacactgttgatggaaatgtgagttagtacagccattatgggaaacagtatggggggtcctcaaaaaattaaagatagaaggtaccatatgatccagcaattccactactaggtacatatctaaaggaaaggaaatcagcgtgttgaagagatatttcactcccacattcactgcagcattatttacaatagccaagatgtagaatcaacctgtattcatcaatgaatgaatgaatggataaagaatatgtggtatatatacactgtggaatcctattcagcctttataaagaaggaaatcctgtcgtttgcaacaatatgaatgaacctggaggacactaaataaaataagccaggcacagaaagacaaatactgcacaatctcacttatatgtggaatctaaaaaaatcaaactcatggaagcagagaatagaatagtggttaccagagggtggctggaaaaggtggtgcaggaggaggagagagaagagggaggagagaggggagaggattgggaaaatgttggtcaaaggacacaaaattttatttagacaaaaggagtaagttcaagagatctgttatacaatgtggtaactatagttaacagtgagttgtatacttgaaagttgccaagagagtagatgttaaatgttcttaccacaaaaaaattataagtatgtgaggtaatgcatattttaattagcttaatttagccattccacatgtgtcatgtttaaatatattacgttgcacacaataaatatataatttttgtccatttaaaaaatttaaaagaaatagccatctagttcattaaaggcttcattattatcagtcatggcaaaatacaaattaaaatagcaattcagtgcctcctcaccctcacaagaatgcctgaaattaaaagactggtaagcatatgaagcaagtggaattcttgtagtatgttactactgggagtagaagatagtttgaggatttggagctttttttcagtttcttcaaaagttaaatctatgacctaacaattttatcctgaagcatttacccaagagacatgaaaacatatgtccaaataaagacctgtctagtacccttattcgtaatagcccaaaaaatgggggagaggaaccaaaacatctatcaggagaatgaaagaatataacattgtggtgcatccaaacaatgggatagcaatggatgaatcttacattgagaaaaaaagcccaacacaaaatacattcttgacacatgagatccaagaataggcaaatgtaatctatggtgataaagatcagaatatcctttcctctgctggaatcagggattgactagagggggcacaagggtactttatagggtgatgaaaatgttctagcccaggcatgatggctcacacctataatcccaacactttgagaggccaaggtgagcagatcgcttgggcccaggagtttgagaccagcctgggcaacatggcaaaaccttgtctctaaagaaaatacaaaaattaaccaggtgtggtggtgggtgcctgtagtcccagctacttgggaggctgaggtgggaggatcacctgagcccacaaggtcgaggctgcagtgagctgtgatcatgccactgcactccagcctgggtgacagagtgagaacctgtctcaacaacaacaacaacaacaacaacaacaacaacaacaacaacaacagtggagctttccagtggctataaaacatgtgatacaacaacagattgaatgcagaagcagatatgaaaatccacctgagttctattaagccagacattacagagatttgcaaaactgtaaaacagtcctatccttctcgctaatgtttactttggaaaatagttatttttcataaaaatacttatattaacatgtagtgggtttattataattttaaataacttgataactactttaaattttgcttaaatttttttcaacatggggtattcctttattgcccaggctggcctcgaactcctgggcttaagcaatcctcctgccacacctcctgagtagctggaactagaggcgtgccacaatttttttgtttgtttgtttttgtttttttttagtagagatgaaatcttgctatgttgcccagactggtctcaaactcctgagctcaagctatcttcctgccttggcctcccaaagtgctaggattgcaggtgtgagccactgcacccagcctagaacaggcgaaattaatctatggtgatataagtataaatagttatggcctctgagttgcagtcagtagggaggcattaactcaacagtggcacaagggaactggctgaaatgttggatgggttccttaattgatttagatgtgcttatggatgtacatatttgtcaaagcacaccaagctgtacccataaaattggtgcattttgcttttgtaaattatgttgccattttaaaaagttggcctcataatatttattttatgaaatgaaatgggatagtctggggataatagtcctgtttggagaattgtgaagttttaaactgccccacaagaatctgttaaaaagaaaacatgcaatcagagtttaatgctagtgtctacactgaatcttcatacaatcgaagctgatatcctttcatgggttgtatgtgctttcttaagaaaaccagatttttctgatgcattagtatgtcaggattttacttgttgcttctctctagaaaataattgcctcttgattctttctggccttttttctctttaggccaacagaacttttcaggagttgtaatgcacagtcagatcaaggagccatgaatgacatgaagttgtgggagaaaggaagcataaagatgccatttatcaatatacctgttcttgatattaaaaagtgccagccagagatgtggaaagcaatagcttgttcactgcagattaaaccttgtcatagtaaatctcggggaagtattatttgcaagtaagtttctttcatcctaacgattctccagctttagttcagaccctccgtgatctctagccagagcctctccatagaattttctctcttaccacttcctttgcctatcacccccgtatgtcaaatgctttcccactttttcctcctctagttgaaatactgctcccctcatcaccacctactggctgtccttgtctcctctgaaataccagacattcctgtagtcttcccagatttctccagctgaaagtaatttatccttactacagattcctatagacctttatttgtacttctcttatggaacttagttcatgaaacatttattaaatacctctgatgcacaattctatttttatatgttaatttatggacttgtcttatattctgttagactttgctcttcttcttctttttttgttttgttttgtgttttttttttgagatggagtctcactctgtcgccaggctggagtgcagtggcatgacctcagctcactgcaacctccacctcccaggttcaagcaattctcctgcctcagcctcccgagtagctgggactacacgcccagctaatgtttgtattcttagtagagatggggttttaccatgttggccaggatggcctcaatctcttgacctggtgatccacccgcctcggcctccctaagtgctgggattacaggcctgagccactgcgcccagccgactttgctcttcttaaggagcttattttgcttaggaaatcaaggatcaagtaaagataggagctgctatagtgggtgaaaccaaaagcatttaacacatagtaatctgcccattgttcttcacatatctttttttccaaaagttttccaaaaccaagttaatatccagcccctaagctgttggtatgtggctcagtgctgctggataccttaataatttcaaccttaaacagagtccagtctattctctgacatggcttcgggataacctgatggggaaatactgaggtataacaattaggtgacaagcaagaggcaacaagaggggaatatgtagactcttagcacagaaaacttgtaggagtcaaatccctattgaagaccaagaacattttaaagtagtggactttctagttgttataggccagatgctaatgttgataactaaaaagagacttagataaggaagggaaggcaaaagaggcaagcaagcaaacaagccagcataaggtcctagaagtgaggatatatgatttttgcagagagtaaatcagactagcttcatttaatttcctttcaaagatactgaaaagccacattgctggtagtaacagtacgaagaagtgtacaatttgagtaagggctttggtctcagacaacagaaagttaggggtgctttcaatttattattcaacctgagctctcctgtgactcttgttctcttttgaaacatgttaagttatgaaagcttactttctggaaagcttcagaaacaagtgatgttgactggacaacatgaggaggttcctcaagctctaaacttacgtgcatttttttttcaagatcagattgtgtggagattcttaaaaaatgtggagaccagaacaaattccctgaagaccacacagctgaaagtatttgtgagcttctgtcacctacagatgatctgaagaattgtatacctttggatacatacctcagtaagtacttttttgtatgtgtgtttttagatttcaaatacttctctcttccaactatttgttttactatttgttttggatgagcatttatctgttgagaacatgggattcaatgataccatctcaatcacagactcttgtttgcttggcctttttggcccaggaaagaattgttgttttaaaatatgtaagcagaagtgattctatcagtctgaggaggtaccaactgtggtcagtcaggaattctaagcagtgactcagggggccagcattctcagataaccagctccatatcattgctgtcttcttaccataataatgactagaaagtggaatttacccccagagactatcagccttttgtcatcagagtgtcagtggatgagagccaggaattggcttggacttactcacccaacagggtataaaaaaatgatagtctaggccaggcgtggtgactcaagcctgtaatcccagcactctgagaagctgaggcaggcggatcacgaggtcaggggatcgagaccatcctggctgacatggtgagaccccgtctctactaaaaatacaaaaaaatcagccaggcgtggtggcgggcgcctgtagtcccagctactccggaggccgaggcaggagaatggcgtgaacctgggaggcagagcttgcagtgagccaagattacaccaatgtactccaggctgggcaacagagcaagactctgtctaaaaaaaaaaaaaaaaattatagtctagcttaatatgtaaaaatggaacttatctcactgcttcagtttttctctgccaaatactcccgccaaaagctagaagagcgtgttgctatctcattgagggatcctggagctggagctcagcttcttggcagtgagacccatacatggtggaaaccaggggatgacaagtagaactcctacacacccagtagttaagggaagtgttcaggctgccaccagggggcatctgtgccatgatctggctacaaaggtagacagtgaagtcagcctttgttttcctgtgttaggtaggattaacaaaaaacagaacaaatagaagtaaagaaagcccagaaacaaatagtctagggcttcatcatcaggaatccaggctccttttatctttccccaccatccttagcatttagcttcagtcatcaagattacttaatgtactttgtcatcacaacatggctattggagttctaaccaccataatctagttccagaaggtaaaaaggaagggacagagcaaacaacttctccctagtcacactgtccatccctagttgtaaggaaaactgagaaaggttattttttaagctctgggcccattgcggccctaagtaaaattggagatcttttagtaatcagggagagaaaagtatgtgctggatttgtagctggtagatttgtagctggtagatttgtagctggtagtattcgccatattttctcaaggccaacaaactgtgtcccttaacctttgtgaccaatatagcaaaaaagagagcattagactggaatttagacctttgtgtctttgagcagatcacttctttgagcctcggcttccctatttatgaaataattaggcaaaatgagatgaactccaagggcccttatacctctgttagtcttagagtatgagtctggcctaaaatcaagtaagcaacacttattgtatttataattctagattctattacagcaggcaaatatttgtgtagaaggaaactatatcaatgggaggaaaattaaatatctctttaaatatcacacatggtttctatcaagtgagactcttccttggccatgatttccgaagttaaatataatcatggtttggagtccatacatattaccataataaattctcatttatgataaaacacgctaaattatccttcttagacatcttatttgaccaccctatccaaaatatacctgtcattttttatcccctgacactacttattacttacaattttctgacttaattatttatttatagatacacatatacatacatagcatgtgtgtgtgtgtgtgtatatatatatatatatatatatatatatatatatttttttttttttttttttttttttttttttttttttgagatggaatcttactctgttgcccaggctggagtgcagtagtgcaatctcggctcattgcagcctctgcttcccaggttcaggccattctcctgcctcagcctcccgagtagctggcacatgccaccacgcccagctaaatttgagggggggcttttttttttgagaaagagttgcactctgtctcccaagctggagtgcagtgatgtgatctcggcccactgcaacatctgcctcccgggttcaagcaattctcctgcctcagcctcctgagtagctaggattacaggcacctgccaccatgcccagctaatttttatattttagtagaaacagggtttcaccatgttggccaggctggtctcaaactcctggcctccggtgatccgcccgcctcagcctcccaaagtgctgggattacaggcgtaagccactgtgcccagctcatacatagtgtatttattgtctgtttctctactagatgtaaactctatgttagagacttgtctattttgttcatcactgtatctccagcacctagaaccttgcctggaatattgtagatcccaataaatttaaaaaaagaatgaatgtatgtttatgtgaaattcatcatttcacaaatgaaagaatctcggtgttttaatagcttggtagaatcaggccttactttacactcatgagctcttcatttattccagccataattaattcagataatttacagttttctcttactcttttaggttggttaaactaatctgttttggttttttcagggccaagtactttaggtaacattgtagaagaagtgactcatccctgtaacccaaatccttgccctgccaatgagctctgtgaagtaaaccgaaaaggatgtccatctggagatccctgtcttccatacttttgtgttcaaggtaagaggtaggtgggtgtgagaagaggatggataggtgctgctagtgtttctttataggagctatctttctttttttcaatcctgctccttctgtaatataggggttatcttcggagtgagattatgagggacttcatgttctatattatgtttttctataatgttttgagattttctcattaaacatgtattattgatgtaagcaggaaaagacagacacttgtaatcctccattgttatttaaattgtaaactaataataacagtctaaaacttgactctcgtgagttgcagggttctagactatgaaagaaaagaagctcagaccagctttttgtactttctcttctatgttgtaatgtttgaaaaaaaatactctacattgttcatgttttttctttcctttcctttagtatatagagaaatagcatattcaatagaatgtatagctatctccataaagattaatgttatgttgaaatatatataactttaagggtgaaggatttttatcccatagaattatgatagtctttatctttctgtcaatccctttagaatatagttgttgcaacattttgcttctttttatctatttcccaattgagaatgtttctttatcatgttagaatcaagattttaaaaaaggccaggcgcagtggctcacgcctgtaatcgcagcactttgggaggccaaggcgggcggatcacgaggtcaggagatcgaaaccatcctggctaacatggtgaaaccttgtctctactgaaaatacaaaatattagccgggcacggtgggcgcctgtagtcccagctactcgggaggctgaggcaggagaatggcgtgaacccgggaggcggagcttgcagtgagccaagatcgcgccactgcactccagcctgccggacagagccagactccgtctcaaaaaaaaaaaaaaaagattaaaaaaaaacgtttttttttttgagacggggtttcactcttgttacccaggctagagtgtaatggcactatcttggctcactgcaacctctacctcctgggctcaagcaattctcctgcctcagcctcccaaatagctgggattacaggcacccaccaccatgcccagctaatttttgcatttttagtagagacagcagggtttcaccatgttgtccaggctggttttgaactcctgacctcaggtgatctacctacctcagcctctcagagtgctgggattacaggtgtgagccactgcgcccggccttaaaatatttttaaagtaaaataaagcaaaagatgaaataagcatgatgtctcaaaggatcatctataatatatgtgtaatactgtaatatatcggctatagagtcataatcttgtcaaaattggaaatgtcggactgttttaaatttcaagatagtattttctgtccatttacccttacattataagttggtcagtattttctttggcaagaaaataagatatagttacttaaaatggtgacatctgtatttcatattatttaaatatataattcaattcaggggccgggcgcagtggctcacacctgtaatcccagcactttgggaggctgagacaggcagatcacgaggtcaggagatcaagaccatcctgactaacgcggtgaaactccatctctactaataatacaaaaaaaattagccgggcatggtggtgggcacctgtagtcccagatactcaggagactgaggcaggagaatggcgtgaacctgggaggtggagcttgcagtgagccgagatcgtgccactgcactccagcctgggcgacagagcgagactccgtctcaaaaaaaaaaaaaaaaaaaaaggaattcaattcagaatcctcttgtttcattaaactcagaaaacccatcatataataagatagaaaatggaaaatgggttttccataagcccacccaaatattcagtttttccttgaatttaaggtatacttgttttccatcactaaaagtttttctgaacaatattattctaaaaatactggccaggcgcggtagctcacgcctgtaatcccagcactttgggaggctgaggtaagtggatcacgaggtcaggagtttgagaccagcctggccaatatggtgtaaccccatctctactaaaaatacaaaaattagccgggtacaaaaattagctgggtgtggtggcacacgcctgtagtcccagctacttggaaggctgaggcagaagaatcacttgaacccgagaggcagaagttgcactgagccaagatcgtgccactacactccagcctgggcaacagagcaagactccgtctcaaaaaaaaaaaaaaaaaaatactgttagtttccctattctattttttaaaatatctgtgattttaaaatattttttactagcccctacaaataaaaagttacatatcttacagcactgttatactgaatgataggtcactttggggtacagatctgtaatcaccaccatcctccagaatgtggaattttaatttgagaggtatgtttttggccaatgaaccaaagcaattccttaatttggtgaaagttctattacataatctttaatagtgatttagtacctataagacttttatcaagtgtatatctaatgttataaaacaatgtcatagaacagtaccatctctctcagctaatttttgcttgtacaggttgcaaactgggagaagcttctgatttcattgtccgtcaagggacactaatccaggtgccatcatctgcaggggaagttggttgttataaaatctgttcatgtggacaaagtggactcttagaaaactgtatggaaatgcactgtatagacctccagaagtcttgtattgttggaggaaaaagaaaaagtgagtcttaagctctgattttgtttttaatatgagattagttatttttactttgtaggaagaatactggatagattctgaccacagagtaaggtctgcatatcagatactccagggcagtatttttcaaactatacagagcactaggacttctaaggaagtctttagaagtcccctcaataaggggctaatggctaataataattaatatttattgaattctaatcatgtgctaaacacaaagctaagtcttgccttacattatctcattaaatcctccaagttacactttgatataggtaataataatacctgtattacccttactgcatagatgaggaagctgatgcttaaagagttcacccagctagtaaatgaccaaagctggattctgctccaggtctagttgactccaaatcccttacgcttcacaggccaaggacacaggtaatcttcccccgaccctttcttcaggcataccccaccccaccctcacttcaccagaagtgaaactcagattttgacatcatggaaagcaagtgggtgtaggaactacactgttaggagtttggaaaaaaagtacattaaaaagtactttgaccaccttccctaaaaatcttagactccactgcttccttaaccatcttttgcttgtagccccaacaactattcatgtcaatatatgatttcaaacaattgtgaaaaaacaccactttttaggatctgttccctccccacaagctcactctgctaccccatttctactcccatcccctaccccttcaaccatagtagttcagcttttatatgctttttggtttactcttctgtgtgagatttgattagaaagaagagtgctcttggctaaaattagctctcaaatttctgccttagagcaagtcaggtatttatctctcaatccatattctgcttgactaaactatgaaggtaggtactttgtatcacagaaaatatcaggacagattcattccttctgtaacatttcactgactaaatgcctattctgtacaaaagagcatactagtgccttatggagctgaaaccgggacgggggatgagatcatgctttatgtgttaagataagagaatttgagccaaaaaaagttgcagaccaagtgctcttctgggagctgggcattcctgccagggcatcagaagagtctttgatccaaagatggcatcaggtctggccctggacagatgagctttcaaagcagaaggggcagccagaaacattcttagaggatagggagcaccctggtaagaccagcacttcaggggcttggaggaatacgataggaggcaaatatgaaaatataaatcccacagattttactctagttggtatattcagaagtcatctttcaagaatttctggctgggcacagtggctcatgcttgttatcccagaactttggtaggccgaggcaggcagatggcatgagcctaggcattcaagaccagcctggacaacatggtgaaaccctgtctctacaaaaaatacaaaaaatatccagatgtggtggtgtacacctatagtcccagttacttgggaagctgaggtgggaggatcacctgagcccgggaagcggaggttgcagtgagctgggatcacgccagtgcactccagcctgggcgatagaatgagacccttctcaaaaaaaaaaaaaggaatttccattttaaaacttgttgaactattaaaattgtaatacgtgctctatttctcaatgcatgatatagatcaacattttctttctgtttctgtcaggtcatggaacatcctttagtattgactgcaatgtctgttcttgttttgctggcaatttggtgtgctctacccgcctttgcctcagtgagcacagttcagaagatgaccgtcgtaccttcacaggtgactgtgatcgcccagagtctgtcctcaggggccatcatttctttgcacacatttttcccttcaaggcagcttctccagtcttaactgcaaatgtacacaataaaatcaatacagaatctaagggcaagatgcttttcctccctggatctcagtttcttcctctatgaattgaaggtattatactaaatggtgtcttagggcccttagcactaatattctggaatttcatgagtcaaaaagaacagagccagtgattggaatgggtttaattaaattgaacttttctacctggtagaataccccatttacccctactgctatgatctaaaatgtccatgcatgttctcagtttgtttctcagcaccttcttcctcagcctaccttagcttacttcttcatctagactcccacaaacaataatatcccagaatattactttcttgactttcctatgctttgctgctcttattattcttacaccaacataaataagtgaaaaggctagtgagatgggatgctttcctctcgtgaagctattattgccaatagcaacagcacagtctgctggtatatcttggtatctgctttttcctagatctaaaatacctttggttgtgggtaaaaagttactaggtagctgcccttgcccccatttcacactgctgcagtggcaacttgattcttctttccccagaattagtattacatgtggagaggggtgggggccgggtggaggagaagtggaggagaggagagtaaggatttaccaaccttgtacctccagcccattggaaataaaaaggggatcagaaataagaagtgaatggcacactggtaaggaagtagaggtaggacgaacactaccccagccttcactgctttattatcatcatcctttattattatcctttgccctgctcaagcaaggactattcattctgcttagagaaaccatagagggatatggggataaagaataagcaaaggatttacaaggaagactttttaaaatttttttgttaatgtctaaatgtttttagaagttgagctttacaactagcaagacccctgtttcctatagtgtgtggcccctggtgtcctgggataaattaagtcaatgactgttgatctagcagactaaggaaattttactgacccaaaactgtgccacatttcttgggacccagtgtcccactccaaatgtgactcagagaaagaagttcataacaatttgtaagtctcaaaattacagtaattttctaagttactgtcttagacatgagagtggaaggaacctacaaccttcactctttctttttgttttttctgagaaggagctttgcttttgttgcccaggctggagtgcaatggcgtgatctcggctcaccacaaactccgcctcctgggatcaagcaattctcctgcctcagcctcccaagtagctaggaacgacaggcatgcgccaccatgccattctaattttgtatttttagtagagatggggtttctccatgttggtcaggctggtctcgaactcccgacctcaggtgatccgcccacctcagcctctcaaagtgctgggattacaggcgtgagccactgtgcccagcccactctttcttatgcttggtattagcctttaacattcaagaaatccccacaccagacttcaaacatctaaattctagattttatatgccaaatcaggagaaacagtctttactttccctacctatagccttgttaataggggtctctacctgggatcaaagtctagggggccctcaactagttggcaataaaaaggacaaaggaaagccatcttgcagatgagctattcagagcattgctgcctttaaaaaccctgtcagaatacaaaaaaaaaaaaaaattagctgggcgtggtggcatgcgcctgtagtcccagctactccggaggctgaggcaggagaatggcgtgaacctgggaggcagagcttgcagtgagccaagattgcgccactgcactccagcctgggcgacacagcgagactccatctcaaaaaaaaaaaaaaaaaaaaaaccctgtcagagatcggagagaaggtttttcctgacttaatttacaattctattttaacgtgagaccttcacatgattgctcatggtttgccttaacaaggaaatataaggggagggggaatatacacatacatatttttgaggctgtttcctctcctcaggtctgccctgtaactgtgcagatcagtttgtccctgtatgtgggcagaatgggcgcacttaccccagtgcctgcattgctcgctgtgtgggcctccaagaccatcagtttgagtttggatcatgcatgtcaaaggatccatgtaatcctaatccctgccaaaaaaaccaaaggtaagtcaaatggcttcttattttattcaactgaagactagtacttacaaagcatctaccatataccagacagtgaaaacagaaaggtaaattaagaaatcgctgctgccctgaagagtttggagtctggagggaaagagagccatgtaaagctgcttgataaggtgctgcgattgggagcccagaagtagggcagttaatgcagcctggggaaggccctgggggagcctctagagattgtgatacctagctgaatctagaaagatgagtaagagattgcaggcaaggtttgcagtagagaaaaagaagtggtagtgaaggcagactaacaagagtcatggctgctggaaatgttatctccgtaacattgttatctccataacatggtgtctgttgggcactaaagcagttctgtaagactgaaacagaaaaggtaacataaggagaggtagcagaagagacaagagaaaagggtgtattcttattagtagctgtcacctgatagtcaggggaaattttcttctagttatatgcaactgttttagaaattggacatgagaaatctctggaaatgcaacttcactactatttgaaattacttgttttgagctcctttctctgctgtttcctcacttgagctcagaagacagttgccccagccttaatgatggatttctgtatggggcagccaccacggcaggcatcttgctgacccttaggttacagccttctggaagcagagtgtttattggattgcctgaatgacctgaacaatacacattccaatgccacagtgctttcctaagcaattgctgcttctccatcctgaaaaccctggtgtaatatggagggagggggagactctctcatgtgttaaaataaatggcaaagaattagtcatccatctgccaaattttatacaatgaaactaatccaagaaagtttctatggaaagaagacaggacgcaatgcataagaaataagctgaaagaataatacaggttgtgttgggaggtagaattgaggattgtcttaatattttttcatttgttttatccattggctagcctttctgaatgaggttgtcttgcttttataataaaacaataaaaataaatgtcaaagtgggaaggccttcttgagtatatacaagattgaaaaattcagctacatgaacctcaaaattttctgcatggtaacagacaaatgacacactggaaggaatatcacagagaaagcgctgatgtccttgtaatataaagagcccctgcaaatccatctgagaaagatcaacctaatatcaaaatggacagagatcaataacctaatagaaaaatggaccaaggacataaacataaaaaaagaaatccaaatggttcttaaacatttgaaaaggtacttttatttgttagggtaagtaattccagctactgtatacaaattccaaaatatcaataatttcacagagtagataattacatagagcccatttgtttcttcagcaggcggctttccatgtggtcattcagagacgtgggatccttccatatagtgacccagtcttctcctacagcctcatagtcctcttctgtgtcttctgcatctggacagcagataaaagaagggagatagtggggattgctcttaagaagctttaataggccacatctaaaagtaacattcatcactacttccaggcacattccattgtctagaactcagtccgttggccataatgaattccagggagactgggagatataatttatatacatacccaggaagaaagtgaagtgaatttgataaacatctagccaatctgccacaatgcttaaccttcttcatgttaagagaaatgtaaattaaattaaaactacaattgtgtaccactttccatctatcagactggcaaagctaaagtttgataacatggtatagggaaatagctgctttcatacaagagggagctggaggaggattggtacattctctatggagggcagtttggccaaatttgcagttttaaatgcacataccctttggattagcacatataaatgcttatccttacataaaatatatctgtagggataaataagaaagtggtagctcacacgtgtattcccagcaccttgggaagccgaggcaggcagatcgcttgagctcaggagttcgagactagcctgggcaacatggtgaaaccctttctctaccaaaaattagccagacatggtggcttccacctgtagtcccagctactcgggaggctgaggcaggagaattgcttgaacccgggagacagaggctgcagtaagccgagatggtgccactgcactccagcctgggggacagaacaagactccatctaaaaacaaaacaaaacaaaacaaaaaacactaaaagaaagaaattggtaatagtggtgcctctagggaagggaactaggtgtctaggacacaagagtagaagggaggcctatttttcactgtataccatgttgtactttttcagtttcaccatgggcttgtattatgtgttcaaaaaataattaattgtggccgggcacggtggctcatacctgtaatcccagcactttgggaggcagaggtgggtgaatcacttgaggccagaagttcaagaccagcctggccaacatggtgaaatcccatctctactaaaaatataaaaattagctgggcgtggtggcacacgcctgtaattccagctactcaggaggctgaggcagcagactctcttgaacccgggaagcagaggttgcagtaagctgagatcacgccactgccctccagcctgggtgacagagcaagactctgtctcaaataataataataataataataataattgttaagaattgtattcatccatcaagtatctactgatgttccaggcatttttctaaacattaggacataacaacaaacaagacagatcaagtctctgccctgctcacgtttacttttatttgcccccagattctcaaccttttttttatgatcctcttatttccatatactcaaattgatcaagctttttctctcaaagttaccaaatttctcctgatattcctgtttctcatccctggcatgttagtaagtaatgaagttctaaatattattttccattatttctcttcaaatattttaaatttccataaaaccataactaagtgcattgtaatttcaaaccatttcatgcatagtgacggtggtagtgattttggtgcaggttagccctaaaaagagtataaatcatttcctttgaaattaaaataacactagctactatatgcttcctcttttattttataaactaaaatttatataccttagtacttaaaatacccagtgaaagctaaacattttcatgggtcttatcttcttatagaaagttatgtaaaccctttataaaaattaggaaagcagaaaaaagcctaaagaagaaaagaatcatcatccctagcccctctgaaggagctcaggaattgagaatgaagcaaggtcctcatcttactaggaaagaccagcttcatggtggcattctctcagtcatttgcaaccagctggtatcagatcctcggtcttgtaggcacaaaaacctgaattattttaggacaaagagtgaggcctttttttttttttttttttttagacagagttttgctcttgttgcccaggctggggtgcaatggcgcgatatcagctcaccgcaaccttcgcctcctgggttcaagcgattatcctgcctcagcctcctgagtagctgggattacaggcatgcgccaccatgcctggctaattttgtatttttagtagagatggggtttctccatgttggtcaggctggtctcgactcccgacctcaggtgatccacccgcctcggccttccaaagtgctagcattacaggcgtgaggcaccgtgcccagctgaggccttttcttaaggtagactcatattagccaagctgaaagttaagcccgtggaagtgtttcatttgttactgaatgcaagggcctccagcctcaggctccagcctatctcttggcctcatatcatggcccttctgctataggtctgtctgtgcctgcttggctcctgccctctggatcacctgccatttccccagcaccacattccttgagcatcacacctgtgttcatggctgctctctcagcctggcaagcccatgctgccccctttgcccccccagcctccagctagaacactgcctcctccccatgctttcttcaggctccccagacgagaatgactcatccccgcaagctttgtgcacatcttttctactttttagcctactgtatatacaggcttgactctcccactctacataagctctttggagacaggactgtcctgattcatctcttgctctctcttcagcctcctatccctcatctagtgctttgctagccccaccacagtccctccctacattggctcatggtgctgcattcgtctttttcaggtgcatacccaaaccacaggtctgcctgacgacttttgataaatttggatgtagccagtatgagtgtgtaccaagacagctcgcgtgtgaccaggtccaagatcctgtttgtgacacagaccacatggagcacaacaatctctgcactttataccaaagaggaaaaagcctctcttacaaaggtccctgccaggtacagtgctttggctgacaaaacaaagtacactacggataaaattggtttatgatattttacagatgaatcaacagtaagaccagccgagggtcttctgtgaatcctgtcaaatctatagcacccagtcctccactaaaaaggaagactggctccttctcctaactctggaagctatcttgctagtgtgtgtacctttgcacatctggtgtacaagcaagaacagagagtggcttcttgcagtccactcctaggaaaagaacttaaaagtttcacaaccctggcatggtcaacatcattcttacttctcatagttctctgggccctcactaagaaacaaagcaggaagaatgtgagtcaaaaccaagaaaagttttcccactcttcccacatcagtcccacctcccaaggtactgaaaagtcattgaaattttctttaagacttaatgtctttttacatcagcttatctctcagttttgtaggtttatggaatctgcatttatgttttaaggaaaaaaactgggccgggcgcggtggctcacgcctgtaatcccagcactttgggaggcagaagaggtggatcacaaggtcaggagttcaagatcagcttgaccaacatggtgaaaccccatctctactaaaaatacaaaaattagctgggcatggtggcacatgcctgtaatcccagctactcaggaggctgaggcaggagaatcgcttgaacccgggaggcggaagttgcagtgagccgagatcatgccattgcactccagcctgggtgacagagcaagactccatctaaaaaaaaagaaaaaaccaaggacaattccttttgaggcttctcacatgcaccactgattttatgcttgcccctctccctggggccgtgctttgggcctagcatccgctgcccacaaccagctaacacttaaaatgattgcttcacattctctggtcttcatggttagaaaaattccatcatgatgtctccctgaaacatgcttgttttctctcagagcccctgtgccatttgcattgatcccatctaccctgaattctgtcttcccctacttgttcccttctcctggctgtgatttttctctgatctattcctgacctacctgttggctccagagtctgtctaccccactgctcccccaactcctccctctccttatcccatacccagcatgaaatgataagacctctgcatttgcatgaagattgatctggtcatcttaaagaggcgcttctgggatactaacagaagtctgagcagagcagagagaggtagcaggaaagaagatttttatctcttatcagttcacatggaataagcacccagatcccagagaggctgagaaaagtaatctttcagctcatctggagacacccatattgctgcccacgccaccaccacccccagcatttagcccacctcaggaacttaagaggtcctcataatttatacctgtgtcttttttccttcctgaaaatagggaggcatgctgtgtactcttggttgggaaaggtacaacatagacatttccaggctaaatgtgatttgtttgccctcagcccttttgcagagcaaccgagcccgtatgtgggcacaatggtgagacctacagcagtgtgtgtgctgcctactcggatcgcgtggcagtcgattactatggggactgccaggccgtcggagtcctctcagagcacagctccgtcgccgagtgtgcttctgtcaagtgtccttcgctcttggcagctggatgcaaacccatcatcccaccgggtaggctggcagtatcggggtggacaggggaggactgagaagatttgcttatccacctccagagagtgagtcattgagaagagagctcatttacgtttttcagaaagtcttgaagagattcttatgctgatcatactcactactttgggttgaccttaaaaaactagggcttgccttcgatatcatctggtgtcctgctattttaaaacaatacagcagccttttctcaagctaaatcttacaccagacaccaatatataaacagataaagcagtattcaattatgaaaattagggttattaaatgcataatgtttacttattacaaagttaacaaataacgaattactaattaatgaataattaaagtagttttgatgaacacaaacttttgaaattgagagaaatagaagatagttgttgtcttagattggccttaacatctaatttaattgttttagttgcatataatcagaaaagttttgtttcatacagactgtttttagcaataacagttttttaaaacagcttaccttacaatctcacactcttagtcaaacagaagtagcagaagagactttattccaagtctgcacagaacaggttaatctggatctaacaggttcattcctccatccgttaattcatcaaatgtttatttagctttcactatgtgccagacgctcctctaagcactggggacacagcagtgagaaaaacaaagcccttttccttctggagaccatgttctgagggaggtgacagaccaaacataagttgccatgcaaatctgcactaaaccagatggcagcaagtacgatgacacgaaatgaaggggaatcggaggggcccagggcagagaggctgctaatggattggttaaatctctgtcgtgtgaaaatacggcataatattatatttgattatgccatattctgttatgggttttagcagtttaaaataatttttaaaattaaatttgaatcggtcgggcgtggtggctcacgcctgtaatcccagcactttgggaggccgaggcaggcggatcacgagatcaggagatcgaaaccatcctgactaacacggtgaaaccctgtctctactaaaaatacaaaaaaattagccgggcatggtggcgggcacctgtagtcccagctactctggaggctgaggcaggagaatggcatgaacccgggaggcggagcttgcagtgagccgagatcgcgccactgcactctagcctgggcaacagagcgagactctgtctcaaaaaaaaaaaaaattaaatttgaatcaaacactcatggaacccctgaaacaccaactcccttattttgcagacagggaaacaaggcctggcagaagcatttgcccagaatcacacagtgagttttgaggcagagcaggatcaggccccaggtctcttgaaaagccagctgtctctatgctatctgcaccacagccttctcactccaaggagtggtgaaggatgaaaagcaggggtagagaaaggattttggtaaatgtagagatgagaggactccaggttggtcaaggagcttatatgaaggtacagtctttgggaaggacactgtaactctcctgcccaaaatgaagggctggacatttcactaaggattttaaattctctttgtttctaattctgaacgcacataaaatggtttctgttatacaggtgcttgttgcccattatgtgctgggatgttaagagttttatttgacaaagaaaaactggatactattgctaaggtaaattgctttatattcagatgctattgaaatcttattgctaagcctctcagtaatcctagagagtagaatgtgttgtcctcattcatagataaagaaactaatcttcagaaaagcaactttcccagggccatatagcccttaatcagtaggacgagggtttgcacccaggctggctgactcccaagcccatgttcctcccccctacaccctggctgtgcacatcacagtcagcgtgagcctttcttagaaaaggcccctgctggcacagtaagcataggtggggctgcaggcagagccaggtagccagagactggtgggtgcccaggtgcttttgaggtcgcctcccctcacaccagtccccgtgcctcctgaggggatcttctggagccctgcccgttccctgcatagttctgccctctctcttttctgcaccatcacagggctccagaaatgttgcacccaacacttgccacaacctagagatttagccccattttgattacaaacacctgtatttttaaaaaccctgtgacctctacctcagaacagtcactttttgcaaaagtggttctggtgaaagtatgtatcttcactacagagtttctcagtcaggcaaaaccccattgtgatggactggagattcagaatttggcctagcaaagctgcggttgggccttccgctgagggctgtgcggtcaaaagagcctcctcagctggcagcccaaagcaagggagcttaggcagtcataggaattcttctttttttcaggtaatacatgttttctctttccaggtaacaaataaaaagccaataacagttctggaaatacttcagaaaatccgcatgcacgtgtctgtcccacagtgtgatgtgtttggatacttcagcattgaatcagaaattgtgatcctgatcattcccgtcgatcactatccaaaagctctgcaggtgagttcagcacatgttgtgaagccatcttgtcactttcaagtttggtgcacctaggagggagtgggcacaaactaggaccgaggaaggatccgtgggtgagggagtggaggcatttgggaagttcagcgggacaggagggagaaaagcaaggcaatctctaaaggactgagcactttgccagtggctgagacctggtgcacatttgacagtgggatgcagaggcaccagggcaggggagggattaagatactgtgactgggagtgtgcacagctggaaggggtccgagaaatcactgtctctaatccacccattgtacagacgaggcagctgatgcccaagccggggaaggaactggtgcaggtcatgcagtgataaagccagaaaagactccagtctcctgagagctgtgtgcccactgtggaggaagatcccatcagagctggtcatgtgggctctagtgtttctttgtcagtctggagacatgtagaaccccactcacgtagacccaagtttcaacatcaaaggcagtgagggctcaagggaagggaacgaaggcaagcagtctgtgaatcactaggaagttcatctcgtcgttgttttccttttcatgtttcaatggacattaaaattgtattctgtgtgaccctaactaaccatgtaaggataaagtctaaatgtgggtaagaggtgtgggtaacaggtgtggaaaaatgaaaacagttgattgattagggcagtggcattgtggattatttcttgtctttctcttttcttttttcttcttttcttttctttgagatgggatcttgctacattgcccaggctggtctcgaactcctgggctcaagctaccctcccaccttggcctcccagagtgctaggattacaggcatgagccacaacacatggccaattatttcttttctggtttgatttccattaatgctgctatatttatgtaataaactaaaactataataaaatgttactttggataagaacagaaggacaaagagaaagtaaatgccctctgaggccacgctacttttaggatatacgtggaatttgtctggcttgatgttgaaaacgttctgtggttttatattaagggaaccttgtttctcctcacagattgaagcctgcaataaagaagcagagaagattgagtcccttatcaactctgacagcccgactttggcgtcccatgtccctctctctgccctcatcatttcccaggtacaggtctccagcagtgtgccatcggccggtgtcagggccaggccttcttgccactccctcctccttcccctcagcttgggccttgccttgcacttgctctggacatataactgactgcccacggaaagtgcagaatgctcctccacctcactctcctgccttgaaaaagacattcaggactgctggtttgtagttgaatattggccaaggaaaggcacatgtcacctctattcgccacacagtatttttttttttaatccgccaatattagtaggatttttgttttgtttttacaaatgttaaaatgtgttgttccaaatactaatgaaaacagaatgtctcttcctggtagaccactgccatatgatttacatttcctcaccataagggtcccccactctaaagcaaatttatcgctgggaaatgagatgaccactttttagaaagataattcactgtactatcaggttcacaaacttcatttcagagttctttttgaagtatttaaggttcccgttgcatttgttttgtttacagataattacctactctggctagaagctaggggtcccagtgaagagccactgccattaaagaatatgaaacatagataaaacatctttgaaattatgtaaattatgtaaattatcaggcaaatttgcattaaattacagaaatttaattcagaaccccaactactgtgttatgcaaaagcaagctgattaaatgacactcatataattatatgttgtaagcaacaggctcactggtcacggatttgtgtctgtgacttttgtgaaagggagaagtgacattgcatcaaagcatcttgcattatgcaatttttatattaaccagatatatattcatcggtattcatccaagttaaatgtagagtttttaaacatcaatctttaaaccaattgctgctacttatataattgccaaaaagtgaaataatgtgtagttcatgtaaataatacattatatttctattttattatgaagaaggtgaatagccatatttgtaaaatgacaatcatgtgtgttaacccagtgctttccattcgtgaaaacacatttgctttttgtgatatgcacaatgtagataagtgttctgtctgactttcttttttgatatagaagtataaagaattgtggtttatatatttaaaagtgtcaagctgagtattaaaatgtatgcatgttgtctaagaaattgaatactttgaatgtgtttcacagtttgaaataagctatttgatgtaatacttcttgtgtgtatgcacatgaacttagattttacatgaagtattttttcagtattatatgtaccctctgaaatacatagggatatgcgtattataccaaaatgttgctgaaaaatgggcacttaaagctttcagaatatgtcagtgctgatgtagcatgcttgttgcaattgccttttttctgtataaatgtctttaatgcaatatactggaaagcttttctattttaataaaaataatttttatatg

SEQ ID NO: 36753 - DNA, 26018 bp, Homo sapiens
ggccgctaggggtgcggggttggggaggaggccgctagtctacgcctgtggagccgatactcagccctctgcgaccatggctgtgctggcggcacttctgcgcagcggcgcccgcagccgcagccccctgctccggaggctggtgcaggtgagcggggttcgtccccacagcactcagacccgggatgcgaggagtccccgcctcggaagcttccagcccgcggccgttgcggctcccgcggcccgggcgcgcggcttaggccccaggacagtcacgcgacgggttctggtccaaaaaccgcctaagtgctccgataacacccagggactcgcctatttttacagcgcgtttctacttccaaggtctcggcgtaatcatcttaatgagcgttactggtgtgtcaaacaagggcacgtgtctgggcgggcaggaccgccaggattggcgctggcccggcctgagcggtgggatcggggagagtctctttgcaggcctgtgcagctgctcccgagattttctttaaaacatatttgtgtgcgttattgtcaggagaggttccttttcttttttaatacaatagataatcattgggcatacaaggggagagggcaccatgtgatcataacagatgttttttggagcagcctgaaatttatcagggaaaacaaatgactactcagataatacaataaattatacttgacatatgagcaaagctcacatactgagggcgttccaagggctgtcgctcttctgaccgttgtgtttagggaacacagcaggggcagagtctcaaagaatttattctccacatgcgtaagcaagggagtacgcaccacagattgtcaggcaaagcctcaggaataggtagagaccttcagggtgtggttggtgaagcttgagttttctaggtcgatgggggcaataagcttggagatccagttatgttgtgagtatggacttgaccctagttaagtagggattgttgatatgtttgtttttgttgcaatggtaggtcactctagttcttacgtctgggcgtagaataacattacttgcacaagggtgctggcggtaggagctttgcaagagattgtaaaagaaccagtctaggacttgacaattagggagtgagggtgcgaagccaagggaaaagaaagagtctaaaattgatcctgggtgactgagataatagaaaagtcacaaggcgtaggtttccagggaagatgagtttttagcctatttgttagtctcatgggatgagtgaagaaatcacaagaaagtaattaggttatcttgggtttcagtcagtattgactaggtgacataggtgaactaggtactctagagatgtaaaaaaaaaaagttcagaaccttcttaatttatggtttaattaagatcttacaatcaggttggttgaggtggcttatgccagtaatcccagcactttgggaggccggggtgggtagatcatttgaggtcaagagttcaagaccagcctggccaacgtggtgaagccccacctctattaaaaatacacacacacacaaaaattagctgggtgtggtggcaggcgcctgtaatcccagctacttgggaggctgaggcaggagaatcgcttgaacccgggaggaggggaaggttgcagtgagctgagatcatgccactgcactccagcctgggcaacagagtgagactccgtcttaaaaaaaaagatcttaaaatgaaacacaaatactcctcatgaaaaaaataagcctgtacatgctgtaatgtatgatatgtgacattcatattactgaactctaggaagcagttgtattggacacttgaattaaatggtcatttactgaactataaacaggatttccagttttctgtgctattttgtagaatggaatttgacctctcattacattggctcttttccctttgcttaccaggtctcttttatggtcaacaaatctttatggactttattggagcacattgcctttctagctctaatcacttttctctctctggtcaaaggagtggtctttactcattacctcccatgtattctgcatctatttctccttaactctctgcagttaaatttctttgccactgaagctgaaaaatacagtgatttcctttttctttgttttttaattatttttttaaatctattttaattttagtttttgtagacacggggtctggttctgttggccaggctggtcttgaactcctggcctgccaaagtgctgggattacaggtgtgagccattgtgctcagcccaagttttttcttcttgacctttatcctatatttgacactattgaccactcccttcttgaaactgttttgtgttttgatccagttttattcagcttcttttaatactcagacttaaaaaaaaattcctgtattgtgccagtcttgggcttatttgctcccagattcatttatcttccctcccctagtctgtctgcattactgtaggctgaccaatatcagctggcttctggctgggtgtagccactggaaggcaccagtggaagattggaagataggaggaagggagaagccagaataatttgtctgtctgtctgtatctggcagtgtctgtctctcttgtggttcccgcttctgctgggatcctgaccccttggctttggtaaccttgcttcttccctttgacctaacagcctgtatgctacttccttcctgttgctaatttctttctttcttttttattttttgagatcaagtttcgctcttgttgcccaggctggagtgcagtggcacgatcttggcttactgcaaccttggcctcccgggttcaagcagttctcctgcctcagcctcctgagtagctgggattacaggcatgtgccaccacacccgctactttttgtatttttagtagggacgggctttcaccatgttggtcaggatgggctcgaactcctgaccagctcaccaggtgatccacctctgatgatctgcccaccacagcctcctaaagtgattacaggtgtgagccaccacacctggcccccttccctttttctaatcttaccctagtacactcagttcccccgcagccagagtggtctttttataacataaaagctttcagtggcttgtcattgcccataggccagaatctagacccttatgatctgctgggccctacttagttctgtggcctcagctgctgccgtgctcactctgcttttgccacaggacccttctttctatacttagtatgtgtgccaattttgttccgaattcgtggccttagtcctacgtgttcctgatgcctcaaatgttcttttcctggatctttccaaggatgactctttaacattcatttctcagctccattaacattgctagaaggccttttttgactctcccatgtaaagtaggccgtcagttactctctagttcatgatcaattttgctggtttcataacatttactgtagctgaaattttgtttctctgagttattggtaactttcagactgtcttcaaatatttgttttgtgtctgctgccatcactgggatagaaaataaataaaatcagtctcttcttggaattcacagtctagtgaggagaaaagccacctgagggttacaaaattatatattctggaacaattagaatgtgcacgggcgttgtggaagctgagataggagtgctgacctctgcctggcatggctgagccctccctgaaagataattgtgttatgtagataaaacttaatgggttgtgttcattcagcatgtattattatacactatatggttcagtgtcctgaccatactataattttgtcattcgtttctgatattgaaggagcgctaggcactgtgctaagtcatagggatgtaacagtgagcaagagacaccatcccgccatcaggaagcctgtattatgttggaggggtggataataaaacaaagatgtgaaccacatacttacagtgtaagaggtgctttgaaggaaataaagatattcatataaaagagaggaaaaagtagagggtaactttaaatagagtagttagggtggaccactctgggaatgtgtcattagaaaagacatgaagaataggctgggtgtggtggctcacgcctgtaatcccagcactttgggaggctgaggcgggcagatcaccaggtcaggagatcgagactatcctggctaacaaggtgaaaccctgtctctataaaaatgcagaaaattagccaggcgtggtggcgggcgcttgtagtcccagctacctggaaggctgaggcaggagaatggcgtgaacctgggaggcggagcttgcagtgagccgagatcgcgccactgcactccagtctgggtgacaaagtgagactccgtctaaaaaaaaaaaaaaagaaaagacatgaagaataaaaatgagccagccatggagagctgggaagactttttgttttgttttgtttttgatttttttggagacaggatcacactctgttgcacaggctagagggcagcggcgcgatctcggctcactgaaacttctgcctcctggattcaagcgattctcccacctcaacctcccaagtagctgggactacaggtgcccacccccacacctggctaatttttgtatttttagtagacacggggtttcaccatgttggccaggctggtctcaaacttctaatctcaagtgatccacctgcctcggcctcccaaagggctgggattataggcatgagccactaggcccggcctgaggagactattactggcagaggcacactgcagagaccttgaggtatcgggatagggtttagaacaaagagatgccagtggctggcacagagcaagagtgatgtaaatttggagagaaaacctagagccagatcatgcaggttcttggaggatgaggtaaagaatttgtatataattccaagagcaatgaaaagctgttaaattattttaagcagtagagtgatatgatctgatttacatttttcaaagctggagggactgtagagaggtgtcaggggaggcagggaactaggtagaaggccattaataggaacaagagatggtggcttggactaggtggcagcagtagacatgaggcagagtggacgaatttagttatgttttggacgctgttcacagtatctggattttagggattgcaataaagggaaggatgaaggatgattttggcttgagcacctgagaataccggcaacaaacaggttttcttttttttttttttttttttgagatggagtcttctctgtcacccaggctggagtgcaatggcgcaatctcagctcactgcaacctccacctcccgggtttaagcagttctcttgccttagcctctggagtagctgggattacaggcgcgtgccaccatgccctgttatttttttattttattttatttttatttttttgtatttttggtagagacggggtttcagcatgttggccaggctggtctggaactcctgacctcgtgatccgcccccctcggcctcccaaactgctgggattacaggggtgagccactgcacctggccacaaacaggttttctagggttggaaattgagagctatgatttggacattcacctgcagctgtcaggttggcgcttgggtgtgagtctggtggtcagttgaaaggtcagggttggagatagaaatttggaaaatcatcagcacatagaagccttttttttttttttttgagacagagtctcactctgtcacccaggctggagtgcagtggcgtgatcttggcttactgcaagctccacttcccgggttcacaccattctcccacctcagcctcccaaatagctagggctacaggtgcccgccaccacgcctggctaattttgtttttgtatttttagtagatatggggtttcaccgtgttagccaggatggtctctatctcccgacctcgtgatctgcctgccttggcctcccaaagtgctgggattacaggcgtgagccactgtgcccggcctcataaatgctttttaaagccatgggactggatataactaaggatatagtgaagttaaattaaaagaggcctggaacaaagccctgggacattcagcacttggaggttggaaggggaagatgagatagtaaaggagactgaggtaaatatgactaatgaggtaggaaggagtccacgtttgtaatggaagccaagacaaggaagggtttctgcagtggattatacatattacctcattttattctcataacagcctgtggagggtatttaagaaaaccaaggtaagtgtgtctaagtaacttgctcaaaaatactcagcttgcagggcacagtggctcacgcctgtaatcccagcactttggaaggccaacgcaggaggatcgcttgagcccaggagtttgagaccagcttggtaagatagtgagactctgtctctacaaaacaaacaaacaaagaatactgagctggtaagcccaggctcttaactgctcagcatatttctcaaagaaaggtgagcccagtcttgctgatgtgttaaaaggttaagtgagacaattatagcgagttggattttgctacacagacattgctgatgttgctcagaaccaacagtggtaaactggcagaaataaaatcctgatctgagtgggttgaactgtaaagaggaggtgaggacaagcaaatagacactgtaggtaacctggagaacctttcttgccaaagagaactaaagtaaggtgaggccatgtgcagtggctcatgcctgtaatcccagcactttgggaggccgaggcaggcggatcacctgaggtcaggagttcaaaatcagcctggccaacgtggtgaaaccctgtctctactaaaaatacaaaaattagccgggcgtggtggcgcatgcctgtagtcccaggtactcgggaggctgaggcaggagaattgcttgaacctgggaggcagaggttgcagtgagctgagatcgcaccactgcactccagccttttttcaaaaagaaatgaggtgaaagctcgggaatgtgggtcaagagacatttatttgtttttactttgttttttaggtggggggaatcagatcctgtttgtatgcttatggaattatccagaagtaaaaggggtgaatgatgtagaggagaaggaagggataactgtgccatctttgaaaaggcaactggaaatgggatccagagtaaagtggagagaaccagggaagattccattaaactggaccagaagcttgaaagaagagaagtggcttagtaaacaaggaacaaactagctaagtagaaaggggacttttaaaatttaatttttatttcaataggcttttgggaacaggtggtgttggattatatgaataagttctttattggtggtatctgatattttggtgcacccatcacctgagcagtatacactgtaaaccaatgtgtagtcttttattcctcacccccaccccccgcctttcccctgagtccccaaagtccactgtatcattcttatgcctttgtgtcctcatagcgcagctcccacttatgagtgagaacataagctgtttggtgtttccattcctgagttacttcacttagaataatagtctccaattccatccaggttgcagtgagtgccattatttcattccttgttacggctgagtagtattccatggtatatataccacatttgctttatccacttgttgattgatgggcatttgggctggttccatatttttgcaattgcaaattgtgctgctatgaacatgcgtgtgcaagtgtctttttcgtgtaacgacttttttttttgagatggagtcttgctctgtcgcccaggctggaatgcagtggcgtgatctcggctcactgcaacttctgcctcctgggttcaagcgattctcctgcttcagcttcccgagtagctgggattacagacgtgtgccaccacgtccagctaatttttgtatttttagtagagttggggtttcaccatgttggccaggctggtcttgaactcccgacctcattatccgcccgcctcagcctcctaaagtgctgggattaaaggcatgagccactgtgcctggccttcatataatgacttcttttcctctgggtagatacccagtagtggaattgctggatcaaatggtagttctagttttagttctttaaggagtcttcagaaaggggactttttgaagagatacaatgggcaagcactaggacatccaaggataggaaataaagtgcagctggctgggtacagggatgtgtgcctgtagtcgcagatacttgggaggctgaggcaggaggattgcttgagtccaggagttctggtttattttttatttttatatatgaaaattttcaaacaaaataaattgcaactgaccctgccagaacccaagctagaaaatcactaaccaaagccatcttttgcctcttgtggtgtgccatggtctatttctcctgtctctgagtatatatgttgcattcttttgcttctcagtgtattcatggcttttctctttgttctaaccgctgcttttctgtggcattggctggtcagctccagccccttttgacttttcagtcccagtccccaccgtcatccaactgacccagtctctctgggtcctagcttgggtgagtccattccattcttgatcccatcagctctggccagaggcaggggagtcaccttgtaagtacttagggttgtcctttgagaaagacatgtgtttggagaggcagtgaccggcatgtttactacaagtaggaacttttttttttgtaagtttttaaattattattttttaaatttattatcattttttgagactcgctctgtcgcccaggctggagtacagtggcgtgatcttggctcactgcaagctctgcctcccaggttcaagtgattctcctgcctcagactcctgagtagctgggcttacatgcatggaccaccacacccagctaacttttatatttctagtagagacggggtttgaccatgttggtcaggctggtcttgaactcctgtcctcatgatccacccgcctcggcctccaaagtgctgggattacaggcatgagccactgcgcccagctactgatagtctaatttcagatcagtaggtctctgaattgtgtcctgcgttgtcagaattaattaattaatctatttattatggagtttcactcttgtctcccaggctggagtgcagtggcgtgatcttggctcactgcaacctccgcctcctgggttcaagcaattcttctgcctcatcctcctgagtggctgggattacaggtgcccgctaccacgcctggctaatttttgtatttttagtagagacggggttttttcgccaagttggccaggctgatctctaactcctgacctccagtgatatgcccaccgcagccttccaaagtgttgggattacaggcgtgagccacttgcccagcctactgttgacatttgttcctaagaagtgtggaaagaactgagaagtagtaggggcaagatgtttactctttccttttttaagaaataatttatctgctattataggtcatatttatatgagatgtgtttgcctcatataaatcagacaattgttggaagtggatagggagaaacagcaagttttacttgaaaacaatcttaaaaaatgaaaatatcttgttagattctaagactaaataatttagaacctagctttaactcaaaactacattttagaaagctatatttaagaaagacttggaattttttttttttttttttagacagtcttgctttgttgccaaggctggagtgtagtcccagaatcttggctcactgcaacctccgcctcctgggttcaagctattctcctgcctcagcctctgaagtagctgggattataggcatgtgccacaatgctgggctaacttttgtatttttagtagagactgggtctcaccacgttgtccaggctggtcttgaactcctgacctcaggtgatccgtccaccttggcctcccaaaatgctaggattacaggcatgagccaccacgcctggccaagacttggaaattttaagatagtaaacttaagagttaaaacgtacatttccaatgaatagttaattagaaaagtttattataaagcagtcatttttttctaattgttaaaagtgatatattctgaccacaaaaaacttggaaataaaagcataaggatgcaggaagaaaccactataaccttatcactgagaaatataaaatgatatagtttaatattttttacattataacattataaatatttatattacaggaaataagatatgtggaacggagttatgtatcaaaacccactttgaaggtaagtaatttaaattgtgctttaaaatttccagaatttaaaggaaatgtcaataaaaatgcatatacttatgatttggatacatgtgaaagtcaaagcaggattatgtaacagttaggaatagctaactattcaaatattcagttaaagtagatgactataatagaaaaacatgtcagttagtctctgccaatgtttgttgcttccttatagtctgctacaaaacaacattccctctagaactgggcagtgttcttcttttactcacagggactcgcattgtattgtgtgtggtacaagcagagactgtatagaagatcctagaagagagggagtggaccagttgggaattagacaaggagggccattacagcatctcctaggaccttctgaagagtctctgttttgtaagggtcactaaagtgacttagttaagatcttctatcaaaatctaagcaaccattctgttatttatctctaaacttaataggagattgtggaagacaagtgtaaggagagaactgtcacagtgctgttttatagtattcaagagagcttttatcttcttttgcttaaagttcatattattgtcttactgtttaagaaattatggctctgggccgggtgcggtggctcacacctgtaatcccagcactttgggaggccgaggcaggtggatcacgaggtcaggagatcgagaccatcctggctaacacggtgaaaccccatctccactaaaaatacaaaaaattaggtgggcatggtggcaggcacctgtagtcccagctactcgggaggctgaggcaggagaatggcgtgaatccgggaggcggagcttgcagtgagttgagatcacgtgcctgcactctagcctgggcaacagagcaaaactccatctcaaaaaaaaaaaaaaaaaaaaaaaaaaaagaaaaaagaaattatggctctggctgggcacagtggttcatgcctgtgatcccagcactttgggaggccaaagtgcgtggatcacctgaggttaggagttcaagaccagcctggccaacatggcaaaaccccatctctattaaaaatacaaaaattagccgggtgtggttgcagatgcctgtaatcccaactactcaggaggctgaggcaggagaatcacttgaacccgggaggcagaggttgcagtcagccaagatcataccactgcactccagcctgggtgacacagtgagactccatctcaaattacatataaaaaaagaaattctggccctggctctgtcctagttaagtggtattgccccacctaggatacaggtcttgattcctagccagagttcctttcagtaagggaccctcttagagttgtttattatgcagttaacaagagtaaagtggctgagtgtggtggctcatacccttaatcctagcactttggtaggctgaggcagaaggattgcttgagctgaggagtttgagctgcaatgagctatgattgtgccactgcattccagcctgggcagctgagcaagaccctgtctcaaaaacaaaaatacaaaaacaaacaaaaaaacaaggtacagtgatcatttcttgaattttgactgaggaatagaaaggaaacttaagcttctgtcctcaaacctcctgtagagaactgggaaggatctacatctgttttagagttggtttctataaggtcttaaatcataaagcactagcattgaactgattatcttgacagctgttcaactattgagattaatttttgatgactcattcatagaagtgtttttttgataatatatttatgtttatttaatgaaatacgatttgggtaaaatacctataatttttaccatcttgtgtcttgccaggaagtggtcatagtaagtgctacaagaacacccattggatcttttttaggcagcctttccttgctgccagccactaagcttggttccattgcaattcagggagccattgaaaaggcaggtcagtagttacttggctttttgtgttaagggagcaaaaagattccatggaaaagatatttattttgcattaactatgtatgtaacacttagaaataacttaatgcctacatttctgctttcccttgtaaagaagtctttgtactatacagtttagattgaaactcaaaactgacaaaaaaaagaaaccattcctattgtgtaatgtcacctaccttattaggtaatcactgattattaaattgaattaaatgcctttttgactttttttttttttaataaagggattccaaaagaagaagtgaaagaagcatacatgggtaatgttctacaaggaggtgaaggacaagctcctacaaggcaggcagtattgggtgcaggtacctggaagacttttttgcttttatacttaaaatgtgtaaaaggggccgggtgcggtggctcatgcctgtaatcccagcactttgggaggccgaggcaggcggatcacgaggtcaagagatggagaccatcctggccaacatggtgaaaccccgtctctactaaaaatacaaaaattagccaggtgtggtggtgcactaatcccagctacttgggaggctgaggcaggagcatcgcttgaacccaggaggcggaggttgcagtgagccaagattgcaccattgcactccaacctgggcgacagagtgagattctgtctgaaagaaaaaaaaaaaaaaaaaaaaaaggctgggcatggtagctcacgcctgtaatcctagcactttgggaggccgaggcgggtggatcacgaggtcaggagattgagaccatcctggctaacacagcgaaaccctgtctctactaaaaatacaaaaaattagttgggcgtggtggccagcacctgtagtcccagctactccggaggctgaggcaggagaatggcgtgaacccaggaggtggagcttgcagtgagcccagatcgcgccactgcacgccagcttgggggacagagtgagactccgtctcaaaaaaaaaaaaaaaaaaaaaaaagtataaaatggcaaaatgaaggttatttaagcttaaatgaaatattaaatgcatgatataatttgtagttatattggcagaagaaatgttgtagtttatagtaacatgctctattaagttctgcagttgtgtttgagtatcggtttttcaaaagtgacttatattggttttaggcttacctatttctactccatgtaccaccataaacaaagtttgtgcttcaggaatgaaagccatcatgatggcctctcaaagtcttatgtgtggacatcaggtaagaaacaccgtccttcccatttattaatcagagtaatacctagggctaaaagacacaaaaatctaggcatattcatattttagaaatgagattctttctcataagttagtatgttttctcacatgctcaagagtgtctggatttgctaagtccatttgaagtatggtcaaaatgatagcgtaggctgggtatcatgtctgtaagcactttggaaggtcgaggcaggaggatcccaggagtttgagaccagcgtaggcaacatagcaagcgagactctgctctttgaaaaaaaaaaaagcctaagtgtcttgtgttacaaagttgtttttaggcccaggcacagtggctcactcctataatcccagcactttgggaggctgaggctgggggcagatcacatggtgaaaccccgtctctactaaaaatacaaaaattagctgggcgtggtggcaggtgcctgtaattccagctactcgggaagctgaggcacaagagtcacttgcatctgggaggcagagattgcagtgagctgagattgtaccactgcactccaacctgggagatagagcaagactctcaaaaaaaaaaaattgtttttagtcaaggcatttgggtctttctctgaggctgggtgactaaaaattcataaatactgtatttgccagaataagacaggttttcattataaaggagaacacggtgcttaaccctgggaatcaaatcattgcttgagcccaggcttgatgactaatttgtagtcattaagttaagttctacaggctttctaattagccttgctgatctatatcttgtctttacttgagatcaagcaagagacaggctccttagcaaaaatatgctgtcatgtcaggaggtgagacctggacacacagaagaatcaagattctctcagatctgagcccttcatttttcagatgaagatttttttcagtgtgtctgagacagccacagagttacagggctgagcatctgccatgtgacagtcattggaaatagagtggtgaacaaaacatttaaaaaaatctgtacatgtgcaggtctctgttggaaaaatgcctaaaagaaatgctgagtcaggatttgaacattttggtatttgcaaatgctttccataaaagttgtaccagttagactttccaaaaattgtgtgacttgtctggatctgcaccaccactgggtggtaccaaacccttgtcaaactggtaggtgaaaaacggtcaccagatttagtttcagaactgtttgtcatggaaagttttgtcttaattgaagtattgtggttctctagcaaatgccatttgtactatattgaaatactttcatttaatattattttattcatttgtggatatatacagtgacttataggcattcttggaagtgctttgttttgaatatttatgaccttagaaaacagtcagttttactttataatgaagaattgataccttattttctgtcacttattattgccatcacccccagtaaaaagtacaagtgaataaaacttagatgagaactgattaagaatttctctatttcggaataggcaaaatatttatgtttctttggtatagagcttgcttgtctgtatgcctgattaaagactgtaagaagatattattggctttatgtttacattaatgttttatattaaactgtttttaactagcccttataatgcaagtgatttttttttgttgacttgtaaagtagtaacaagttgattaatatttattaaacttatatatgccagttgccaaggatgtaaaaatatgacagggtgtctggcctcaaaggagcatagtctagtgggaagacttgacatgtaaacatataataatattaaaagcattgcatagtaattggggaacacaaaggaggagaaactgtttcaagaaaggatagaaataaatggtcaaggcagacatgaagtagtgttctgattagttttaagagaaatgtaggtgttttacatgttggtggatggggaaagtgcagaggtatgtgtgtgaaatgtgcatggtgtctctggagagctttaactagttccatgtgacctgaggtataggttaggctgtgagactgaaaaaggggagagaagggatactgtaaaggctttatatattatgctgagttatctaaggtgcgaaatgatcagacttacattctagccaaaatgagtcagatgagtgttgatgatgctttggtggaaaggctgcatgtcagaagatcaagtggaaaattatctcagctgtccaggaagagatgatgaggatctcagtcaaggaagtatgattattttcatgaactgagattacttctaatcttctagagcacattaaatttttagcagcatgaatgaaatgaagggttagaagttaagaatttcaggccagtcatggtggctcacacctgtaatccgagcactttgggaggctgaggtgggcggatcgcttgagtctgggagtttgagaccggcctgggtgatatagtgaaaccccatctctactaaaaatattatacaaaaattagctgggtgtgatggtgcatgcctgtagtcccagctacttgggaggctgaggtgggaggatcacttgagcccaaaaggcagagattgcagtgagctgagatcgtgccactgcactccagcctgggcaacagcgagacctgtctaaaagaaaatttaagaatttcagaagatggttttacatgaaagatttctggtattttttttttaaagacagagtcttgctttgtcacccaggctgaagtgcagtggtgcgatcttggctcactgcaagctctgcctcccaggttcacgccattctcttgcctcagcctcccgagtagctgggactacaggcgtgtgccaccaaacccggctaatttttgtatttttagtagagatggggtttcactgttagccaggatggtctcgatttcctgacctcgtgatcagcccgctttggcctcccagagtgctgggattacaggggtgagccaccgtgcccagccagatttctggtattcttattaatgtctggttgtgaacttttgagacagagccttgctgtcacccaggctggagtgcagtggcacgatctcagctcactgcaatctccgcctctactttttttttttttcttttgaggagtcttgctctgccccccaggctggagtgcagtggcacaatctcagctcacagcaacctctgcctcccaggttcaagcaatcctcctgccttggcctcccgagtagctgggattagaagtgcccaccaccacacccagctaatttttgtatttttagtagagacggggtttcaccatgttggccaggcggatccagaactcctgacctcaagtgatccacctgcctcagccttctaaagtgctgggattacaggtgtgagccactgcacccagccaacttatttctcattatattatttaacaccatttcttttcatcagggtgaagtggtaaagagggtacttcctgtattcactgtgtaacaaatgtttaataaatgcatgtagaatacttgtttggtggtagctgtataaagggtgtcatgggtttgcaaaatatttgtattaacattgggtttttctggtgtttctgcgcaggatgtgatggtggcaggtgggatggagagcatgtccaatgttccatatgtaatgaacagaggatcaacaccatatggtggggtaaagcttgaagatttgattgtaaaagacgggctaactgatgtctacaataaaattcatatggtaaatgtgatttttagtggataaatgctatctaatgtccaatactgtttgatttttcttactctatgtactttacaaactgaactgaaagatgggctctataaatgttgattttagccgtgtacttttggagaatatttttgtatgcctattgcatcggcatggctcagtcattaaagaaattttcccacatttaaatagggtaatttctgacgcttagctggcaactgcttggctaattcaagtatgtgaagataagacatgagtggctgggtgcggtggctctggcctgtaatcccagcactttgggaggccgaggcaggtggatcacctggggtcaggagtttgagaccggcttggccaatgtggtgagaccctgtctctattaaaaatacaaaaaaattagccaggcgtggtggtggtgtctgtaatcccagctactcaggaggctgaggcaggagaattgcttgaacccgggaggtggaggttgcattgagccaagattgcaccactgcactccagcctgggtgacaagagtcaaactccgtctcaaaaaaagacatgagtgaaaagtgacctggtatagaaagaaatatatatgtgtgtgtgtatatatatatgttattattatttttttgaaatggtgtcttgctctgttgcccaggctggagtgcagtggcacagtcttagctcactgcagcctccgcctcctgggctcaagcaattctcctgcctcaggctcccgagtagctgggactacaggcacgtgcccccatgcccggctaatttttagtagagacggggtttcaccatgttggccaggatggtcttgatctcctgacctcatgatctgcctgccttggccccccaaagtgctgggattacaggcatgagccaccacctccggcctaagaaatatattttaagaaacgttaactattaaacactataagttaggcaaagttaatagatattttctaaattatgcaaagttaactttaaaatatttcaactttttatcagggcagctgtgctgagaatacagcaaagaagctgaatattgcacgaaatgaacaggacgcttatgctattaattcttataccagaagtaaagcagcatgggaagctgggaaatttggaaatgaagttattcctgtcacagttacagtaaaaggtagagataatgttccaaaaaggatgaatagacttttcatgttgctgaatgttttatgcttaagttttaaattaggacattatcttggttcatttcaactgcttatggttaataaaaagtgaagagttgccagttcagagagaatataaatctacccaacttaatgtcagatttcaatccatttataagatccctgagtattactttaaatttgagaaatttattagaactttttcctgtgacagtcaatacggtattttaaattgaaaagggatttactagaaggttaccgggagtgcctccaagaactgaaggatgaacagtagcaaccattcagctctgggaacttcagggattggaactgggtgttcactactactaagacatgctctcttggcttctcacacctgcaggcttttgtgctttattctctcagcctttctaaagttgctgcctctacctctagggtcacatatatagggttctcaaaaaggagagactttctcaccagttccagcagaataaatccacaatgaagactcattaacttgctttaggttacaattctattccaggaatgattactgtgctctaggtgacagaatactagagcttatctagtgtaggtcagacagctgcctctggggtcaggagagtggggtctgtgatcatagaagggagttgaggaagaaaaggggacatggaggtgtagaagatttaaattttgtggctgggtgcagtggctcacacctgtaatcccaacactttgggaggccgaggtgggaggattgcttgagcccaggagtttgagaccagcctgggcaacgaagtgagacttggcctccacacaaaaaaattaaaaattagctgggtatagcagcacacgcctgtagtcccagctactagggaatccaaggcaggaggatcaattgagcccaggagtccgaggctgcagtgagctaggtttgtagcattgcactctattgggagactgtgcaagaccatttcaaacaaacaaaattagctggctgtggtggctcccacctgtagtcccagctacttgggaggctgaggtgggaggatcacatgggcctggagaggatgaggtaaactgtgatcatgccagcctaagcaggagagggaaaccctgcctcaaaaaaaaaaaaaaaaaaaaaaaaaattgtgaagctactttgtaagtttctctttttaagatggtaacataatagaggttatagttaacagattctagatgagtgtttacttgggatggtttaagtgaagcagggatacaaagggaggcacagactactaggcatcttgtacaacagttgcttgctgaatgactacttgttttgagcgattttacttaaaatatttttattttaggtcaaccagatgtagtggtgaaagaagatgaagaatataaacgtgttgattttagcaaagttccaaagctgaagacagttttccagaaagaaaatggttagtgttaagaaatgaagcataagaaaaaattgagccagtataccatatctagttcttagaattgcctaaggattttgaaaaattctagaaaacatctagatgttatttaacattttcagtatatcaggctcatgtaaaattgttttggtagtttataccttcaatatataaatcccagggaagatatgtataacatgactatagaattcagtttttcatatgtagcagtctatgatagggtcttcattggcattgaaaaaaacagatttattgatataatttatataccataataacattcttctatttaaagtggtttggtagtttttaacattcatttatatttatctccaggtgattctagataagaataaatatctgatttgaaaaatatgtagtgagtacctgctatatattgaataaggaaagttagaccctggagacaaaaatattaactggtccctatgtttcaagagttgtagacgagcatttatccagtgccatcatgcatgtttgtgatgtttgagaaaactgttttatgtacacaaaaaggcattcttacattgtcttgcagttagctgtgtacatgtttcctgagggcaggaattgtctccacccatatttgtaatttctttaaacatttagcagcccaggcaataggtatttgttgaattgaaccaaatacatttattgtgaaggaatgttttgacttcaacctcatttttgctttcaggcacagtaacagctgccaatgccagtacactgaatgatggagcagctgctctggttctcatgacggcagatgcagcgaagaggctcaatgttacaccactggcaagaatagtaggtaaggccaggcgaggtggctcacacctgtaatcccagcactttcggaggttgaggtgggaggattgcttgagccccggagttcgaaatcagcctgggcaatatagtgagacttcgtctctacaaaaagttaaaaaattagctgagcatggtggcatgtgcctgtactaccatctactcgggaagctgaggtgggaggatgccttgagcccaggagtttgaggttgcagtgaactgagattgtaccactgcactccagcctgggtgacagagcgagaccctgtcttaaaaaaaaataaggtttctaaacatctataagctcttcatgaaattgagtttacttgttagatatagccaactccaatattaagtattactacctaggttgtacttgtggcagaatttaattgatacatatttcaattgagatagaagctcctttaatattttcattatactttatataagattaagctttaagggctgggcacagtggttcacgcctgtaaccccagcattttgggaggataaggcaggattgcttgaggcctggagtttgagaccagcctgggcaacacagtgagaccccacctctgaaagaaaaaaattagccaggtgtggtagcatgcctgtagtcccagttacgtaggaggctaaggctgacgatcatttgagcccaagatgtcaaagctgcagccagcctaggcaacagagcaagatcttgtctctttttctttttttttaaattaagctttaaaaaacttcctgtcctgtatgataaatagcagaaaataaagtacatgcattttcctacagaggcagctatgtaggaaaaaaagaatatgggattaggagtccagaaatacaaaatttacatgtgtggtgttttagtatttattaactctgtggccttgggcaagttctcaatgtccttaagccgatttttagctgcagaaatctgtcttgccttcttcctaaggacttaacagatgctattttgttactttataaaaagccttataacttcattttttttcttagcttagatcatggtttcttaacctcagcactattgacttttgcactaagtaattctttgttgtagggactgttctatgcattgtagatgtttagcagaatccttagtctttacccagtggcatctgaactattctgacaaccaaaaacatctctaggtggtgccaatgttcctagaggcaaatacccccaaactcccccccaatgaaaatcagtgtcttagattactggagtaattttataaagtgtagaatcctagaaaaggaagacatatatttacatatattaaaggggctaggaaatgtgcatttaatgggctaaacttggcttgtgcatattctatacagtaaaaaaaaaaagattttaacaacccccccccccctttttttaaacagcatttgctgacgctgctgtagaacctattgattttccaattgctcctgtatatgctgcatctatggtgagaacaaagtgaggggcgatactccattatgctagcttctggtttgcttataccaaggttgcagtttttaagattttaaatgttatctgccaaagcagagagatagcttggtttcaaatcttcccatgtcttctcctgaaaagagtaagagcaacaaggataacaaacaaaaaaaaaaaaataaagaacagctcacaaactacatcttcagtagaacaggtaaaactacacatctgaattacttgtaagtatcatacagaactcacacacctggtgtggtaaccacaaagcggagggaatgctggctgatggttccagatctagaatggaaagcaactagtcactccccaggagaggactccattctgaaagggaacagctggcagcaggtcttcagagtaaatagtaaaactagagacagaaaacctacatattccaaattgtcagtaagggctatccaagtctcagtgggaaattgctaagcagtcacaggaaaagaaagttttaggggttcagggttcttagaaatcttaagtaaatatttccttttgagagggcctcaccctgacagtaaacttctgtaagcacccagataaaaaaaattgcagaattttagtaaaatcagattctccccactgcccccaacccccgcaatgaaaaaaaaaactgcagaatcagtaggaaacaagaatagagaagatcagaaacaaggggccagtggagtgatgatctgctcagagctagcagatctcagaaaatgaaaggaacacgcagcttctgaaagtgagtaacatcacgttggaaagcaagggtaataaacaattctggattctgaaggtagaataacttctgagagctacagacatagctatatatgggtaccatattttgttttgtgttgttggaacagtggaagctgtttgagctgtataggctagaaagctacccttagtccactagtagaagagaggaagatggaggaagagttccacgttaattttattatcgctcacaacaatcaaatttcttctgtaaagaaaaagggcactcactagtaatgttttagggcactcactagtaatgttttaaaaagtattagcatagggataatcactggcacaaatacaccttcctgcatagctgaggaactaccaaaacaaaacagatcatatagtgtaagattttaaataaatgacttacaatgaaactgcaacagatgtaaatatctgtggcccagataaccctacagtaacatttataaagcagaaactgcaggggatgcattaatatcactaatattagaaactaatatacctctttcattaacagtcaagaacatagaaatggctgggtgcagtggcgctcgcctgtaatcccagcgctttgggaggcagatcgcttgagcctgggaggtcaaggctgcagtgggccatgactgtgccattccacttcagcctgggtgacagagcaagaccctgtctcaaaataaatcaacaacaacaaaaaagaatatagaaccaagcaacacacaatcagtaaagcagagcttaagaatatataaagcattatgtgcccctaaatagaaaatgtaccttttcaaatatctgtggaaagaaaatcaaattttctgtcccctatgtcaaaacagacataatgcaaacaaaattctttgatataatggaataagatgagcaactaaaaatctgaaaatgggccgggtgcggtggctcacgcctgtaatcccagcactttgggaggctgaagtgagcagatcacctgaggtcaggagtttgagaccagcctggccaaacatggtgaaaccctgtctctactaaaaatacaaaaaattagctgggcatggtggtgggcatctgtaatcccagctactcaggaggctgagacaggagaactgcttgaacctgggaggcagaggttatagtgagccaagatggcgccattgcactccagcctgggagacagagcaagactgttggaaaaaaaaaaaatctgaaaatagagatccttccatctgaaaccaagaacttccatatttaaataacttatgtcaaactgtagtatttcaaggaaatgatgacagtaagttgtgattgctaattatttgaacatcatctgtcttttaaaaaatttaaggttcttaaagatgtgggattgaaaaaagaagatattgcaatgtgggaagtaaatgaagcctttagtctggttgtactagcaaacattaaaatgttggagattgatccccaaaaagtgaatatcaatggaggagctgtttctctgggacatccaattgggtaggtaaaaataataactatatctaggttaagagctgcctttgtgtttctagctaaacttaaaactgcttcataattcccattgctcttaagttttccttcctacccatctttcataaggcaaaaaccatttctgatagatggtatccaatactgaacagagacctgtcacatctgttatttgaaacctaataatgttttatgctgaagaagaaaaagtgtacatttagactttttaccccctttttctccttcctatttatttcattagctttagggtaccgtgggttttggttacatggatgaatttatagtggtgggggctgatttcagtgcacctgtcagtcacccaatatgtagtttatcccacatccctcttccattatactctactcttctatccattatactgttctgtacttttaaaagatctgtgacctggccaggcacggtggctcacgcctgtaatcctagcactttgggaggctgaggtgaacagatcacgaggtcaagagatagaggccatcctggccaacatggcgaaaccctgtctctactaaaaatacgaaaattagctgggtgtggtggtgcacgcctgtagtcccagctacttgggaggctgaggcaggagaatcgcttgaacccaggaggtggatgttgcagtgagctgagattctgccattgcactccagcctggcgacagagcgagactccatctcaaaaaatgatctaagatctgtgacccttcctgaaacaagtcctccaagttttagttttagaatagtagtagttaattcagcaagtagtagtggctagtaaggttttcaagaagttaaattggaatagaaacattttggttagtcataaattctgtacttcattaaagaagtaaatgctttcttaattttaggatgtctggagccaggattgttggtcatttgactcatgccttgaagcaaggagaatacggtcttgccagtatttgcaatggaggaggaggtgcttctgccatgctaattcagaagctgtagacaacctctgctatttaaggagacaaccctatgtgaccagaaggcctgctgtaatcagtgtgactactgtgggtcagcttatattcagataagctgtttcattttttattattttctatgttaacttttaaaaatcaaaatgatgaaatcccaaaaca

SEQ ID NO: 36754 - DNA, 120136 bp, Homo sapiens
ctcttgaagagggctggtatatttgtgcctgctggaggtggaattaacagtaagaaggagaaagggattgaatggacttacaggaaggatttcaagtaaattcagggaaacacatttacttgaatagtacaacctagagtattattttacactaagacgacacaaaagatgttaaagttatcaccaagctgccggacagatatatattccaacaccaaggtgcagatcagcatagatctgtgattcagaaatcaggatttgttttggaaagagctcaagggttgagaagaactcaaaagcaagtgaagattactttgggaactacagtttatcagaagatcaacttttgctaattcaaataccaaaggcctgattatcataaattcatataggaatgcataggtcatctgatcaaataatattagccgtcttctgctacatcaatgcagcaaaaactcttaacaactgtggataattggaaatctgagtttcagctttcttagaaataactactcttgacatattccaaaatatttaaaataggacaggaaaatcggtgaggatgttgtgctcagaaatgtcactgtcatgaaaaataggtaaatttgttttttcagctactgggaaactgtacctcctagaaccttaggttttttttttttttaagaggacaagaaggactaaaaatatcaacttttgcttttggacaaaaatgcatctgactgtatttttacttaagggtattgtgggtttcctctggagctgctgggttctagtgggttatgcaaaaggaggtttgggagacaatcatgttcactccagttttatttatagaagactacggaaccacgaaagacgggaaatacaaagggaaattctctctatcttgggtttgcctcacagacccagaccattttcacctggaaaacaagcgtcctctgcacctctctttatgctggatctctacaatgccatgaccaatgaagaaaatcctgaagagtcggagtactcagtaagggcatccttggcagaagagaccagaggggcaagaaagggatacccagcctctcccaatgggtatcctcgtcgcatacagttatctcggacgactcctctgaccacccagagtcctcctctagccagcctccatgataccaactttctgaatgatgctgacatggtcatgagctttgtcaacttaggtatgttgttcatttgtttgttaatctatgttattacaaagtggaagttttccctaatggtaaaggagctgcttggtaggtggtcatgtttatataaagacattttctctaactctcctgtttagcttctgttttctttctttcattgatgccttaggcaaaaagtcatatatatatatttaatatgaatagttaaatttaaacacttatagtgtgggtcttttcagatcttgttaaaatttcaacctcgcttaaatatatgaatgcaaaggcaatagtctaaaaacagggaaatttatgaggatagctatgctatgggcaacaataaaaaaaagaagcacttacagatgggaaagtaaaagtgacattcggaagcactttttttttaagtgatttaaagcacatgtaagtatatattcacatactacttaaaaatctctcatctaggggaggcaactactgtaaaaatatagaggtaaaattaaccaagattgaatagcaccataaaagattactatcaaggaatcaaggaagggattctgaaattctatagtaaatatttcagaaataaagtttcaatctaacagttcttaactgtaatgagtaaagtatgttatagctacttgatttttttcacaggcaagaaaaatgtaaaacatgctttagtggtctttatctatacaaaattttccttctatatgagataaaatatttgaaattttctgtaaaccacaacaatattaatgagaaaattttaaaattatgttttagttgtagctggtacttcatggtggtttttaaatactgataatgtcaaatgataatttagttcccaatattccctctcacaataatattatggattaccaatttcaaattattttataagggctgttgttttctttaaatgttttagtaaaaattgaaggtgaaatttactatctctggcagtcaaaggaaaataacatcgaatatattttatgtttgaagattaaaaactctatcaacaaatttaatccactgggaagaattgagaactttatgatgttatagcttttagaactttgttttaaaaatgcaatctgctttgacttaaaattaacatgttttattaaacacttaattaaaaacttcctcatgtaacatctcaaaggaaatattctttgaaaagtcagattatcaacaaatcttaataacacatggatgcttttataatatatgttgcttaatatactctgctcatttgctcttagcaatcctagcatgaaggataaggtacttaataaatcgtacgttttatgttgctagagacaaaggtctcattattaagtgagtaagtcataatttgttgcactaatcaggtgtcctggaggccttttcttctacgtataattaacagacttcacatggaactttttagtcattaaaatatagcttaatttcaaattaatgtgattgcttttacctagtataagggatatgcaagtgtagcttgtggtacattttgctttgtaacatttctaaagtattattcaagaatttaaagtagtttaaatattttaatagaaaaatttcaacctagcaaaatttatatattcataaaccattgagaaaatcaggtcatatcatctaaaatctgacaaagaagcatatgtatgttacatattttaataaacgatagctcagtcatgaatgtcataatatattttattagaattgctctgatcattcacaagagaagtgtaagcatgatttttggatttatgtgtttactttttataaatctacatagagtaagaaagtcaaaaccaataatagttttattcattgattcctataacttttttattattgagaaacacatttaaaaataaatgacattttggttacattgttcagattataataacatagcagtttattagtttattgcctatatgaagaaatacaattattcatttgactctagagaaacaatattagctataagctttagagaaactgtgtgtttatttttatcatgcttgaacttctgagtagtgctttatattcaataacaaactatgttgtttcttctttatttaataattccaaactaaatgtcttacatgaaattactgacaaactgattctgatactaggtgagtttttcttggtagactttaaggaaaattaaaccacagtttaattatcctttgatcatgccttcaaatacattcaagatttatagttgatcactgcttagtaaaaagcttcaacttttgcatttcttttataatcaaataaataaataagcatactcagaaaaggtgaaagtgtaataacattattagctgcaataagagtgccagtgctttttaaatgtaatatccgttagcaaatattacctgtagtttatttcatgttcttataagactaaaaaggattagattttattttttcactgtcttaaaagacatgcatatagttgagactaagtacaaatgagtcacattagtagtaggcaagggatttgtattgaggaagtcacctggatatttaaatatgtgaaaagaatctgttgacatttcccataattagaagaattatataaaaaggatctagtagcatccttttaaaaaatgcttgtgtgttgtccttttcaagtcaaataatggattttccacaggtaccttgccattcagaaattcttttttcaacatagttttggtcacgaagaacaattaaacttaatccaaactcagaatcatgtttaacagaatacctactgtttaaaattcagatgagattagctttatattcataagtgaaaaatagatttgaatttactaaaagcaaaataaaaagtaaataaattgcctaaggcatgcagacatctgaatatgaaaccaaacatatcattttaacctttattttagtgactcgtttattttgaagaaacaaatataaattattaactgtgtgaagagaaatattccttcgatcatattcattattcttaggccacttttatcagtctcatagtattaaattttacagattgaattctttgctttttccctaaaactgttgaatatcagtggaacttttgcttggtcaatataatattattttgttagtaataaaaatgtttttctgtttagttttattttcttttttaaccatctctttgtcaaaagtgctaagtgttagtatatgtattaaataccagtacaagttaaagacatgattagataatttgcttacaatatttatctcttgtttacacaaataaaacatgtagtgtatttctaagatcttttagttagaagccaattttatttgattacttggtgacattatcaccataatgacataacactagatgttttagaggaagtaaaaacaggaaaattacttttatattattctttgtatctacatattcctctggaaaaagttgaactttgagtttattaatggtttttctcttagatgtatttcaagaatacgttttaattccaagcacaaaagtatttaaatgtgttgttaaattttttaaatataaaaacatatttagtctgttatcatgaaagaaaaacgctttcaaaaactaaaccttttttgcctacttaccctaatcattaagttctcttggtactggaaggaaaaaatgctttatgttctcagttgacagatttgaaagacatcattgataatttattattgtttttggctgaatcaagtgcccagtggaaagtaatttatatacaaatctacctaaagatgcctatctatgtagtctctccaacagagttattaacacttgtgtaacataaacacacccataaacacatggaagttttttttgaagggggatgggttggaaggaaagataatataaagccattatagtatatattcataaattatgcctggagtaactaatgctaataatgggtaaagcaacaatcattctgtaaaagttttaacttttgaagagaaaaatattgctgagtgaggagacctttttctctcttcttcaacaacacttcacattcataatcacgaccaacgggattctttttctcctttaaagatggttgattatcaagtgattggcatgacagacaaactctgggttgccagagatagttataatcatagtttaattaaatgctttttttttttttttcaaattgtagtggttactcacaaatatcaaattttaaaagtttaatgagacgtattagctggaactaagaaggacttgggactgcctcagctgccacctctccttccctttcattcttccattttctgtaatatcaccactctccctcctcccttctcatcccagtattttttggcctttcctccttgttcttggtctctgtagccccaggctctcttggcacccctctccttaccactcccacacttcctggggtctgcctttcgtcctggtttgctagaggcttaaattagttgaaaatcaattagttacagtttgagaattgaggtacactctcctgttttctctccagttgagaaggaaaaggttatgatgtgccaactgcagcctccacccactgggagaaaagctccccagggcatcagagctgccctggctcttgccatcccctgtaattgtttctccatcatcccattcttctttgcctcctcatctctccctaaggatcccattgacagaatttaattgtgttttgcctttattttataaaataacatttaaaagggaaaatttcaagaaaagtaaaagaaagaaaaagaaatcaacaatgaacaaaaataacactcatcaaacatgccattcctgtttagtttataaaaagcttttgtgtttattatccttatttaatattctgtcacttccatgaagaaattatttttttttgaaaagagataatgagaaagaataaagagacgaagagtgagatatagaggcatacaggaataaggatgagacagagaaagaaagaaaatatttttgaaaaagagcctgaaagaaagaaaaggaatgaaatgagtcattaaaggctggtttttcagttgtacaggtggaggagatgctgggaaatcctcagtctacctcataccaaacagcagctaattcaacatccccaaccacatcagctcgaggggaaaaccctttcatccttacacactaaaataccgaagtggggaaggagggggttgtctcagtatgtgtgtacaaggagcatacagacaagctactcacatttacagtcataaataatgtagtagctcagctttaaaaaaccacaggttaaaggaagaggcttccctgacgcacaggagaggggctgagatcagaggaaccactgaaagggttggagagaaacaatgaatcccttgttctaagtaatatttatgagtgcttctttgcaccttaagttcatattttattggctgggccgtggggtttccccatttgctcatctcttaaaataatacccttggctaagatatcctttaaaacacactagtcagccctgacaaacagctcatttatttagaggaaaaagggatctgttttgattttgatgtcagattgggatgtttaagattcagctcacaaagtctgacagtaagataaaaataatggtggagtattcacctgactttttcagagatgtttaaaacaatctgcataaccaagtagtagtaacacctagtttgtatgagtcttgaccaagaagctgtggataaatgataattttaaaaggcagaaacaaaatctatgaaaatgtacaatgtttaaaaagagaaaaaaatactatttgtagattagtaagaaaggtctttagtggtttggggagaaaaaaacaacaaaaacaaacaaacaaaaaaccccataaatcaaaaagaatgcattaacctcggcttggaaggcagtgaattaaatacatattacataactcttagaaactaaaaccttgtataattctgaatagttggatgttgaaattaaactggaggttgtgctgttttatgacttctaagacaatgaagatccttgtcttcaatattgtgtttgttcaatttctttctagaaaaaaaattagcaacttttattgttcttgttaaacaggtttcctggagttgttaggaataaagaaaatagttttaaaatgtcaggatcaacagatgtaaatcctatttagattttattcaggactataacacatgtctaaatcaagaaaagatttattaacatgtacaaaatccttcagctattttaatgctataatgacatgaaaagttcaatgttatttgttgttctgactctgtgattaccctttctatataggagacacagccatctccagaatcttcagttcatggcatattactgctcacatgactttaaagttcaattataaattaaatttagttgctttcttttctgtgcttccatggcagaaatagagtagtatacaggaagccagaatgcttggattggaatcccatattccacgcttactagcagcgtgaacttgagcaagttatttaaattatttgtgcgtctggttgcttatctaaaaagtgcagataataagatcaccttcctcgatgaatgttgagataatctgcatgagcagctacataatctgtggaccctgatgcaaatgaaaatgcaagccccttattcaaaaattattaagaatttcaagatggtggcagcagagtattacaccaagagcagggcccttctaagcccgggaccctgtgcaactgcgcaggtcacttgcccgtgatgctagtcctacatgtttgattacatgttgtggcaacagaaaccatgtcccattcatcccttcccgcctgccccacccactgagatgtatcagcatttccagaagaaaagagacagaatgtgcaaactgaattatttaggagagtttaaatgatgttataatgtttatagtgttgtgggcagaggttttgttttgttttgttgcagcaaaacaagggatcatatagtatcttgggatggcagggtagccttcactactcctgggcagggggcatagttaccagaaagctcagaggagagatatgtggggaaggtgccctgacagaaactgtggcattgggagaaagatgccatgcatctaatccttagatactcagcgggggggatacagataccaagggataaatacccagaccatatgctttggtcttccattggttcaccctcactgaaagccagagagccacagaacccattggtgcagttcctaaaagttagtcttttggtgagaatagcagaatagggaaatgtggagagtggatcttgaggtacaaatggaagatatttggcacaagtagataaataaacattggttgtttagtcagcaagtgttctagaattacttcaatttcagtgcaagttactgatatatatgttaatctttgtattatttagttaatttatagtaaaattcaagagagaataataatttagtgtgagagataattacttcaggagttggtgaaataaagtggtaaatataagcatggcatgctgaaagaaaaaatccttaaattgtacatgggtcaataatttcaggtgatatattaaaaccattttagagaaaattgaaattaagaaacaaaaattacccagaaaacagaagcccctaaaacaagaaaaagcagcactttcagatcacaatatgaactgcggactgcaattgccaatgaaaaaattcagtatgggaacgagaagaatatatgcaagtatgtagagcaaaatgaagagcaatatatttttcaaatccctgtttattgtcaattgtatgccatacctcctgagatgatccacgactgtgtgttaaagcttttttgaattctgagtggaatcatatgatattctcacatgcagcattcgcattccatagttaatgttgcaggcataaataatgttagaatgaggtagatagggattattgtctttcttctttgctacctttattctcctctggcagaccatctgtgactcagagaggcagaatttagtagtggagcaggtatgtcagctatttagttctcataaataatcaagcactaaaccttgaggccagagccactccctgcccttcaatcacagagaaacactgaatagaacaactcctttccagtacagtttgtgttttccatcaaatttgctacagttggaaatttcacttatataattattaaaagaggaagagagggtgcaactcagaaactgtgtaggctcttctgcaaataaccttgatgcagacacacaaaagacttatttatctagtggggaagcaatgaaggttattaattaaatatgctttatgtcaaaatttttgtagatgtattctttgctctgggtgaagaagggtcatttggttctcccttaactgttttagtagggtttcagtgttagggttttggagccagactggtttgaattccagctgcgtatccttgagcaaaccatttcacttcgttgaaactatttcctcatctaagtggagctcataatacagaattggagttaagactgtataatgtaaggtcctagacttttgagcctacatgagacaaatactaaattaatggtctcaactgctattacaactatttctactagaatatactatggagatctaatgttagaggaaatctacattcagcctacaagactttgtcaaataaatgccttgctgaaattctgaaacattatgcacataatttttcctctgtctaaaagaaaaaccttgaatttcattgactctttcttcaagctggacagctgatggactctgttcccccactagagtgctttggaaaaggtcagtctatgtcagagccttcatgagacggactgtggtgctttcctctgaggacccaaaagcaacattttctgtgattagctgctgaaaggtgcttttcatactacctttggtcagagtcctagaactattccatggttttactttaattttagatattacctgttccatttccttgcttgttaaggaggggaaactaattagaagccaaggtagtaatatacaattagaagatatttgattgtaaagacatggacagtctataaagaaccctttgaaagaatgtaaaaaaaaaatgaaaagtttttaatgcttattttcataagtcaactcactttgagggttttaatttttaagaagttgattcatgatgaaaatttaggtgtataaacttttaaactctaagcaggaaagtcactctgttcaaataatctttcaatcctggagctttcagtattgtctgtaactcaaatcatgtctgaatttatgatttataatttgcagctattctcattactacttaaatcattattataattttgtttctacttaataccattcagccttaagtattgtgactttcctcgacgatttgtttgggttttttttttcagatgcggctattaaatatttttgttaattatcttgagttgttataataacttataattttttaaacaggatgaaaatgtatttgtttggtctccaaagccacacaaaaggccatacataaactgtggacatcttctattacaggatgcacattgtaaaatcatcacattgatttttgatatttcattatatattgagtgggaaaacatagatttattgttttctcattatttgataaaatgctggaagataagtcattaatatgatgtctcagtctgtttgtgttgatgtaacacaatacctgagactgagtaatttataaggaaaagtttgtttggctcatgattcaggaggctgagaaatctaagatcaggcagcccattcgatgagtgtctcatgctgttttaactcttggtggaaagtagaagggaacgtgagtatgtgcagagacacacaagagagactggacttattacagcctgctctcaagggaactaatccattcccaggcgaccaataactccctccctcccacaagatgacatttatctattcataacggcagtgccttcataatccaagcacctttcacaaggttccaattccaaacgctgccatattgggaatcaactttcaacatgagcttaggagaggacatactcaaatcgtagtgataattactgctagatttttaattgtgatgggtagttattaaaataagtacagattccagctacatatttattgatatattcgaaccaccatttaaggtttttctctttacactttacattaaaagttatcattcttcagtaatttacattgaggaataattttatttatcagaattaagtgagctttttttttatatgtgtgatgcattcacggttatgcatctttaaaaatgggggtgtaccttctgagaaacgtttctttaggtgatttcatcactgtaccaatattatagagtgtacttacacaaacctagatggcatatcctactaaacacctcagctagatggtaaagcctattgctcctaagctacacacctctatagcatgttactgcactgaaaactgtaggaaattgtaacaccatggtaagtatttgtttattgaaacatatctgaaaacacgtaattggttgtgctacattatgatggctatgatgtcactagatgataggaatttttgagctccattataatcttatgagaccagtgttatatatacaatccatgttgacctaaacattgtcattatgtggctgcttatcgtatataaaattttcaggtcttagtatggttgtagcagtgataattaaaggaataataacaacaataaatgtagttcccatggcagagactggactctgtgatttttatgcgttatttcaatttatccacatcttaattccataggtaaatatatttctgccaatgtattgatgtaaaaattgagggtgttctgagggtaaataacttataaaagtcacccagctagtgaatggcagaatcattactggagccatgctctggcgacagtttttatattcttcaccattattctttgctttgtaacaaaattttgaagaagttaaaaagtatacaacttttaacaacaacaataataatggcttatattttttaaaagcatctttatatacgttatgtggtttgatctaaattaccgcagtatatagccctcaaggaagtagatatgatcccacaacacacatctatggaaactggagttctgaaaggtcattcattcagtcatttaacaaatataagctgattacctactattgggccagacactgtgcgaaagactgtgcctgttttactgccaaaatcacagggcaaaggagccaggtccaggcccagaatccttcattcttgtgccaggattttttttctttgctcaatgtcacatactttaaataaatcacacccaaaatctagcaccaagtaaaattaaaaacaccaacaaaaatccctttaaagaattttttttaaaagtctgttaccagttgacagaacctatggaagccttttagtccaaaaagactggagcaaaggtaaaaccaagtcgcagcaaagcttggagagtctgttagaagcctgcttgtgtagctctgggaaattattagtatggaggctccagtgactttcaaggaaatatccgaaaagaaggttttatattttacactggatgctaattgtacattccaaaatataagtgtgtctcaaacattcattgtttgtgttgtattcaggaaataaggatacaagagcattcaatttttcaaaattaagttgttggagctgtctaaatcttacctctggccctatcttacttcttcaattgtgatggataaagattttcacccatattttactgctaacaagactgtatacaatgtttactttgctactgtatacattgaacataatgtagtttcaggatataatagtcaatggagatacaattataaattgaaataaaaggggattctgagaattggtataaggaccactttcatacatttccttgaatctacttacggtattggggattgggcaatgattactttaagttgattgtcgagaaaaatcgaccaatattctatgacttccttactctttcctggtagtttactgtgattgtgaagtaaaaattgcatcaaaatatggatataagtgtactggtacaccatcatagttgttagcgttcacctatcaattcacatcaacaaagcattctatcataaaagtgaaataatagaagtggaagaagttaagaccttaatgatttcttctctagtggatattctgtttgctacagctagcgtagtgcttatgatgtgcaagagagcatgcaaatagcatttcaagtgctaacattttaatttttcataaagtcactcagttttatagatgaagaaattgagaccctgaagtcctttgtccgaagtcctacttcctgtaataggaagaactggattcagagctcaagctattcactgatatgctgtgctgcctttgtcaatgctattgagaaggctgctgtgttgaattctttgtaaagttctatatactttccaacatattatatattgaatttgcactattttcacttcatcagtaagggacataaaatggcataaaatgaaataaaaatattttagaagaaagtctgtaataatgagtttaccaagagtctactccctggagttcaactgttacgggcttttgatagatgagttgtgttgctggccttccaaaggaggcaaatactcatgaaacagaggaaaagaagcactgtgcagacaccaaagatactgacatttgtgacatacaatctaattggtcagtaatgaggagtggaaagattgatctgtgttattgattcccacttttaaaagacagatttggcataaacaagattaacatttggcaaaatagaaaagaggtaaaatatcaaagttgcaaatagtaataggccttaaaagaagggttggagattggaataaagtattagtgagtttaattgtatgctgggtgatttccaacctgctggccggtctagaaggccatataagcagggctgccatgctgctaagtatgagtgccttgcctcagcttctctgaccccactggggattggccagcaaattagtagaaacctactaaagtggaagtttgggctgcaggaacatctacagctgacaagttaggaatctcctactgcttgctgcagctagaaactgacagataacttctgcttcatcttgctagtcatgactgaaactcctctgtgttctagataatatttaataacatcccatatttagtacacatcctttgatttgtagcagttacagccctaatctcttgcatgtgtaaagtgagtttctttccatagctcactcattgcccctgtatcacacaaaagctgaatatattatttctgctccttatgtattttatgaattaaagggtaaggacttgggatatatttgttttccaaaagaaaatatttctggagctacaaaatttctcaaagcaaaatgcagaagtacatgaggacagttcagacccggctatcctcagctcccaataccaaacagagggaaccaaacaatgaattatgaaaagtaggtacagttgttaacatactgacgtttagctaaaacactgaaaactaatctctgctttgaaaagcaaggcaagaagtagctaagagtaaaaatgagcatttaagacatcacctgctgcttcttaaaaattctattttgtttctctctctctctctctttacctttagccactcgtacccaatctaccaatagcccaattgtaatgctagaagtgtgaaggatcttaatatctgatttctaattatttagtctgagacatgcttaggaagtcagatgaacttatgaataagtcaaacatttaatttttattagactaatttcattgacatatgataaaacatgtgcttaactataattatattcaaatctcttggccactttcaatcatttactctttttaatcagagttctttgtcagggtttcctgaaatgaatttcgttgaaaacattactttttaaaaaaattttttgagacaggatcttgctctgttacccaggctggaggtcagtggtgtgatctcggctcactgcagcctcacctcctgggctcaagcagtcctcccacctcaggctcccaagcacctgggactacaggcccatgccactgcacatggctaatttttaaaattgttttggagatgaagtctccctatattgcccaggctggtctcaaatcctgtgcttgtgagatttgcctgtcttagcttcccaaagtgctgggattataggcatgagccaccaaaacatttctctgtccttttcagaggtgttgtctgaaattttgtggccaaataaatttgaactatgcaaagaaactaattcaataggttcttatgttttcaggacaggattcctcagtgtgtttattatgctaatgagcattatgaatctctgcaaggaggatataagttacagtgtttaacatgattgatcattggtatttggaagaaactttcctttatggagaaggactgtttataaaagccattctggaaatacagcaaacagaacgttatgatactttaatttgttgacattgtagtcacttttatgtcaaattaaaaaggagcaggaaaaaagttacaattccattatctagagccaattattgttgatgtttttgtacatttcctcttatactttaaaaatacacctttttgtatagttgaactgtttatgtaaggttgtacccttacttaattcttgatttttaagtttttgagttttctcatttgttcattttctccttatgaatatatttttgatgactgaataatatcagctagacaattcattgtcatatttgcataaacagtattttattattgggcatgcaatttttttagtttttactattgtgtgctgtgttgcaatagctatttttactcatatgttcttaaacattcctgaccagttttttagagtctgttcttagaaaacgaattattagagcaaaaggtgtgaccttttttaatgcatttacacagaattacattgaggagttcctgaggaaaatgaacccaggaacactgataattgaaactaaccagtgtttcaatatcactgctaaatcacttgctatcctatacctttttaaactttttttttaaaattttactttaagttgtgggatacacgtcatgtgcagaacgtgcaggtttgttacctagatatacatgtgccatggtggtttgctgcacctatcaacttatcatctaggttttaagccccgcatgcatttatcctaatgctctccctccctttgccccctactcgccgacaggccccagtgtgtgatgttcccctccttgtgtccatatgttctcattgttcaattcccacttatgagtgaaaacatgcagtgtttggttttctattcctgtgttagtttccagcttcatccatgtccctgcaaaggacgtgaactcattcttttttatggctgcatagtattccattgtgtatatgtgccacattttctttatccagtctatcaatgatgggcatttgggttggacccaagtctttgctattgtaaatagtgctgcaataaatacacgtttaagcctcctgaaaaatacactaaattgcttttcagtaaatttgtttcaatttctgtttgtatgagtgtaaacgttagtattattttaccagaatgaaacctgaattaatattatgtatttccattcttgataatctaaaacatactcttttatttgtgtttcttctgagatttattaatcttttatattttctctttggggagttttaagtttgcagcttatgcttagaaattcctcctgtgactaggtgttaataattatttacttttttttctgttgtttgctttgatctcttttcagccaactcaactcattatttgtaaatagcagtcatgtgaagacatttccagatatttaagaattttaaaaacataccgtcaacattctattttgaaaataattgctcaaagtcatcctataggtaattgctgaaaaaaaattgagaagaatgaggtgtttataatattcaaggagttagagttttagaattaaatgaggtgagcaaatagatttggtctaaataacttgatgttcaaataaccttctataacttaattataaaacgctcaagtatatatgagcaaagaataatttggatggcagagatgtaatacctcatttataacactgtttaaaaggtgttggccaagtgtggtggtgcatgcctgtcatcccagcactttgggaggccgaggtgggtggatcacctgaggtcaggcattcaaaaccagcctggccagcatggtgaaaccctgtctctactgaaaatacaaaaattagccaggcctggtggcgcatgcctgtaatcccagctcttgggaggctgaggcaggagaatcgcttgagcctgggaggtggaggttgcagtgagccgagatctcaccattgtactccagcctggacaagaaaagtgaaactctgtctcaaaaaaaccaaaaataaataaataaagctgtcattttgggattgcagagaaggattactaaataaatgtatacattatttttcaattgagtagtaattgcatgcatttacccacaaattatatactttatagtttagtatcaagtttgatttttgagtcaaagcatttcttttcatggaatctcaagatgttttggaactttttgccatcggcaattatttaaatgatcacaatgatataggatattcataacccacttttggcaccttgatctctttagtatcttctagattgatagttacttctaagggatatgaaagagtgcgaaagtatggctgcatttttgttttggctaaacctggtctctaaatgtaaggttttcattatacatatttatcatcttatcaacctttcttagctttaaacattttataatcatacataataactttttgagtctcaatactgtatcatagcatagtttttaaaatgtcatttaagcaacaattactaatgtaaattcaagtaacatattgtgttagctgcaaaaataatgccactgaagaagcagttgagtgatcgataaactctaaatcaaataataaggtatatcaggactgcatgagcagaagaaaacagtgttcaaaattttatattagtaagtctaggattcaaaaaattgaatgacattgaacaaaacaagtcactatgatcatgaaccacataaaactttacaaagcttcggcagtgtcaactctgtatatggaaagtaataaattaaaatgtttaaggtaaagatgattagaaatgtaagtaaaaattggtagaagcaaaactgtagtgtgaaatctttccataaaattaatactgcataatagcctacacacacacatacaaatgtaaaataattttgtacttaaataatacaattaataatattaaattaaatggtacataatgaagattgtgctttgaaatatattgatatgtatgaaatcatgatttttgagattccatggaacagttaaatcaatcactaatcgggtggtatgtaagtgtaaaaatataaaaagtatagataattaataaacatgtaagaaaatgttcaacactatcaattattagagaattgctaattaaaactaaaatgagataccactacacatcataaaaatggctaaaatagaaaaagaaataaaaaaccctgaactcagaaaaccaagtgcgtcaatgatgcagaccaactaaaacacgtataaattgctggtaggtatgcaaaataatacaaccacgtagaaaatatcttacaattttttgataacattaaacttatgcttgccattatgacacaaatctcagttccaggtatttacctagagaaatggaaacttgggttcacacaaaagcctgtacatgaatgtttatagtgattgtattcacaattctccaaaactggaaacaacttaaacatccttcagtgactgaataagcagtgacacacccattgaattagacttcttggcaacattaaaaggggagaacaattgataatgctaaaacataaacctaaaatacatctagctaagtgaaaaataccagacccaaagggctatatattgtctaatttcatttgtatgaaattctagaataagcaaaattgtagatataggaacagattagtattttccagggattaaaggtggggtgaaagactgactacaaaagagccatgaacaggtaatggaactattctgtatcttgactgtggtggtgatcaccgattctgcatttgtcaaaagccatagagctaatggtagatttcactggtaaaagcaaattacagaggcagattatgccgtgtttacaatcaagtattcataaaatatataaaagagctatttaaaataaacagctatattaagagaggaaattacatgtttaaggaataacatttaaaaaatacttaaaaatttatcaaaacagaaaagtagcagccaaagaactgtatgataaattaatgtgtttggaagtttggtaccaaaagaaaaatatcagaataaatgtatattaataaattaagcatctgattaaacatactccatgaaatcctaaaaggactacatgcaggagtgaaagcaaaatgtgctgagttagaaaacaaaaacaataggattaattcgtctaagggttgttaatttgcaagaccaagtaatcaacaaacttctggtaaacttaataaaaatagaaaaatcccaaacaaataaaaagagaaataacatagtataaatattcactagcactttaatgattactacattaactctatgctaatatctaatatattaaaaatccccccccttttttttcttttgagagaggatcttgctctgtcacctaggctggaatgcagtggcaccatcctaactcactgcagctttgaccatctgggctcaagtgatgcttccacctcgaccttccacactctcccccaaaataaataaataaaaataactaattgaataaaaataaaaacaaataaataaaaatttaaaaaggaagtgttgaaattacaggtatgagccagcatgccccacgcacctcattaaaaatcttatcgagatgtcccaggaatgagaaacataaataggtaaacaatattggtagttgctgaaaatatgatcaaaagcttttttctgttttctaaaggagaagaggaaatttgtcattttaggggggagagaaaaaaagaaacacatcaaatgctacataaattggtccagactattttaaaaatatgaaaaactgcatagtattttttaataaattagcataacatgcatacaaaaatataaaaaagagagtcttttgcatagaaatcttacttaaaattatttgcaaatcaaaatcaaaaatactgtggaaaaatcttaattaaaatacttgcaaattgaaattgagtatttttaaaagagtcatttgtctttatcaattgattttaattctagaaatgaaaggatgatttaattttagggaatctatcaattcaatgaagcatatgaggtaaaattaggaaactaatctgaatttatggcatacctaaaatatttgacatttagagccaatcatttcaataccttgctcctctatgtgacaaaattatcttcaacaataattgtgaaatgagtctagtaaaataaggctaaaaagaaaatacagtgaaaattatctttattgaatgataaatatatatgcatatatacacacatatacatatatgtgtatgaatgccaataaaataagaaaaaaatacagtataaaaaagagacattagattaaccctcttaaattgcattaattttattgaaatgaaaaaatattgatcaatatcaacatcttggtcaattatataagaaatagttttcatttccaaggtttctgcaaatttgtcaatgactttatcaaaatgatctttatatattttgtttagtatcaggatgtccagatctgctaatctgtcttcactcctacttgataaaatcataatttatataaatcttatttttgaaagttttttcatgcacacaacatatataaaagtagaaaatgtcttaaacacaaagaaattggttagaaattcatagaaacctttttctccatcaatttcagaaattataatgcagtctgtcattgtttctttggatttgttgtggttttccagagttttcacatttgaaaatgtttgctaaaatatccttacaaaaaataaaataaaacaatattatatttggtaaaaaattctgaagtatataatggttttgaaattggttgagcttacttagggtagtatttgtgtctctaagtcatgaggtactacatattcctgcaagcaaacagtagatttgatataaacaatgatagcacagtgatcgtaaagaaaaaatataaccgtacttcagttcttactcaccccatgtgtatcgggtttgactgtataaccagcagttctctacattagcttccatggaatacaatgtttattaaaggataaataataaaaatgtgctaattggaaacttacatacatattatgaaaatacagcagttgcaacagcaatttttaaaactttgctcaacacaaattttttctgggaggaatattttgtcattgacactgtttagaattgctggaggcatggggataataaaaagcagaatgactaatagttggttgtattactgtttttaaatcctctacagaaagtgaatctttttctttcctgaacccagaggggcttgctctaaccacctaaccttggtacagcaatgatgttaataggagattaatggcatgcaataaaacttgattctgtttcctattaaggaaagagagtcagagagagagagagagagagaaagcgggggagggggagggggagagagacagagagagagctaggaatagaaagataatttactcatatgataaataatatctatcacaaattagcaacaaattttattttattgtattttatcttattttattttattttattttattttattttattttattttattttattttattttattttattttattttattttatttatgtatttgagatgtagtcttcctctgtaacccaggctggagttgcagtggtgcgatctcggctcactgcaatctccgcttcccagtttcaagtgattctcctgcctcagtctcctgagtagctgggactacaggcgggcaccaccatgcccagctaatttttgtatttttagtagagatggggcttcaccgcgttagccaggatggtctcgatctcctgacctcgtgatccacccacctcggcctcccaaagtgctgcaattacaggcgtgagcctccgcgcctggccagcaacaaatattttaataataaaattatgtctaatgaaattccaaattaaggcaaaataaacaacagaagaatgacagcaaaccaaactagtgtactggttatcactatcaataattaacagaggtctggaagtttgaaatgctacaagttttaactgtatacagttgataatattgctttctttaggaatcaactgaaaacatactaaaattaattggtatgactaagagagcagaaataagactaaaaataaaaacacaatggatttcttctatgtaaagagcactcagagactatgatgaaaatattacataccaatgacagtagaagtagaaaaaaacaccaaaataatagtgtgaaaagtttaattggaattcttaacaagaacatgtaagattttcatgactaaattttatataaataaaaacttgtataaataagttgtgacacaattttctgaatgagaaaagagagatgaaatattgtctttctatttgcatatagatttactatcaatctgaaagtcttaactgaatctttcttggatcgtcacaaaaatatacaaaaaaaactcatcttaaaataaaaatcagctaagaactagtggaacagcaagtttagtaattttcctaccaaattttaatgtacattttaaagccctactaaatattttaatattttatatattgctataatagaacaaattgtatatagcatgcttcctgaattggatagattttaatatcatgagagtagatagatatactaacagaaataaattcattttactaataagtgcttggcatataaaaacaatactttggggggatagaataggaggcatgaaaatttgggctaatacaatttccttctaaatttactgaaaaatgagaaggatcttcaactttcttgcagagtcattcactcaagatacctttgcaataaaataaacttcccaacatctgacatggcccatacttaaaaggatgcttttcataccttttaaggaatcttttctgtgatttactagagggaatgtagattttttttattatcaggtgctttctatgacatctaatcagagtattaacactgtggccatgacaagtgtttaaaatttaaaagtacttttgtaatacttaatcctcttaagttgatttttatttttaccgaagttatacttgcacatggcctaaatcatgctataaagttttgttaagaaaaacagaagttcactttattttccaagtccacagattcctttgcagttcagtggttctactgcctattcctctctccagaaatgttctagtaatattccctggggtggaagccagctttccacacttcttccagaggtactaccacctgcctccatgggagaactggctctggacaaccgctctagtcttgctttgtctactgctcctgcctatctcccttaaaagcattagcttctctcccttctcctgtgacatacatagcgtattcctcactccatgacattgtcataggactgaaagaagccaggaagggaagttgtgtacaagtaagctctgttttctgttttaaagcgcaatcatccactgaaagaaaaaatagcacagagacctgtctagctgcttagaatggggagaagaaaattaagagaaaaaaaatgataaatagcttttcttttccttattctattaaagtaaaaaaaaaaaaaaagcaaaacaaaacaaaacaaaacaaaaacaaaaaacccacaacactaatattttgtgccactatgctctttgctctaaggaatataaagtaggatacacaaaactgcttttaagaaattcagtctgttagatcaaaacagtaactttggtagtagctatcttttaccattcaactgctatgcagtgcagaaaatgctagatggtatacaaacatttcatcacttaaagcattctacatcttgtaaggtaaactgtttattatctcctgtttgcaatgaggaaattgaggtttggagaggcccacatttacacaactaatgagttaagaagatgggactggaacctactttcttaatcactatgctaaacagcctgcagatacacatttagttgatgctaaataaatatttgatgaaagaatttctaataaaagacagacatggcttatgatgaatggcagtgcctttatcaaataagcattactgtgaatgctttgccagaagaggaaaggattactgtgaggaggcagaaggtagaaaatgtgcacaaagtaaggcttacactggataaaatttgtgacagaggaactttgtgggataaagtaataacttgagcagtggtgtgaatatataaggtatgtatatatcactggggcccagcatccctgattaaggatattaaatatatcctaggtagggatctatctatctacctctaatctatctatctatctatatctatcgatctatctatctatctatctatctatctatctatctatctacctacttacctaactacctatctataaatacacacataaacttttctatcaggtaaatatttatgttctacttgacatttgccaggcatgtctaagcgatttatatgtattagctcatataatcctcaacaacaaaattacaatataaatactatgattaatccctattttacagatgaataaaagctaaaagtcaagtaacttggtaaaggttgtgcaacttgtagatgacacctgagatttgaatccagatttttcaaggaaaggtgatgtattagagataaacatgaagtgctgttcttggtcaaaaactaaaaaagtatggccctgatagaccttgaaagatactatgtatgcaaaggacttcaaaatgctgtttaagcacaagtttcagaggaaacaaattgataggtccaccagaaaatgtactgtaagtttaggttttattagtagaatagattatcaagggtaggatagaaatagtcctcatctacatgttgatcagagaaatctaggatgattttcattcacttctggtctccataatttaataaatatatagagaaagtttaacatgttcataggaggtaaatgcagggtgtgagggtgttctaaattatatattaggaatgcttgaaggaaatcttttaaaagcttttcatcttacatataataaaattcaaactcctcactctgttctacatatccctaaataatatctattttggctagcccttttacatttttcctaactcttcctgcagctcactctgctttagtttgctccttttgctcttccttaaataagacagtgtccttccacagggcctttgcacctgccattcacactgcctaaatattcctctccaatctatgtgtgttgcttactctcatgttagtaaattgccagtttttcagagatttcttcctcaatcatcttatgtaaaatagcattcatattactctctattcacttaccctggtatatgtgtgcacatgtctgcatatatgtatgttcatgtgtaggtacgcacatacataagaagacctttatcagcacctgatattatttatatattcaacaagtcttagttcttgctgttacagttttctccggtagaatatgaactctataaggatagggactttgcctcttttcttcactcctatagccccagaccacagcagtgtgcctgaaacacagaagggtcacaacaaatattgattgaaagaataaatgatggaccatttagcttcaagaagaaaaaaatgcaatgaggctaattgttatcttcaaatatttgaattgcttttgcatagaagtgtgattagacataatctaaaatagagctaaattaatggtaatcccatttttaataacagtcacagtggttcagagatgaagtgtgtttattctctgttactgaatatgttcaaccagtgacagcctaatttcttaggtaagatttagaaaggatcatatttggactaaatgaattgtaagagctggtctaatcctgcagtctttgattttatgactggagataagggaaaaatgattcctgctgcatcctttgtcccacctgatacctggctcatatttagaatcatagcattttagggctgacagagactaaagatcacatagagactgaagttgaaaaccaggagatgatattatctttctgcaacaaaaccaactatgatcatccacggaccacagcataaactcccaactcctcagtcatcaataaatatttattaacctctaactacttgctaggcagtgttttcaaccctgaggttacagcagcaaatgagataaacaagaactttcttttcattgtgataccatttatcatatcgtagctagacttacatgtatgtgtataaatgtatgtatatattgaatatatgaataatatgaatatattgaattataagtagtatatcactcatctaaattttgtgtgttattactaaatggaaaagatagggaatcaagtgtagtgactgggaaacagtgttttctttgtttacaaatttgcattcttttggcttttgaatgattataccaaagtgacagctgttggtcaaccagaaaccaggagtcagctgaatttttgcaggatatttattcatacattagggtggtcttccaggaaacagaacaacaaacagaatattttacaggcagtgttatagaaatatacacaaagaagcattctggttgaaagtagaaacttttgacctcacacagggaagtctaaatgtaacttaggctacaccagcagttttgactaggaaagtaaatagaagtttttaaaaagttgtttttaaaataatggcttaaaagattaactgtacaaattaaaatccaattaattatccttttaaggaaaattaattgaagtagagttaaaagcatccttaacaatattggtgatctatatgaaaaagctataggagtaaaagtgatactattttccctagtagtccttttaaaaattttagagtgcaatttttatttttacaatattgagacatatcactgatattttgatggctaagatactctacagtaatggatattctacacagtggagaattgactacattttataaaatttctgaccaccttttggacattcctgtagatgaaaaaatcaaaacctagatactaaactcacttaacataaaagtaaaaaaaattattgcatttttatatacattgatttttttccattaatatatttgtcattgaagtcaatgaataatagcactttttttggcccaggaatttaataagcatcattttcagttttgataaataatacgactaacggtaatgcaattgtatcagtctacctttaaggccgttgcattcctggtggtgtaaacctatgatcacttctgttgtatgcctacattactttgtaagattaattttgtattgatgttttcaagacagtgagggtaagtaggacacattgcatacaagttttgtctcaggataggaaaaggacacgttacaaacagcataaaatgaagtgctgggactgccctggttgagaatgacaggacaagatgagaagtcatggatatttatcctgggtctggcaaagatgaccacaggggctttaatgtattatggaatgcaatgactttgaatttcagttccaccactttctaagctgtgctaacttgggcaaacaagtctcttggaatattatattttacatcgataaaataggaactgcagtgcctagtctatgagataatggaatagagggtatacaatgtttgggactggtctgggccccttgctggttacccttgctggttattttcctttttttttgaaattttagagcaataatttcatattgaagccactttttaactataaatatttgcttccctgaaatgaaaaccattgaaaaatataatctacctacatatgattataaaatatcacctgaggcatatacataaaaataaaaagaataaaaaattattaaatattatatatttgaatatataaaacttgggtattactctggtggataaaacaatacaaatatcagatgtttgcatctaccagtaatgaagatattcaaatttaagagacatgatgtcagaacccattccattcaagaaatacatcaaaatgaaagagcagacattcagggagatttgagcatataaattagtgtctggataaataagaaactgggtctgttgcacatgaaagaggatactaatttgtgtgtgaatatgagtgcaagtttaattgaagaagaagtacatgacaagagaaatggtctactagagaagttgagaaaatgagagactattatagtttttcaaatgagggtattaagtaacgctaccacgagcacttcaggttgccatcttttctaaactactttgggtggcatctctctctaataatgtaagtgagaaccatcctgaacaactaccatgtgtcttcaataacaccaaataaaatattaaccaaatgaaaattatcaaatcaatatttatatttccctttctattttatttcctatctgcatgtagtatttgagttgtacatttcaagacaatgtcttggctccacttatgctttgctctccaagttgaacattcactgaattactggtattttcatgtacattcttgtaaaaactcttcattattattagcaactgaagaatgaacaatttatatttatgggagtttagtctagtgggccattcaaagactgtgtggggcctgagaaaataaatttttcactatgagggactcattagaaaatagcacttgctcttccagctaaattccaagtctctacatagttccaaactctctctaggagacagcattgctgcctccaaggttttctgtgccttagaaagaggagcgggagtaggagtaggatcaggatggagaagaaattggatttggtgttcttgttcccaaataccttcctctataaaagtatgggaataaggagttaagaatacctgcctaattgaccaatatatgttttttcaagaagactgacatgaaggaatttgataaacttgagtccagggggttcatggtgtaacctccaaatcatagaaggggagaagcatcacaacctctctccctgtataagaggaaccaattctcaatccactgtgtttccttcaaaggcttcttttatggtggttcaacttcatattttaatcaaggtccatatgttggatattaaagtaattttaaagtgtcagtacaatgttgctatcacccagagatctgcatggtaaataagaaacatcttaaggtagtaggagacactcaccttaacagtaagggaagtgttacatattcacacaatccatggaaatcccgtcgccttgtggttatgtcactacatcaaagcatccagatcattttttttttcaagagttgctccatagacccattgtaggttccaggtgaatatgctgcagagagatttagttccttcagatgtcaagtaatttgtatggtaaaatcatatctcagaataattcagaataaagttccatgtttatttttcattgtctcagcacaactgattagttatgaaactgaaatttctcggcaaaaaatttaaatctcattataaatgtccattgaagtaagtatgacagctctgtttcttattatgcacatgtgccatgtaaagatattagccataaaatttgctgaatgtcctttaggggacttcaaattttagtatgtttcaaataacttaaagaacagcatttgtttatggtttttcatgtgtatagacaataataaatataactgatagtcacgtacatggtgaattaaactaaagctatatgatataaacaagttgtctttttgtttttgaaatgaacttaaaatgaattaaacatgtcaaagtcaatatttcaaaatatacatttttagctaaacatttaggtcttttggaaaacattttggttggttctaaacaacattattactttttttctagataagttttatttcttgtatatttcattgatatgaaattataagtattcttagagtttcaaaactacttatggcaagagttaaactgtgtatttaccatattttaaaggtcaagaaaaaaattttcagaagataatgtgatttataaaaattttaataaaaagcattggtattcctattattgaattcacattgaattttaacaatcagctgtaaactattttggcatctcaagtttggaaaagaaagtaatctgttaatttgtagaactcataaaatcactctcgagaaaaaaatccattataagaaaggaaatcacttctaagttaaatatataacattaaaaataagttcacaaatatgcgtaatctgttgtagctataaaattgtatagctttatgatactatatcttccctacattgatagtttttggttttaatttaaaaagcttgctatctttagattgatgtgttaggaaagagaatctgccaatgtttttatttgattatccaaataaaaattagattaatgaggcatgatgacagcagcacagttaaaagaacagataaatcatcagtggaccagcttcaaactttacttgcttttgctcttctgaatataaaatcttagtgggggaggtggcttaatctagaagacagaacaatcaactcttaggctcatgctgtgttaggataaataatatcatactttgttgaaagggtgggtggaaagtttattaaactgaaaacaacccttcctgtattataaatacagattcatattcaagcttctccctagatcattcacctttagtgtatatgttcatagagatgtgaatggagctaagtttaacttttcatgaaaaatcatgactgatacctagtaaaatttaaggacaatttctctttgaaaaaacaagaatgtcataaggtgtattttaaaattatttagataaaacatctttttttgttcaaggcaggataataaaagtatgaattttgaagtcaggcaaacctgcatataaatcttggctcaggcactattaaaaagccttattaacttattcagcacaaatttattaatactttgggttaaagattgcatttgatatgatagtataccagaaagtttctcctatttcagattattttttcccttaatctcagattactccaccataaaattggaataataatagatctatagttgctttttttctattcctaaatgagtgtgcttatagaaaaaccgtttagttctttagcgataaaggcagcttaatctatatgaaacacagcctcagtgtgttacattacagcagaaaacaacataactatgaattggaggaaaaaaaactacaataagtatgatcagatggttaagatggtatgcaagtatttgaaaactgagatcccaaatgtcattatgaagatgtattcttaatcttaaagtagtttttattgacttcagaaatgtcttaattatctagtttataaaatgcttaaatatttaaaggaaactttaaaaaactgtatgcctctatgaaacaatttaatgaaatagccaggctgctttaaaagctaattacttatcagtaagtttataaatatatatatcctaacttatgatatcagagaaaaacgtgttttgcatggtgtaatatagccatgcaaattactcttataaaaaaattaagcaaactagaaaaaatcttaatgctttattttatttactttttttgctgtaaagttttcataagaatctgtttcaattatagggagatttagtgatgtttattcttaggaggctgcatctggtgtaaacaagcaatcagattcttttcagtctcacagcaaagatgaagcaattaaatgggtgaattgaaataatattttacagttgatatatgtaattttagctgaaatatttaagaaatatataaatgtgatttgctcttttgcctgtggtagattaattttagacttataccttcaaagctaagaagtataacacaacaaaacaaataattccaatgaaattgtaaaaaaaaaaataaggcaacttttctaggtatcagacagcagacagtggaggattataatcttcaacagaatgtgtacacacaaaagaagaccccaatttgcccaggttttttgtgtcggggcattttttttttgaggggccggcgtaatgcaagaaggtgaaacctcagctgagagcagcagccagtgaattgaggaggcagtgattggagtctggggttcctgaggcagttcgaattttctaggaaagacactataaataaaggtgctatgtggaggcactgagctttccttgtaaacctgggggagtgttgcattctgtatgtgtaggctgagactctgcagggcctagcagagagtagctgctacagaggtgacttgaacaggcacaccagaagccaagtcatgtaaacatggacattcttgtccaatcagggtggagagaacttgctgacttcttgaacattcggttagggtcccagaaaggccacatcttaggagtaaagatacctaagataggaccatgccttagaactaagaacaaactgaaatagatccgctctaagaaatcacaaaatgaattttgacgggactaagaggattcaccagacatttagttgtcttccagaacaaacctcaacagaccagaaaatgaaaacatacaaactctctgcaacatatcattcataatgtccaactaaattttttaaaaaagtgttgtaaagtcacgatcaatagcggttaatagaaatctactgcaagatgatacagatatttgaattagcagacaaggatttggaaatgcataaatatgtttaaggatagaaaaatctctctctctctctctctctctctctgtctctctctctctgttatgggctgaactttgttctctccaaattcatatgttgaagctgtaactcccagtacttcagaatgtgactatatttggagataaggccatttaaaatgagattaagttaacataaagcctttagggtgaaacataattcaactgagctaatgtctttataaaaagaggacatttggatgcacagaaagaccccagggggtgtgtatgcacagagagacagccatgtgaagaggcagcaagagggtgaccatctgcatgccaagaaaaggactacaaacaaacaaacaaacaaacaaacaccaccaccagacctgtgacaccttgagtttggtcttgtagtctttagtactatgaggaaatacatttttgtggtttaagctaaccagtctgtggcattttgttgtggcagccttagcaaagtaacacaatatatatggactctgggccattatacttgaaaacaaatcaatagaaacaatttaaactgaagaaaagagaatcaaaattttttttggagaaaaacatagctccagtgaccaatgagattctgttcagtgttttaaaataacttttaagaagttctagaaggagagaagagaaaataaataagtagaaaaaaataactgaaaatttggtgaaaaacatcaacatcaacctaatgatctaaaacagcagcccctaacctttgtggcatcagggattggttttgaggaagacaatttttccatggatgcagggtgggatggtttcgctatgaacctgttgttccatctcagaccatcagccattagattctcataaggaacatgcaatgaagatcccttgcatgcacagttaaaaatagggttcgcactcctatgagaacctaatggctctgctggtttgacaggaggcagggctcaggccataatgcttcctcacccactgcttacctcctctcctgctgtgcggcctggttcctacaggccaccaaccagtacccgtctggggcctgggggttggagaccccttttctaaaaagcttagtgaagcctaaggagaactatactacgaaatgtacagctagttacatcatctttaagcagtttaaaatcacaaagaaaaatcttaaatgcagccaaaggaaaaaagacacattacatggagtagtaaatcaatgatataaatgatggctcatttctcatttgaaacattggaaatcagatgacaaagcaataatactttaaaaagataaaaatccatacttttgtaggaaaacatgactaaagtagataaagatgtattttaaataaatgaaagtacaaatatttcaaagcaacacaacctatatgataagaaatgctggaagaaaaatgtcagagtaccagaaaaatagtatcagtatcatgaaagaaatctatacaaaatttacagttaacattatattggaaagtaaaatactgagtgtgttccctctcagataaagaatcaagtaaggttatctatgctcaccatgtctaattcaacattgaattggaggtcttcaccaggaaaataagtcaggagaaatagaaggcataaagatttaaaaagaagaaataaaatactctttatttactgacaacataagtatttttaaagtcctaagaaaaacctacacaattaataaaagaaaaatagttagtggattcagcaaggtcacagaatacaaagttaatataaaaaattgtatttctgtatactgacataaaacaattagaaaataaaattaagaaatatttaccgtagtatcaaaataaatttaacaaaacgtgtttaagatttctatattaaaaactgtaaaacatagctgaaataaagaggcgaactgtgatttcatcaaaataaaaaacttctgtttataagacaccattaagaaaagtaaagtcagagcttcagacaaaatattatcaatatacatacagaaccaagcacgtgtctaaagtatatattgatttctacaaataagtaattataagataaataacctaatagtatacagacaaaaaattgaatagacacttaggaggaggcagagctcctgttataggtatatgaatggcaaaaaaaagtctgaaaaggtatttaatatcattattcactagggaaaagtaaattaaaataacactgtctacaatagcaaaatttaaaaaggataacagcaacaatattggtaaagaaaatgtacatataacctacggtacaccaattgtgctcctatgtattaattaatgttattcaagagacaatagacacctttgttcacagaccaagcatggtggctcatgcctataattccagcactttgggaagccaaggtgggaggatggcttgagaccaggagttcaagactagcctgggcaacatattgggagcctgtctttacaaaaaattgaaaaattagcctggtggttgtgaatgcctgtagtcctccctacttgggaggctgaggtgagaggattgcttgagctcaggaggctgcagtgagctatgattgtaccactgtattccagcctgggtgacagagtgagatcctgccttgaaataaattaataataaatgatgaataaataaaaaataaaaaccttacaaataaaagtaaataaataaaacccctaaataaataaaaatgaaataagaaataaaataaaaataaataagtagaatatttattggagatttattcatatagccccaaatttgaaatgacacaatgattcatcaatagacttatgcaatctaggtatgttatggcatactcacaagatgatataatattaatacttagcattaaaaagaaaatgaacattgatagacctgagaacatgaatgaatctccaaaacattttctatggagatgcaaattatatcttgattgggaattcagttagataagtgtattcgtctattcaaactcatccaattatacaattgtacacttaagatctgtgcatttcactatgtctcaagaaagagctctgttaaaaaacaaatatatgaatttgagcaaaacagaattagaatgaaaacaccatgtggaacatgttatttacagtttataattgttctagataagcatggcagcaaaagcatcatgaaaataaatgattctatagatgtttccaagggggaataataggatagattttttaaatgataaggattttttaaatgatataaataacctggagaagtccagatgtcaaaaacatccccaggggtttgggatcacatcaaattaaaaaccttctgcacagcaagggaaaaaaatcgacaaagtgaagagacatcacatggagtgggagaaaatatttgcaagctacccacctggcaagggattaatggccagaatatataaggagctcaaacaactctataggaaaaaatctaataatttaataaaaaaataggcaaaggatttggatagatatttctcaaaagaagacatacaaatggcaaacaggtatatgaaaaggtgctcaacatcattgatcatcagagaagtgcaaatcaaaactgcaatgagatatcagctcaccccagttaatatggcttatatccaaaagacaggcaataacaaacgcttgtgagggtgtggagaaaagggaaccctggtacactgttgctggagatctaaattagtataaccactatggagaacagtttggaggttccttgaaaaactgcaaattgagctatccaatgatttggcaatcccactgctgggaaaatcagtatatcaaagagataactgcactcctgtgtttgctaaagcactgtttacaatagctaagatttggaagcagcctaagtgtccatcaacagatgaatggatgaagaaattgtgaaacatgtactcaatggagtattattcagccacgaaaaagaatgagacccagtcgtttgcaacaatatggatgaaactaggtatcattaggttaagtaaaatgatccaggcacagaaagacaagcaacgcatgttctcacatttgtgggatctaataatccaaacaattgaactcacggacatagatagtagaaagatggttaccagaggctgggaagggtagtgggaggctggcagggagatggggatggtttggttaatgggtacaaaaaaatagaaagaatgaataaaacctactctttggtagcacaacagaatgactatagtcaataataacttaattgcacattttcaaataactgaaagagtataattggactacttgtaactcaaagaataaatgcttgatgggatggatacactattcttcatgatgtgcttatttcacattacctgccagtattgaaacatctcatgtatcccataaatatatacacctactatgtatccacaaaacttcaaaataaaaaaatttaaaaaataaaggagtacttaatgaaacagatttaaaagacttggccgatttagccaaagtataccaaagtaaatatctatctgtctgtctgtctgcctgcctatctcttctatctgtctgtctatctatctatctatctatctatctatctatctatctatctaaattagttttataaggatataaagagtcatttttttctttcactgttttattgaaagcataaagttaagtcaatcttcttaaacatactgtgttaattatcataattagttaaagaaaaaatgctctgtggtcgcccacacccatagttccagctactcgggagactgagtgggaaggatggcttgagcccaggaggcagaggttgcagtgagcagtgatcgcgccactgcactccagcctagaaaacaaaagcagactctttctcaggaaaaaaaaaaaaaagttactttaaaactttttctagttacataattttcagcaattcttcccatactttcaataccaaaaagcacatttgatagcactacttcttacaaatttgaagaagtttgcttataattattttatttttctacatattttgcctgatttaaaatttttatatccctgtagttaactttaagaagcgttttagattttagtgtgaaacaacatttgagatagattcaaggaacttcctaacactgattctttgcactggaataaaaaatcatgaaagtacagctgtgtgaacgtagagttgacagcactctggaatatgttagttggcaccagtctaaaggctgggagggtaaacaagataacctgggaggtcttccagtaatgcctacgtgtgtgtgtgtgtgtgtgtgtgtgtgtgtgtatgtatgtatgtgtttgtgtgtgtgttggtggggtgaggttaggcagttaagatctttacagcccagatattgtcaactggcaatctacaaagtcagtagacaaaaatctcattctgactactgatttatcacataacttggctaaccaagttttgtcaatttagatttctcatgctggacttctagatttaaacctctctagagtaatagaaaaaggtttctgttggtttgtttttacttttaaaatatgctctctagtctttgcaaaatagttacatacacacgttatataatttggttaatatttgctacttaatgctaacaattttgttgcaaaaatccaataataatcactttcaagcttagtctgaacagtagttattgatttttatatagtacttaataaaacaatgtgtttttagtactcaatttatttcatgaaatactttacgcactcaataaacatcatctacaattaaaataattgtttatcctgtgatattttgtgagtcttttggatatcttaatcaactttacaaatttgttaattttttgattgggaaaattgagctaggtagcctacatttaaataaacatatagatgatgttatgattttatttaatatttaagaaagaaaataccgtattgtgttaaatcaaaatgtattgaaaacatacagtggtatagattacatccctattgtttagttccaaactaatgctgtttaactttaaattcatctcttactttagtttcacatttaaattgaaaactgtttgtaattcttttccccaaattgtttctgacagaaaattgttttcttagtctcttgccactgaagcgattttcaagtgttgcaaatttgctctgttatctttccctcttgaacacaatgtaggctatagttggcatttcagaaaggaaaaatggatttctagaaattgaacataatccaagcctcagacagagggagaaggaaaagtaggaccatgtactcctgagaaaagaacgacatagcttagcattaaacacaacagtactgtctacaacatgcattgttaacaatgaaagctgcttttcattcacaatttcaagctgagcagcttgtacctaataggtgctcagtaaatacgaatagagctagatttgcagtttgagttgatttgcaagttagtatgtaatgctaaatgttaaacagtattgcttaaccaagtcaaagtgttcctgtacatgtgcatttgaaatccaggaaataatttctgctcagttaggaagttttgccccacccatgttacacatttgcatctgtttttatatgcttttgatccaatcttgagttttcttattttttcattgttgagaatttggtgggaaaaattggggacagggtcttggttctcataaaagtatttttcgataatatcttgaaaaataaggtaaatatttttctgctaatgaagctgtgtcaaaagaccaaataagaattgctattcacaatgaatttttctcaaactcactccacatataatttttttttttttttgagatggagtttcactcttgttgctcaggctggagagcaatggcacaacttcgtctcacttcagcctccgcctcctgggttcaaatgattctcctgcctcagtctcctgactagctgggattataggcacctgccaccatgcccagctatttttttgttttaatttttagtacagacatggattcgccatgttagccaggctggtctcgaacttctgacctcaggtggtccacctgcctcaacttcccaaagtgctgggattacaggcgtgagccgctgcacctggcctccatatggaattttatgttatttgtttggtatgtaagcacatatagaatctgtttctgtccatttaaacatgttattttatttatttttatagttaagtcaatgagggtttgtaaattatgagttttacttttttgggggaaaggatggcgtgtattcccttgacagctagtatagtatctgccatatgaaaaagtttaataaaatgatagttaaatttttatagccataatctaaatgaatgtatattggcctgaaaagacaaacaaacaaacaaacatgaaagcagctgagtgcaaggttccctttgagtcagttcagaatcctcagaaacaataaatatggccttctatgtcagagataagaggcaaggcatgttacatacatgaatatctagttttgcttatcaatcgaatgcagataatattagtaatatttacttttattattgaattcttttctcagaatataactaggggtaatgaaaagcaggattaaaggagcgaggaaaggaagtttctgttagtaaagtctaccctaaagtgacttcaagagaacaagacaatttaaaatttcaacaagcaacacattaatcacagatgaaaaaatgctcaatttaactaatgctagttccatgacctatatttcatctagaatcaagccacctcagagggtaattaggtgattgcttgcaggaagttaccctttgttccccattttcccaccttcttttgttccccaatcgtgtgcccaaaatggtggctaaatgataatcattcaatagacatgaaaactgttttcctcttttttcttttactaaatacatattgtattaaatgaaattatagatttttgcataatatctcataactgttattaaaatttttatagtcatcatcattgttgttagtggttctctctggacattgtaggacttctgaatatacaccaaagctttataaattcattaggattccatgattgaacatgggatatcctgcatgattttgggtaagaagaaaagagacactatatcctttagtttctgtgccactattaacatagttaacgacacagacttttatccttcagagattgctgtcctgtttacatattgcttgaatttactaggtaataaatattaatgagcttttttagcccttcattctttcagatgcattcagtttctctttcaaatgagttcacctaatcctttccattacccttgtcagctctgttctgtgtaatgattatttacatggcttcctagagttattttaagttttgctggtttccttcaaaagccgaaaaagaataaagcctgtcataactggaaacatgtaaagcacaacttaggtttgagataatttttgttttcactatgtgttaaaaccaatgtggcataggctggttagtgatgttgatatgttttcaaagtcatgccttatttgaggctgtgaacacacatcaaggggcgagaaaatgaagcagaactttaagtacattggctgtttctatacaagagcaatttttgttgtacttagttgtgattgtaggaataacacttgcattttgcagagtctaaacatcctgtactgtggtcaatgccatgcagattactgaaaatgctccctagtgttagatattcataatatctctgatttatttattttttatttcttagagacaggatcttgctctgtcgcacaggctggagtacagtggcatgatcatagctcactttaaccttgaactcctgggctcaagtcatcttcctgcttgagtctctggagtatctagaagtacaggcatgtgccaccattccccaataatttttttttttaaatttttgtagagacagggtcttgctatgttgcacaagctggtctcaaactcctgccctcaagtgatcctcctgccttagtctcccaaagtgctgggattataggcatggaccactgcacctgtactatgacttatttttaaatgaacaaaacccaaaggaaaagtgagacacagaattttggaatttgcattaacactgtgacagagcaaaaagataaagctcaaaaagaaattcagtaacctcctggcacgtttaataggaggcattgatgtggttaggtaccgatttgaatgcatgctccacagattactatacttatgaacttggataagttaatttttcttcaattagatatgtcatgttttatcaaatatatttcacatataagtacatgtaaaaccaattactattaaaacagatgagaagcacaaagctagatatttaaatacaggtgcttagtggattctttcagaggacgagataaacacagcctctgagtaaaatcctggcttaatttgcctaacagtttttaaagactcttttctggggaggtattgtcctggggatttgggggatctgccaagtggcaagcccaagtacagtccagccaactgaaacatggtgaggggaggtgagcttttctgcaatctcagtttgcaggctcattgtgatcaacagacagctctcaggagtagggaaaaaaagaaaacaaaaattcactggggagaagtgagtgttctcaaatgacccaagaggcagcatggctttgaggagaaagcaagaacttcatgaagacatgtcaggagagctacttgtaggtacagttcaagtctttgctcacctagactttgtcaggttcaaaagatggtacaaatggtaaatgggatatttgtgatgttagcccttaatatagctttccagtacggactatttgcctcctatacttggagcacagccgttgtcctgaaatctcccttcttaagcattatttttgtctctctctgtgttagaccttctctctcctgttacccatgtctttgtcttctttctggtttatttatttcttatatgtatgtgatttgtattttgtctctggaagcctgtaaaatcttctgttcgcctccagtgttctaaatgttcacaacgatgtgtgtccactgagctgggaacactggtttttagtcttgaaattttttgtacttcagataagtgaattgaactatttctttgatgatttcctttttctttttttcttcatctctctttccagaaactattatttggctgattctggacattttttttttattttttaaagtcttcttttctaattttccacttctaattgctctcttttttgagaatttgctcaattcaatctttcaaactgagattaactttctgctttacttccaagagatgttttagcattgactgtttctatttctattttataggatttgtattagtacttgttccatggatgcaataatttcttttagcccttaaaggataatatagtagttttttttagtaggttcctccaagttcctttccttaaaaaaatcaatttttacgtttatatctcaaggtggagaattttctcagctatctggtaataattggttgtctgtgcttatttaatagtgagatattaaaatgctgattagcaacttagcatattggcggaacttgtcagtattattttccctttaggatgctgtttctttgctattttgtggaaacttggtcttttcctcttggatttgtcagatttcaaaaagaggattctcattctcttgcctagaagatataaccctagctgtcgacatcctggcaaccaagtggggaaagaagccgggaatttagcattcagggtgaatattcttgtctagttcctctgtcttgagtatgctaacacactctaactgtgcctggtgttgccagtgaagaaccctctgttttcccttctttaggaaaaaaaaagtctaaacttctcatgtaggaaagaacagtcactcaaaagcacagaatgtgaagagaaacctaagaatctacctgctttgtaaacttctaatactcaaacttgcttattttaacctcaaacttgtatctgcttcacacaatcatttctggagatagtagatatcatcaattcctgaccattttggagaatatgtgacttaaattgttttaattcagccttttctattgtaaatttaggttttatgtaacagtatatatgagttagttagatggattactaaataacattaagaacaagtcaaacttaacagcaaaagcatcagaaaacagatcatctgataactaacataacattggattggagactcaggaaattattaaatttgaatctaaaataagatggtctaacataaatctcaaaagacttattgttgtttccaggtgtgcatcttaagaaacttgaagggtttgtatatttgaactcaaaaccagatactgctcaaagatgcgtagctgaattttgctctgagttttgtggttgacctgaaatcccaatacaaaggaaaagtccaagagtgtgaaaccatgtcaacccaaatatgagactgttcatgtgaatactctgtgaactgagaccactaaggatcccttgactctaattacagtgtggtctcattcaataaaatgtaggaagatcatgtgatttctttattgattctggcacctgttaaatctttattaaatacacatatgttctgaagtaactctccaattatacaatacatctttaaatacaatacattgattcatataactcaccattttaataatgtgctataaagagatgttaagtcatgtattatgtattccagtttctaactgtaaatgtaaagactggtaaagtttaatttgtaaggatgatattagggaaacttatgacatataatagcagtcctaacaaccaaatgtaaaagaaacacacaaaacaaccatacttttgaagggaccaaatgtttttaataccttaaaaagaagcttaaaaattataaatatgttaccaaagatttggttatattacatatacacagtttggtggaatatttttatatgcataagaaaaaatcaatgagaatatagaaattatcatattatgttcaaaaacatcacatatggtgtttcacaatgcgtaattcattctgtggattactttaatacaattctgataataaccataagataaatgttattttttttgcatggttatgtattttttgaattacctttttttcttcctcaagagtaatatattcattaaagaattatagagattctattacactagcatatgtttttaagtaccaacacaggtagtgtgaaactgaaaataaatgtgtgacattaggattctgtctagttatcactatttatttgaatttcctttgaagaaggaagtaaaaaatatatatatactattagaactaatattaatactattttgtggcatgagcagggctgtgccacagtagatggttgaggggttctgcttttgaattcactggaatggcagagtctggatttagccttccttatgaaacaataaaaaaaaatctgaaaaaaaacaagaaaaccaacatatattcctatatttatttattatacatgtatatgaatacctgctgtgtgctagggattgaggtaaggaagagtgtacggtagtaagcaaaacaaaagtgctgctgttatcaagcttacaatctaccgggggagacataaagcaaataatcactccttaggaaacaaacgtgggccacttgcagttcttgcctaaacagaacagaacatcagctactcctatattaattttagagtgtatatgtaatatattcttatagttttattcctaatcttagaaacctgtaaaactaatgtgtctctattaattatatattattccatatgataatcacatttctttgtgattatacatccatgtaccaaacttcactgatgcaacccatttggcagaaaaattcatagtttgtctttttgcaaaatgacagattgaaccacaaattgaacttgagtgaactctattatattataccaatttaaaattaaaagtgggtgatttcagatatttatttgtttgttcagctataaaaatcctcatatcctttaaactatacaaactgtgtcttaaacccactccatttcccccatagagaaatattgagcaaataaaatatacttgtcaacttctttattttttcaagtgtttttttcattgagtataattatttttttctaaataaaatgttcctaaaatataccaagataaacattgaatacactaaaaatgtgattttttaaaaacaaactttctttattatgtaaataaaatatgcaaactccaactattgatatacttagggtgagtggcttcactttgacatcatatgtaaaatggcatggagattacttgtaaattataatctaaggaagtgagaatggatttcaagctaggctaagagctgttaaaggggataatagacttttgatgtctgtcttttcacagtagcacaatagctaattcatgtgacttctgaccttttagtgtcttgtaaccaagtattggcattaatctactacttatctgtcacccaccacatttgatagtcccaatctctgttttcaattatcagtcattagagaaggcactgagcaatttcagaagaaaactcacaaaacctttgacctgtttttgtcatgtaaccacaaatattcactgtagataaactatcaactcactgatttcaagatgtaaaggaaagtcttttgtgtacatagacttactgtaacctctatcacctaaaggtggttaaaaactgttttattttactgatggagcagaagaattcacaagatcatttagtgaaatctggtgagattagaatggttgacctctagctgccagacaatctgtaaaaggaacagattttttccactaaagaaaatgtaagagctaaatattgaccaaaagatggctatcagacagttatgcctttattttaagttgttacaggtaaacacaaaacattctcaaatatttgtacatagtgtcattgaaatctgttatttgtgtagtaaatatactcattcatcattaaccatttttcattatacagaatgaatcagtcaagtaccaccctttgtgggtattctaagctaatttttgacatttaatattaacgtttaactcaaaaagatgtgtatttgcttctaacattcacttaataatttttcctttctaaaatgctcataataaaaacaatagtaaactatgtgtatacttcggaatgcattgttatcctcagtgataaaaataacttaatgactttaagacttaaaaaaaatttgtaagaaccagtaaatttgattacactgatatttcttggcaatttgtgaaccttcaaatatgtgctacgtgttccaccaatatataaacaagatgtcaagtaaatacaactattttttatctatccactgttgtaggaacctagcctgcaggtttttttttaactccataataacaaacatttttaaaaaaaccacaatgacatctagcttctagaaaattatattaagataccaaatgattaatttacctctgcttcctaagagcactcaggtcagaggaaaacccttcctcttagaattttctactatattacttaacaatcctaatgagtcctttctaacagccttttactgagatttgctgtggcatccatctcataatacaagctgaaacaagtcaatacacccaactttgttcatctgcaagtgtgttcccagtgttctattgtctccacaacactgacttaaggtagaggaaaaaggaagaaactaaatgcataggaggagagagcacgctaagaatgagcataggagcttgggagtaaggctaaagcagaaacattgttctggaatggaataggaaaactttgccctgagacagatgtagcagttgttattagttgaaactttcatgcaaagaatattaggagtaataagacctagatattatctctggctttgtgataactaactctgtgacagtgagaaagttaatattgtttatctgtaccatgagggagataatggaagctccaccttgttggatcaaattagggaagaaacaaaaaattaaaatttattaattatattaactccttcattaattaatttattgctacaattgtttatttgttattaatttaattattaaatatataattttcataccaatgcttggtatgcatagctgttatcattacagtattctaaataatcactgaaagctcattgctaggcctaatttaaagaaaacaggaacaccttgagaccaacttcattctaattttagagctttatgtaaggcttaattcttgtttctaaactattatatttttaaagtaaactaatattcaatcaacaattaaatgtcttaattttcaaaattatatgcattatatttaaattgattttgaaaatcaatttgtttagttatagtagaatattacaattatttaactatctaataattctttgagattttgcttctttataaaactgtattcatgaaatatttatgagtaagaggataataactgtagaaaatttgaaagtcaattgaaattatcctttgaaacaaaacattcagggagacaattttctttcattcaggtcacatattactgtgtattaacaggctcttaagacttctggaatctggagtttgccacactctctggaatggttatccattcatggaaaacatgtacatattctttcactgaccaataaataagtctttatagaactaggtttatgttttttggtggactagttagcgaaggatatcttggaaagtgatgcatcttggtagtcacatgatatcattgcttttttttcacttttacaatgcaacacagattagtaataattctatgagtaatctcttaatgattttttgcactcagcagcaaacaatgatctgtattctttcaacagctggctaggctcctgggagaatgctatctttgccttacagctactgctgctatttgtgtcttccaagttacagctcttgtgtgggagattaagactgattgcccatgaatgcatctccttaaaactgcagataaatcactacatagataaaactgtaatcctctgttaattaattctactcttcagataatgtagacatgaaaatatttagcccaggacaatttcatccagtttctattagtgataaagtcattcagagagatatctgcttgggaggaaaaaaaaaacaacttctatcagtcattaacttctgttaacttgtatctcaacaataaaagtcttcagtgtgtgttttaaacagagtttaacctttgcagaactttgacaattcagagcacttaggacatagtttggtgcttatataaaggcaattctgcttcttttcactatcagtccattaatcatgggatgtgaataatttgattcatattttacatcttgtatgctttgatgttaccactttttaaaccaaaatataataataaattatttctcttcttctagcagtgcagttgagttttctatttctctagatagctctgtaatttcacatagtttggagtacacacaaagaaacctgctccctagaagcagaaggaagtgtgtttaccatcattgttgtgtttgtgatttgggtggtaaaatgcatacgttttgctgaagttttgatgttttattttctgtgagtttgtgtatgtgtgtgtgggtataggaaagcaacttgttttaatttttttagagagcgctgttggcaaccatcagctctaataaataaacaaccctatgttgatggacttatttgaatggaataattttacatgataatatttgggatgatctacacctccatccataaagtgtatcattgtaaagtttccttttttcatttttatggtgatattaaatggcttacacctggaaatcttcaaaacgtgtgtgtcataaatgacaacgagagaagagtctgggattagtgaagtctatgtatggctgtttgcaaaatgcacccccctcttggtcttgttagacaggtcagcacatgtaagaatttgaacaggctgctgtggtctccttttaaatacaattattagaagcaaattgattgacacaagtgtttgttactaaacactctttctattctcacacgagagaaatgtcatttttggtctgagataagggatggtactaggaaaaaaagcattaacccctgatctcagtgtgtctttactctgtgtccttctatcccctttaacaagtctgggtctggcttaaatgagccaaaccttctgcctttttgtttgtcttgttttatttgtttttatatggtaattaagagatgctttttcaccaccaaagagggaatgtgtttagggcttttatggagtcttgtgtatctatatctgataaaacagattttactggaaatactggtaaagattctggaaattcatggtatttggttgatgtaaaatatacattaaggaatgaattaaaagggccaaatacatgaatctcaaagccaataatagtatacacttctctgtttttttttcttctcatttacttgtgtatcttttaaccttcccaagtcatttaccactgcagtaggttatagcatactgtaatatacagaaagacagaatgcttaatatttgccaaatttgtcacaatgtgaataagacaaagatctttcttaaaaagctgacatttaaggagtgttaaatgtgtgtgtttgttctttttcatctactttgggagttttgattttggtagcagctctggtaaataaaaggttgggtatgaaggaattctgccggtgaatcacaattatgtcaaaattaaaagctataattaaatttcaacatatggttgtagtgaaagtatgatgttacattaacatatatagtatataatactcaaattatataatcatttgtttattcataaaatattccttagataagaaatgtaatcaatattaaataagtgaataaaaacacatgtgctaagataaagataggaggaggtgtgttctaaaagaatgaactgagtccagaaagaatggcatgtctttattatgggagcatcataaagggaaggggaagggttctttggagagaggataacgaaagcactgaaacaaggtcaactttcccaagaaataattagattgaaaacataacaaaacaaaacaatattcagaaaaacacactccggctgtgttaatgagggcttagaaattgaaatcctgggatgaaatctgttatctttcgattacaagttttgggctctttgacaagttataaaactagtggacttaagtagggtcacggggattaaatgaaatatgtaccacacaaatgatacttaaataagttaccatggcttcagccaagggggaatgcagcaggagttgctgagtggaaagagatgactagattttgacccattcatgcaatttttcattcaattaatatttattaaaagatttctctggattatgtattgtgatgtgttagatgctatatactttttggtgatcaaattccttattctgttcttcacttttttgtgtactgctgaaagacattgtttaaactaacaatgaactagcctctaagtgcagaacagtaggatgtcattatgtaggtggtataggtattgaacgaagatttataataaactttaggagacagacatctgttactatgtagctgtcatcacccaatttcttattcttaagtcagggatattaatatttgccacctccctagtgttactgtttgaggtaactgagattacattgttgaatatttgtgggcatcattaggctgtaagtcttattccattactcattccaatatgtcccatggaatttattgttgcaattatgattcaaagcagtaggatataaggatttgaatcaccagacaagtctgcaatgcaacttcgttctgtgtggtatatttaatataaaattttattaaactctttgaaaatgagtccccttaagggtttaagttaaatagcttggattagaaaactgaaattttataataatggctgaaattctagctttctactttattacactaacatctcacaggggattccagaacggtagattacataacatgaattcaatactcatctgcattaagcaggtgcacactttaggttggatcctagcaaactcatgtcttagcctttatttttaggactatacttgttgctttttggttaaaattttaaatatacaatttaatattaatgaaaaaatgaataatggttgttatcacttagaattatgaatattgaccttcagaatggagaaaatatattttcaaatggctggttggtgcatatatcatgaagtatagtatttgtcaagcagggtctgggacagtgccacctaggccaacacatgacaatttctgcagcaaagcaataaatatttatagaaactgggataaaaagagactttaaatcacttcatgtcagttaacttctggttcttctgtcaaaagagcttgaaaacaaactcgtagttttcagaatgttttggattttggacttgtaaatacaagattttaggtctatgttaacaaaataggacaaagccatagtgtgttagcagacgcagcatatcctgacatttaacaaccatggattggtgacaccaaatgcctgggttcaaagtttttggtaaggtatttattccccatgcttccacagttgcttcatttctaaaatgaggataataagagaacctaccttgtaggctgttatgaggcagaatatgttaatattaataagatgataaaatactgagaatatagtctggcatataaatgctatttagatatggtcacatgatgtcatctacttcatttaaatttaggataagaaaataagaatacagtgagttagatttagttccctgaaagcaaaagttgtggctagttttagcattcttacatgcacatcagttactagctacttaggtagcaggcattttcttcccctagacttccactctcacacagcccagtcaaatggacaaaagggagaggaaggaggagtgtgcagtctgcactatcatggcagtctgcactatcaccagagacaagatttaaattatggaccaaaataacatcttacaaatgggttttttgtccttatttaggaaaaattgattaataatctctctggaaatggacctttcttaggaccaagataatgatattttaagagaataattttatgaatcatgtgaggtggtgttactgtagtcagagagccaaagagcatcatccttgccaagatccacaggacaaaaatgcttccaactgggtgcagtggggaacacctatagtagtcccagctacttgggaggctatggcaggaggatggcttgagtccagggtttctgtaaaataaaatttaaaaaaatatgcccccaaatgtagctacatttttctgtatgcctgctttagattctgagatggaggtgaggatcagcttcttgctctctcctgaaccaccttccacttttctggggaaaataaaccagagattattatggaggatgaaggcaaagcattgtgggttcctttgtcaggagcttcaaatgtggccacccatctggccttagaacatgatgttctagcagccttgtctccgcagcatcattcctgatggtcattatcatcttttcccttccataatcttaatgcttctagcttaggatcctaagtttcatatatgtatagcagtgttataaattttaattaatcttctaaagatttccaatttttgagctttgtgaatcaattaataccacttgtacaatacactatcttacacagccagattatataataatatgtctgatacttactgtcctaaattcttcagcatttcttaatattcccaaaaggaacagttctttgacttcatttgtttggaaggttactaaagagggaaaatatgttcccctctcaattctgaataatgacagaggtttttgagagactttgtactggaccaggggtaagaatttataaaaaatgctttaaaagcaaacaaacaaacaaacaaacaaacaaacaaacaacacggggcagagtagctcatgcaagtaatcccagaactttgggatgccaaattgggaggattgcttgagcccaggatttcgagaccagtctaggtaacatagtgagaccctgcccctacaaaaaataaaaaaattggctgggtgtggtggtgcatgcctgtagtcctagctactctagaggttgaggtgggaggatcacttgagcctgggaggtccaggcgtcagtgagcggtgatcataccactgcactccagcttgggcaacggagtgagacctttctcaagaaaaaaaaaatgtttttaagaaaaagaatattttatttgctgaaaagagaaaaaattttctggggaagacattttagaaacaatctttcttgtaaaaattagtttgctttatttacttgaactttgaaaggccataaacacagtccttgtatacttgcaactcagtcctctttcccatttccctcccatggctgtgctgtctctccagtcatttcacctggaactctggaggttacggtaacatattcagaatttctgtataaaattttctatggtctgatacttgatacatagtagtaatcattttacagccttcacttttaaaaacatttttggataacctttccatttaggatccaggaatttgtataaaaccgcagaggttatattgcttttgaactaaaggctgttggtttgtggaatttcctttaactggaaacacgtttcagtttgtggttttagggtttttccagttttatactatcctgcttgtttgttttctttcaaagctggagaatttatcattaatttccatattttataaaagactaacttttttccccctcaaccccctttattttttcagttgaaagagacaaggatttttctcaccagcgaaggcattacaaagaatttcgatttgatcttacccaaattcctcatggagaggcagtgacagcagctgaattccggatatacaaggaccggagcaacaaccgatttgaaaatgaaacaattaagattagcatatatcaaatcatcaaggaatacacaaataggtataatctttttatttaacttattatcctggcaaatatatgtaaaattttagtaaaagccattgataactcatgtgatctatcaaacaaattatttttttgggggcaatgtagtaacatttagagccaggtagagatattgaaaggtaaccgtaatcgatctgaaaattttctcctacattccagagctgctccctactcctgacaccaattcgtatactaaatagtctcatgcttctaaaaatgtgctttctaggtctgttgtctcattttgtaaagttgtccttcatcccagaaaacttccactttgttctgcccacatgaaatgtataattaagataatgaaattacttggtgttctggaagttagagaagcactgctttacttttcactgacatgagtgtaaaaattgtatgttcatttttatgtgtattttgatgtcctctgtctataagttggttaattcggaatgatacaaaaatggacagatagtctgaaatactaaatgcataaaaacctcagttgataatgactgcaaatgaaccattgaaaataagtgttaaatatcagtcattttctctgatatttaacaaaatgcagaaatcacttggataacacattttttcaggtgatgaatctacctttgtcagacagctcagatctaccatctatctatctatctgtctgtctgtctgtctgtctgtctgtctatctatctatctatctatctctcatgtatctaaatctatttgaaatcctatattgaggtgatatctctctcccagtagctttcattcctcacatctaggtcttccttttgatgaaataatatatccttttttgattagaaaaatatttaaagattgctatcctgtctcctgtaaggtgctgttctctccttgttgacaatatttgcagttcttgatgtttagatttgtcttggtcttccagtttggcagaatttcgcaatagtgccttgcaatactcaatgaagaaaaaattaaaaagcttctgaggtcatgtctattgctaaagccttcctgttagactatcctctcggagattcacaatgcatatcagaatattaaagtcttttttaaaattttttattttaaatcaatttaattttggtcttgaattaaatacaatctaatttgggacattgtgatgtgcccaaagtttgagactaatagtttatcttaaaataagggaagttcttgttctgattctttagaaaagcaaacagcaacagaaaaacaaaacagtgattatatttgagagccagaaaaactttgtaaggaaatagaaactttttatatgcgtctgatataataatcagatcacttatgtttgtcattttgagtggctttgcaaattaggtaccaaaagattaaaaaaaaaaaagccagacactaatgctgctctatctctggtttagaatccaccctgtatacatgtcatctaaagtcatcccatgtagacaaccagaacccaaaaggaggctgtggacaatatatgaatatatgcaggtcttccagcctaatggcacctcccgatattcctgacatacaaaagggctttatgttatcacagtatggtttactcagaagttagtctgggggtgccattcatctgagttgtttggcttgaatacacaaagacttttgtctctaccttggctattttaaataaagtattattattatcattgcaaccacagaagaccatcaatatgatggactcatcagggtttccattatgtacattgtttttctggttttaagctatttcagctgcttaacattcaattaggctacgccttggcttctggattgtaggagtgtttgtcattgtggacagttctgaggcagatttcttttttattttattttattttattattattatactttaagttttagggtacatatgcacaatgtgcaggttcgttacatatgtatacatgtgccatgttggtgtgctgcacccattaactcgtcattcagcattaggtatatctcctaatgctatccctcccccctcctcccaccccacaacagtccccagtgtgtgatgttccccttcctgtgtccatgtgttctcattgttcaattcccacctatgagtgagaacatgaggtgtttggttttttgtccttgcgatagtttgctgggaatgatggtttctagcttcatctgtgtccctgcaaaggacatgaactcatcattttttatggctgcatagtattctgtggtgtatatgtgccatattttcttaatccagtctatcattgatggacatttgggttggctccaagtctttgctattgtgaatagtgctgcaataaacatacatgtgcatgtgtctttatagcagcatgatttataatcctttgggtatatgcccagtaatgggatggctgggtcaaatggtatttctagttctagatccttgaggaatcgccacagtatcttccacaatggttgaactagtttacagtcccaccaacagtgtaaaagtgttcctatttctccacatcctctccagcatctgttgtttcctgactttttaatgattgccattctaactggtgtgagatggtatctcattgtggttttgatttgcatttctctgatggccagtgatgatgagcgtttttttcatgtgtctgttggctgcataaatgtcttcttttgagaagtgtctgttcatgtccttcgcccacttgttgatagagttgtttgtttttttcttgtaaatttgtttgcgttctttgtagattctggatattaaagtcttacaaaggctttacagtgacaacacacacacacacacacacacgtacgtgcacatgccctctcaattctattttaactagtcttcctcaaaattatctggctatggattcattgggtgtgtagtacttattaatatcctatggaatgctagttcagcagaactcactttaatacgtactgactgatatgcattgttatttttaacagcagtaatttgaaggcagaaagacctatatttgtttctcaactttaacactgactacctatttgtctgcagataagttacgtttttaaaaaatctcaatctaatggttccatttataaaattaagatactaatattattttcttatagggccaggcatatatagtgaatactataatatgttatttttatgttacataataataatatctcaaaattagtgagaagagttgaaaataatattctgaatgttagttaataatattgccaaaactaacaaattgttttattcatagttatctttttctatgtctgttttcacacttggattatgagttttttaaagaagagataaggataagttatttatttttatcctcagcactaccattttcctcggtatgattcaatgctttgacatcattattactcaaaattggaatactacttccatatacatatcctaaaatgtttgaattatgtttattttttgtcagttatatatattttatgtatgttgagtttatagttggttatttatatcctaagcatttttttcaggaatgattggcataccagttttctatcctctagaatatatttattaattgtatttaattgcagaattttacattgatcacaattaaaattcctatcttttctgtatgcccactgttctgtctgctcagtatatttcttaatgtcatctaatgaagctccctctgagcttactttcacctttctattttctaaggatgtgaatggtataatttaacacatgacaaaaatgataaaaataaagaactaagagtctattaatactttatagtctatttctaaataaactaatgcttatttttattaacagtccattttggaatatttatggatattgatgcttagttcacgtgacttcatagttttgggaaattttaattatccttacaaaaatgaaatgtttgtttatcttgcacctctgatatttttctaattatacctgatttaaaaaatattactcttaatgtttctgctactatagctacgtattgtttcagtattctttggtataatttggctaagactttattttaacatgtgtttaaatctactctcagatttaggatttcactgatatttttcctaattcctttgacttaatttgtaaaatctaaagtgcatgtatatctttacctggcatcctcttccactgccattttaaactctgggatgatatagatttgataggtttctatttaatttgccaaatagtatttttaaaaattcaattcaatcttaattcagttctaccaagttcacatttttgaacatctgctattgagtagtgttactgaattatgattgttactttatcttctagggttatagtatatttattgtcctctgtgatatttgtttttgctaatgtatttggaatgttttactaattattttttcaatcctgaaatattcacagagactcatacttcgtaattcaattctttttttttttttttttttgagatggagtttcactcttgttgcccaagctggagtgcaatggcactatctcagcccactgcaacctctgccttcaggtttcaagcgatactcctgcctcagactcctgagtagctgggactacaggcacccaccaccacacctggctaatttttgtatttttagtagagaggggatttcaccatgttgatcaggctggtggtcttgaactcctgacctcaggtgatccacccgcctcagcctcccaaagtgttgggattacaggcgtgagccaccacgcttggccatatttcaattttatatactgttgatcaggtatgacaatctctagcaaaacactttttttattttaaaataagcattggttcattgacagaagttcattattctgcattgtaagaaaatgcaattctgtgccgtgttattacctatagatgcaggattcactttctgtactcccccttttcttccaaagaaagatgtttaagggaaagaacacatagaaatagcgatatgtcttatagaatatttcaggtttctatgaaggactttaaagtcaccacagaaaataataatatagtgccataagagcatagacttgaaattcccaaatagggaaatttctatatttcttggagtctcagtttgcaaatctgaaaaaataaaaaacagatgaaaaagtatttcagatcaagaaaaataatttcagatgatgtgggaagggctaatgcatatcccaatgcaaagatcatagttgataataaatacattcatcaatatattttcatataacttcatatgagcatctatgttagtttacagaactatatacataatggcaaaaaattgttttttattataataacagtaggtacagttttctgacacctacctttatgtaaagataaagtaagtaaaatgttctaggtgtctttatttaataaataattagttttattacataatttaatatatgaaaaataaatcggtaggttttgaagtgtaataataaaataaatgccacccaatttaatagcaatatcattgaatctttctgtgaataatagctgaaaacacaagttttagataaatagtcaaactctttaaaatacatttgagaagtatggggaaagggtagtgtgggatgagagagctcttatttatgaatttatcttacagaaacattgcagatatagacagatgtagacggattcatgtaaaagtgtttatcgctgtattattgcttacaattcacaaattgaacataattaaacaagaaaaaagttaaggtataatttttggaaaaatagcacagagaaaacacatattacctttttttttttttttgagacggtgtctcgctctttcatccaggctggagtgcagtggcgcaatctctgctcactgcaagctccgtctccctggttcacgctgttctcctgcctcagcctccctagtagctgggactacaggcgcctgccaccacgcctggctaattttttgtatttttagtagagacggggtttcaccgttagccaggatggtttcagtctcctgacctcgtgatccgcccgcctcggcccccaaaagtgctgggattacaggtgtgagccaccgcgcccggccaaattacatttttgaaaactatttactaacactgaaaaatgctcaaataataatgttaattgacccaaaccaagaaacattattatatacattattatactattttaaataaatttatatataaaacagattgaaggaacccatcaaatattcattgcaggctgtgggtaatttacattttaattcttcaacactttctgtgtttttaaaatttttatgatgaacattattggtataaacagcaatgtgaataattatagttgagagaaaaaaggtaatgaaatgattttatgctacacacatctttacaaaatagcattcccaacttctgccaggtatagagagtaaaaaatcaaaacaaaacaaaacaaaaaacactaggatttaaaaatcagttgctctcattttttcttaagccatggaaggtatttttttctcataggaaatgaagataaatagtatcttttttatttttcgaaaaaatttaccactgctttggaactttgactttaattctctgagaattctctgagaagagtaaatattttttggaaaatagttaccacaactttggaactttgactttaattctctgagacaagtattgcattaaaaatactttatttacatatcacatgatcacagttaaaatggaatttcaatttgaaaagtaattttaaaatcctattaattgttttaactattgattatttgtggcttcatatacttcttaaagaactaaagtggaagtagaaaaaggaactagtacctctggctatttttaaagcagagtcacctctcaaaacttctgtgtcaaagttgtgggttttatctacttcgtattttcagttaaactcagaaacaattgaaaagtcagggcagactgtactctttaatgtaatttatttgacaatgcatatatgttttcacatatgtaaagtttcctttccctaagatactgcctaggactggctgggtaagggagatctgtacagtaatttggactgatgttttatggatatgttttatattcaagacacagtctgacctattaaccatctaatctatgaattatttgacagtgttatgcaatcaaatttaaaatatggtagatccattatgtcacctcttttcttatttatttatcttagtgagacttatagctcttaaaattatatattttattcctaccatttctcccaccttcccaatttatccctactcatatttaaatgtgtgtaatttaaaggagtgttctgatacttatccaaatctatattttacttggtaaaaagttaacacactttgcatcatttcacttatttaatcttttcatataaggctgacagccccaaattctatatagaaggcattgctctatagtcacacctcatatatctggcattattgggaaaggaggtttccacatgattgaattttccagataattcagctgagcttggagtgcttttgttgagcgtctaccatgtggcaagcacagaggacataaggccgagtaaatagggcctcagaagctcatagcctggaggccagggactgtggtggggctgccacacacagactttaataactataatacaatgtgctaagaacgatgatgtaaatatgcactaagtgttgtggaaatagaaatgaagagaaagttaattttttacttggaagggtaagggaccttagggaaagcctctgagaggagttcactattgagctgaacttttcaagaagagtaggaagtttccataggcaaaacaacaaatggggaaagaatagggagagagagagagaaagagagagagagggagaaagagagagggaaggagggagagagagagagacagagagagagagggcagaggtgtatgccagaagaaatgttcctaagcactaaaatgtttaagtgtataaaaaagttcaagcgtataatgaattaaattaatacaataaaatgatcaatgccagtgttactactaataagaatagcatccagcacttacacatttaatggacactcaccatgtgtctggcgctgtgctaagtgctttacttgaattaattttttcacaaatatatatatttatgtattccctaaagaaaatgtgctatgtagaatcaaccttttcctaatgctctgctatgaatataaatttctgtactccattgtgaaaacattttaagctagcctgctcgatgtcattagccaccttcagtacttggatatatatagttaagctgtcatcattccagttcacagtcagcttcatatttacatcatctccccctgcctccttcttctctaagatttgtgattcttctgcggacatacttcagaaggtactctgacattttccactcaggaagatttcctgggctcttgagagcagggtgccagaacaggacactcagatgggagattatgtttctaaagtgtctagaacggtacacaagcatagcttgcatatcttcagtgtgtggggatcatgctctattttagaggttcttacctggggtgattttggtccctaggagacatttagcaatgtatggaaacactttattttgtcatccacaattgatagggggcaggtatgtgtgtgtattgttactagcatttagtgcgtagatatgctggagtagtaatgtgggtaggaatgctgctaaaccttctaaaatggacaggacagctcctctgcctcacagagtgctttgatccaaaatgtccttggtaccaaggttgagaaatcttgctctatttgaagatttaagatataaacctaaagtggaaatagtttgtgccataagctaatatgtcagtgaattttgctttgaccatttaatattttggatcataagactcataagatgaaagagctcttaggagtttgtactgggtacattgctcattcactgcatgaaaaatggttgaactgtctgtgtaatagcctcatgtcctttttgcttgttgaatgaggggacctcctgggtgtatacctggtagcacatgtttaaatttctctgcaggggaaaaatgtgagatgatgtaatgccaggaaacctactaaatattaaaaatgtcttggcaattaaaaaaattctgctcagtgaaaagtgattaaattttcttagtgagattccaactttttttcatttctgccatgcttttcattcaattgcatctaatattactattttaccagttttcatctgtaccttttaaatgcagcatggaattagatattctgaaaattaatggttagtaagatttatagaattgtataatcccacatttattttggggaaaaaaagcgatttaccatttgaaaacattgatcaatttgaattgaaacccaattcaaattctagcccatataagctaaaagctgctgatgagggaaactttgaaccttataaactctagaatttaccattattaatttgtagtctcttgaataatatgatggtatttatgacaaatacccagagagagatgtatgctttctccttgggtggccatcattatatttttattggacttgataagctattcaaggaaaaaaggagatggaagaaagtgaaatagttataataatagaagctttgggaaaagtggagatgtcgttgtggactacaagttttgtactttatgaaaataaagtagtgtggcatcctttcctctaaaatttgtctgtgtagcttctagataatttcttaaagcttttctggaccaggtttaagtgcttcatgattagatagtagagtggctatcctattggtttctcctttttgtttctctttgaatataaaaaatatgtggctatcctcttggttaagtatcctttttctctctctttctctctccatatatatatgtatataatatatgcatgcatacacacatatacatatattcatgtaattgaaaccacaaccacaaccagggttaatattccttttcttatctcttcttcttgattatataaatgattttacttattttttataagttttcaacccatttttttctccagtagaactgagaggtggttttattatggattatgtatcaaaaatattcctaaagttaaagaagatgaataaatttctatttccaaagtttctaagtacaggttgttaaataacttttacatttgtaattgcataaatcacttctgactataatgagttggatgcaagaataatgcatacaactcatatacatttacacactatacatgtagtttgttaagaaagtagcaattatagtaatttgtatatcatttttatttgtgtattcttttatccttgcaatagatttttgaggtagaaattactttaattttcatttagagaatattcatttaatcttcttttaatcttcatttaaagaagaaggaagataactttagaaaggtgactttaaagaacataatgatttttttctaatattaagtaaagcctgagtatagcaagtcagcgttgaaattaagcaggcaccaactccatctatgattgtggttcctagattcatgaaggtacatggatagtgtggctctttaaagtatctgtggggtgggtcaagatggttgactagaagcagtagcgataggaggctcccattgagaagaaccacaacagcatgcaaatcctacaccagcaaccgaggtatccaggttctgtcatcagaactgactgggcagctggtgtgacccatggagaggaaggaagagcagtggggtgcggtggcccacctgagggcctcatggggcagaggggccaccaccccccagccaagggaggtggtgagtgagcatgctatccaacctgggaaaacatgctttttccatggaactgtgcagcccacagattggaagatcccacgtgtgagcccacgccaccagtgcctagggtcccaaccatggacctgtgcaggttctcaacagccagtaagctagaatctgcttaagcctgctgagctcacagagggaggagtgaccagaaccacagctgtggttgactgctgtcaaagccatttgaggtccttgggggagggtgagagccaacaccgggacagataactgcctaatacattaacctcctatggcaggagaagggcagcagccatctctatagctccaggctgtgcttttccttagctggacccagggagactggatggcttggtcccaagaagtatccctcacagccaaacacatcagctgtggcatactgtggacagagtgcctcttcaggcctgaccttgacccatccctcctcactgggcagggccttcctgcaggagcttctaaaactccaaccaggtgctcagggacagaactctgatctccctggacctgatcccctagtgggaggggtggtcacagtctccaaagaccagcagacttagtctttcctctggctagttctgaggaagtcaggaagcccagaagagtgggtttctccccccactgaagtacacctcctccatcaaggaacagtcaaagtgctttgttaaactggtcctgctccccatgccatccaactgggtgagaccctccaacagggatcatcagacaccctatacaggagcgttcctactggcatcatgtcagtatataaacacatgtcagtactataaacacctctattcaaataaactataaaatctagaagaaatggataaattcctagacacatacaccctcccaagacttaaccaggaagaatttgaatccttgaatagaccaataacagttctgaaattgagccagtaataaatagcctaccaaccgaaaaaaaaccaggaccagatcgattaacagccggattctaccagaagtacaaagaggagctggtaccattcctttagctactatttcaaacaattgaaaagggatgagtccttccttccttttatggggccagcatcatcctgataccaaaaccttccagagacacaacgaagaaagaaaacttcaggccaatatccctaatgaacatcgatgtgaaaatcctcaataaaatactggcaaaccgattccagcagcacatccaaaagcttatccaccacgatcaagttgacttgatccctgggatgcaaggctggttcaacatatgcaaatcaataaatgtaatccatcacataaacagaaccaatgacaaaaatcacatggtcatcccaatagatgcaggcctttgataaagttcaacatcccttcatgttaaaaactctcaataaattaggtattgatgaaaaaatctcaaaataataagagctatttatgacaaacccacagccaattcatactgaatgggcaaaagctggaagcattccctttaaaaaccgacacaagataaggatgccccctctcaccattcctattcaacatagtattggaagttctggccagggcaatcaggcaagagaaagaaataaagggtattcagataggaagagaggaggtcaaattgtctctgtttgcagatggcatgattctacatttagaaaaccccattgtctcagcccccaaactccttaagttgataagcaacttccaaaaagtctcaggatacaaaatcaatgtgcaaaaatcacaagcattcctatacaccaataatagacaagcagagagccaaatcatgaatgaactcccattcacaattgctacaaagagaataaaatgcctaggaatacagctaacaagggatgtgaaggacctcttcaaggaaaactacaaactactactcaaggaaataagacagaacacaaacaaatggaaaaacattctattcttgtggataggaagaatcaatataatgaaaatggccatactgcccaaagtaacttatagattcagtgctattcccatcaaactaccattggcattccccacagaattagaaaaaactactttaaatttcatatggaatcaaaaaggagtctgtagagccaagacattcctaagcaaaaagaacaaagctggaggcatcatgctacctaacttcaaactatacatcaaggatgcactaaccaaaacagcatggcactgctaccaaaacggacagatagaccaatgaaaaagaacagagacctcagaaataacaccacacatctacaaccatctgattgtcaacaaaccagacaaaaacaagcaatggggaaaggattccctatttaataaatggtgttgagaaaactggctagccatatgcagaaagctgaaactggacccctttcttacaccttatagaaaaattaactcaagatggactgaagacttaaatgtaaagccccaaatcataaaaaccctagaagaaaacctaggcaataccattcaggacataggcatgggcaaatactttatgatgaaaatgccaaaagcaattgcaacaaaagccaaaagtaataaatgagatctaattaaactaaagagcttctgcacagcaaaagaaactatcatcagagtgaacagacaacctacagaaggggagaaaatgtttgtattctactcatctgatgaaggtctgatacccagaatctacaaggaacttaaacaagtttacaaggaaaaaaaaataaccccatcaaaaagtgggcaaaggatatgaacagacacttctcaaaagaagacatttatgcggccaacaaacatatgaaaaaaagctcaacatcactaatcattagagaaatgcaaatcaaaaccacagtgagctaccatctctcacaccagtcagaatggcgattattaaaaagtcaataaacaatagatgctggtgaggatgtggagagataggaatgcttttacactgttggtgggaatgtaaattagttcaaccactgtggaagacaatgtgccgattcctcaaggatctagaaccagaaataccatctgacccagcaatcccattactggatatatacccaagggaatataaatcattctgctataaagcaaagacgtggaactaactcaaatgcccatcaatgataaactggttaaagaaaatatgctacatatacaccatggaatactataaagccataaaaaggaatgagatcatgtcctttgcagggacatggatgaatctggtcaaggggagggagagcatgagaacaaatagctaatcatgtggggcttaaaactttgatgacgggttgataggtgcagcaaactaccatggcacatatatacctatgtaacaaacctacaggttatgcactagtatcccggaacctaaagtaaaataattaaataaataaaatcaagtatctgtgagtcttacagcttattggcacctgataccaatgagaaatgttcaattatatttttaaaacaagcaaacacttttgccatgtgtctataatatagtactcttgataaaagagatttcatcaaaagatgaatgggcatcccatccagtgcatattagtttacccaatgtctcttgctaagaggtgatttcatttataatgaaattttgcatttgaactctaaggatagtgttgtagagaggtaaataagcatttgcttattccagaagattttctgtactgtacatacatctcttcttacattgaaatagtgcaagaagttctatcttccacatacaaacttaaatgcatcctataagtagcctcatgattatcacattaaaaatccctttacatgactgtttgcacctatttccccaaactccacagtatttgtcctttccacatcataaccatattcacagatataaaactttactttcaattccttctctttctcatagttaattcacccctcaatgcactgtaatttgattttcataactccactcaactagtcatctaccatcagcctcctctttaccagatcttatactttttctttcttcttattctcctcagtatttgatattgttgatcattccctatttaatatgtgaaatatcctaatcaggggaatatattagtttcctagaattgccataacagatgactaaaaactatgatggcttaatacaataggaagttgttttcttacagttctgaaggctaggtttcccaaatcaaggaattggtaaggccacgcaccctccaaaacctctagaggatgatgcttccttcccgttttcatcttctggtagccctagaagttccttggctgtgtgaagatactgtaattccaatctcctcttccatcttcatgtggctctcttccttctgtgtgtctctatctttgtgtctctcctcttcttcttataaggatactggttatattgaaatatggcttacctcatcttaacttgattacatttgcaagcatatttccaaataagatcacattcacaagtatgagggactagtacttcaacatatgtttttgaaagacacaatttaacccataacagggagtaagctagatagtgattgataagaaaaataaaattattgtgagtcataaggaataagatatttattatagggatttgactttctgcaatcatgggacctggttaaatagttcttgtaaggctgttgcttctctatcttgtgatgggtctaaagttagcttcccataggcagctgggaagaaaaacagatacagaattggagagaaaaagaagaactagaacttttcaggatatgctggagccccaaggacaaattagaaaccatgtctttctcatgcctttggagttccaactttaatgatgtgcgtggcctgcaggggagattggtatgcttcaccatgaattccacaaactcctttgcttaggatgtagagaagctgaaggaggtgatcttgcagaaggaattgtgggccagaatttggagaagctgacggagctgttactcaatggaagctgaaagagcccaggtgctcccaacagtaaggtgagctagcagatcagtgacaatgtatgcgagcagcagaaaagcctggcactttaccaattatccaatcataaacttgggtgctgcttccattccactacccaactcctgtgcagatttctctgatggctaacttcaaagcagccccaaacaaattcccaagggaattctggaatttgtcatttctgtttaggtaatatgacaatgtacatagtcacaacagtccatccttgtcaatttggcactaatatacatcttttatacccattcataacttcttcctgtttttttttttgtttgttttgttttgtttgaggcagagcttcgctcttgtcacataggctggagtgcaatggcgtgatctcagctcactgcaacctctgcctcctgggtttaagcgattctcctgcctcagcctcccgagtagctgggattacaggcgcctgccccccccacccccccaccccagctaatttttgtatttttagtggagacggggttttgccatgttagccaggctggtctcgaactcctgacctcgggtaatctgctcaccttggcctcccaagtgctgggattacaggcatgagccaccgcacccggcaccattcataacttataaaaaatgtaatagcaaagtaattctgccttttaatccatctttggatgttgttcattccttttctagctgagccatactccccctttgaagtattgtaatttcaatactgaaatatgtgattagctactatcaacactgcttatactagatgggaggtagatggggaagaaaaggggaaaaaaagaattatttaatatatattaggtaggtgcaaaagtacttgtggtttttgccattaaaagtaatggcaaaaatacatatatatttaatacaaaaacataaatatattaatttcaaaataaggaataaataccatattacaatactcatttctgcagctagtcacatggttgcagttggtatttataatttccttcttttactatgctatcaattttctgtttattttgacaagcaccatggctggtcacttttccttatctagtaaggtaaatcaaatatttattgttgaagtgtctgggccattagcgataatgcctgcaatgaactgtgattttccatttacttttgtcatatgacaagggagtacgaagtggtgttccaggtgatctcttgtactctatgcatactcctcattactcatattgtggtagtagtagtccaatttccctttgatatttagaatcattgattcacatggtatagtaaccacttactggcttcttgattcactggcatgaggagtcgaagtggccgggtagctgtttcaacttccaatttaatagaactattgccatggacactagagttagcattgtaccattgggaactaagagctctggaccaacatagcccaatgtcttgggagtcagaagcacagattttgctagttgaatcatagatagtgagttgagaggaaccacttccatttccaccccttgatttccagaccatgagacatctggctatgagagaaacagtcatccttgctatattggttactgatttagatcatataaagcttccttgaaggatatcagttcattcttgtaaaatattggtacccaacttgtggcataactgagtcttcaaaaggccatccttttgatgggaagcatgggaagaccggtgacttccgtaagcatgagcccattttttatcagaagcgatgcagtatggaattctatggataagtgaataaggcattctggaagttcatgtgtggtaattttggggagaagcatcatggacaaagaagacagattcatatccagagcaccctttccagagagaacgaagtactgcccttccagtactgaagtaagtgttccagtataattagccaagagcaaagtggagatttatcctcctgggaaatgcttctgcaaggatttatggtagagatttgaccttatgcattcctagagctaaccaatctatttaagtctgttgctctgcatctgaagctgggcttaaggtccacaggacagagtcagaaaggaaagatgcattgggggaaacaaggacaaaacagaacctgtgaagataatctggaacccatgaggacaaagtggaacctacctccaagtctccaacttcaatgatgcagttgactttctagccgccaagtcctttcctttagaagcggatgccttgccctagattcagaggaactaaatagggagaattagtgggatctgaaggagctgcatgctcaacaccaataagatgaaccagcagatctccacaatatgtctaagttgcaataacacttgaccacaaggtagtcttctaagcataaatatggctactgcttcgctgccaccttctaaatgttacccaaatttcctttgcagccaaccctaatcccaaacgatacacagtagttccagcttagttgaattgatatagtataaaaccaccatggagtgtgaaaatacgttaaattgaaaaagtgaataaatgaattaatagatagatggatttgtgaaatgacagccaaagtcacttcttagctgtttctacccaacttgttttaggctagtggctcagatcaacctttcagtggtccagtccaaatatcagtgcttttcttcaagataaggaaagcaattgagttatggtttgggagtaaagggagctgatattttataagagaaagtgttctgaaaatggaaaactgggttctgatccccctattggctaagtgaacatggaaaattatttgatttctctttaaatttccttatgaaaaaatagtttggctaagtaatttatatctcactcagttctagtattctgtgatttattttggtcactttcagagttaaaatcccagactcattgatttcacatcaaacattcttggtcaattttttttgtcttataatgagaatactccatttattcagctgactagaaaaatagaggaagttaacatttccaatactacatgcctggtgtgctactaggcctgttcacatcccttatatatcgaattataaggagaacacattatcataatataatcatatcaaatgatattccctttactcaagtaaaagatcaaacaaattagagcaagaagttgaatgtttatacacttgattttttgtataagcataggtagataatgaatacacttaaaatagacaaaactataatagtttgttaatatttcgcatacatattttaattcacatgttgtctgaaatgattaatatagtattccttgtttcactctcaaaacatatatatgatggctttttcttcaaacttgtctcatgcatctttgacattatgcctttatcactagaatcacatttttaatcatatatcacagtgttaataagtatatcgtcttcagatccatctatgttgtttgaaaagtagcatttttgtatatttgtgtatgatactgtcattggaaatactatgctatcgaaagtgcaggaatccacaggttgtgtgtgtgtgtatacatgtgtgtttgttgttgttttttagcatttatttaaatgcataaatgttatatccacaatgcaacctctaactctattcttatataagggaagggtacttatataagtgctttttaaaaaggtgatgtttcactgtggggaggtctgtgcaaacctaccccaaagtcccaggaatctgagaggctgaagagacaggctgacaaaaccagtttccttggaagaaatatttaatagggacttaggaacagaagccatgtctgtatctcgggcagcagcaagttgagatggtggattcccacaccatcacccagggagcagagatggttcagaagggagctgtaggacaattgaagtatgataacataaaggttgtttgacctaaaggcagaatttgcgtaagtacctgctcttacacaaggaagatagataaactgaaaatattagagggcttcccagaacagaagttaatcagaagccaatagagtggattagctttcaagatggagttgctttggcctccacaggtaaacttctaaagacagtcaatagttgaagttttgaaacaacactcccagaaatactttctaaactttttgtgccttgttttctctacctcctccttctccttttctcctctttctgctcctctctttttcttcttccccctttttgtaaatacaaaattaacactgatagaggttatttgaaggtaatgttcttctctaaataatactttcccaaaactcataggtcaaaatgaagcaatttagagacatttgtattatggcagaccctataaaagattgcagatttaagtgtaatttacctcttaaccagatagatattcaaagtattgcacttggtcttgatcaaacattttaaggcagggattgtcataccatttttaatatacagggaaattgaggttgaggaattccttaattgttcaagatctgtctgatctccaaatctttatagcactagattgatattgataaaaagatgataaatattaatttcttagctatatagcttctatattctcattccaccaattagcatcttcggttgagttatgctaatggtagtaacttaaattctgctgaattttggttcctgctgtttagtctttagtgtagtgtccttctggtattttaagattctcaaggtatgtatgcaaaactctttcttctttcactaaaataaaaggcactcatgcaagtaaatatacacaaacataccaatagcccatgtataactagacatgtttaaacttctggtcatgatgagtcagacctgctcaaatgtatttgtattgacaataaatgtatgtatatattatatattactattcacctttgagcagctaaacttaatattccaaaatatttcatatctgataagcttatttgatactacaaatctaactttatctgttaaacctgactctgtatttaacaacagcatgatgactttattaaccatagaggaaattattatactgatctatatcacaatcaagatgaacaatgaaattttacctgaaaaagaaaatgcaaattttagtcattatgatttctattaatataaatttactttcacatatttgtttttgaaaacctctcagtcttgataagtgctatgttgtcaataaagacagactattcacatccaggaatatttacattcccaccttaaaaaaacccgctttattagtattatgtattagtattagtattatgggttgaattgtgccctctcccccgatgttgaagtcctagcctccagtaactcagaatgtgaccttttttggacatagggtctttgcaaaggcagttgacctaaagtgaggtcagtagaatgaatcctaacccaatacgactggtgtccttatgaaaagaggaaatttagacacaaagacatgcataggagaaaagatgatgagaagggatacagggagaagacaacagtctacaagccaaggagagagcctggaacagatcttttcctccggtttcagaaagaaccgaccctgctgacaccttgattttggaattctagcctccagaaatgagagaaaatcaattgcaaactctagtctggtattttgttatgacagccttagaaaacaatcacacgcagtggctcacgcctgtaatcccagcactttgggaggccgaggtgggtggatgacgaggtcaggagatcgagaccatcctggctagcatgatgaaaccccgtctctactaaaaatataaaaaattagccgggcgtggtggcaggcgcctgtagtcccagctactcgggaggctgaagcaggagaatggcacgaaccctggaggtggatcttgcagtgagctgagatcgcaccactgcactccagcctgggcgacagagctagactccgtctcaaaaaaaaaaaaaaaaaaaagaaaagaaaataatcacaaacaccattctgaaatatttgcttatgcacattcatgtaaatgggctttttctttgctacaatgtaggctttaatttcaagtattgtaactgcaccttatttaaaggatttatggaattatttttgctacaaataaatatgttttttctttatacatgtattttctctatcgcactgttcttaaatgcattactatttaaaatgttcttttattggatattgtaagaatttcttttaaaaagtgaagcaaaactggtgaggcaggacaactttaacaagtttattttatactgttcatgggaaatacttaggatattttactattcccggtagtataagtgccatattttagtggagaaattttatacttcaaaataaatcccctctaacattctacagaatggggttgggggggacttgtttttaagaacctgctatgaaaggggccatatgagtaaaaattacagaattattaccactgtgtttattactcatagtcttgattctcctcaagcatattctgttgtctataggtaatgcagaagagcttcgtatatgaaaggagaaaggagaaattaaataatttgtcagtcaaaagtaaaatagctttgaccattaatagaaaactgtgcacttatgaaatcaattaaactttcataacttttcagaggtgaactagaaatatatggctctttttagaccataccacttcatcttcccagatttactttccaatgaattgcaatttgcatcaccgaaattcagatatttaggccattcttgatgctttttctaaatatatacatcatcattctcagtaaactatcgcaagaacaaagaaccaaacaccgcatattctcactcataggtgagaattgaacaatgagaacatatgggcacaggaaggggaacatcacactctggggactgttgtggggtggggggagggggaagggatagcattgggagatatacctaatgctagatgacgagttggtaggtgcagcgcaccagcatggcacatatatacatatgtaactaacctgcacattgtgcacatggaccctaaaacttaaagtataataataaaaaaaaagaaaaaaaatacaaattccataagaaaaaaatatatatatatacatttaaactggaactgtctccttcatagacatgctggaaagttttgggatttgaacatggagagtttggagaatttttttttcctgaagagatggcacaatttaaaaataatagaaaatatcattgaaatgactaccaaaagaaatttgttaattttgcttctgaaagtttacctccttgttcttttttgtttttcatgtctttattaatatcatgccaagggatgacattatgagccttgcagaattgattaggacatttttgccatatttcaaatgaaagcagacctgaaatcagtgtagcactcaagtatttcccaaggtacagggtgactgctcctgtttaagaagtgaacagtgtaaatgagttaattccaagattaaggtctcagagatatttaccaaatatctcaaaactttaagacaattcttattttcttgtctgcttatttggaggatttttcaatttaggaggaagaggaagaatttaactgacctgctatcacactgggactataaagggttctacaaattctagtgagaactaaaggaatcattttactgctttgtatgatatgcttgttataagtctgcagtatctaaaactgaatcctatatcagatgtgaaaaaagcaagcgtttcaatccttcctttggtaaacactatgactgtaattgtgaaaagacaataaaacattcatagtttgtattaggatatttagattatttccttatcatattacatttatttgaatttctctagattaatagaaaaaaatctagttaagaaacgaagatgtagtttctaagatacacattttttaactttgtttttgttaaaatggttcacttttaaatttgagtatttttcattaaaaaagtatgatttattaaaaatgtgttttcacattttgtaagccacccttaaagtgacttctatgatgtatacagacagaaaatgcagtaaaatagtatttaacacagtatgttgatatttaacctagtataataatattaaacaatgaatagctctattgttttctatataaataatatgctcttaaatagattcaatacaatatcaaaggtcataaaatgcataatggtgttatttctactctatcttgagggagatacagtgttttacagttaacctatttgagcctgaatgttttcaatactaaggagctgttgtaaagattaaatgtcagaaataggtaattttagctcagaaactgcctgtagtaagagaataataaattattcattataattcaacaaatgtttatacatttataaatataatgctaaaattaagattcagcaatacaaccataaacgttaataacagtaacactgtgcagattattctaaaatatataagtaagttcatattcacagccattactgtcccaaggggacttaagcttgcagaagatattaacaaaagttctcatagattgtgccactcaactcatgggatttatccttaaaccagtggtattactctgtaatactctcttggtgtttggtatccataaaataattatataataaaaatagaaaaaatattagaaaactccttctaaaacagatgattgcattacatcctgcctgtgttccattcatttgagaattcacattcatccaaactggaacaactactttcatttgactctattcagtttaatcctttgttttgaggactacttacagatggtggttaccgggaacactgatgaccagggatcaaattaagagcactaagtcagtttataaaggccaatgaaaagcaggaaaatggaaattactttcagatagagattactaatttgtaccaggtttggttgggagcctagtaacaaaggttttgtatcttattactcatcacttgagtcacttgttcctcttgttctttaactaactgctgttattttacaaactgcttttgtaatgttttcacttaagtctaggaaataatgatgttcatttaaacctttaactttttttgttgttccttttctttttagggatgcagatctgttcttgttagacacaagaaaggcccaagctttagatgtgggttggcttgtctttgatatcactgtgaccagcaatcattgggtgattaatccccagaataatttgggcttacagctctgtgcagaaacaggggatggtaagcactgaattttatatatttttttgtgaagcttgtttgacacattgagagttatcgttttttatgtgatataaccaatatatgttttatatttatgatgtccaagtcaacgcattctatagggtagtgcaaaactatattagttagttaatcaattcagaacacatttatccaatacatttattgtcaggctctggggtgggaggtaaagaagacgtaggtactgctactgttctcaaggaatttttagtctagtgttgaagacctgtatatgtaagtaagtagcactactctaatacaacaataccaaaataatatagttgtggtggttacacaactatacgatttgtaaaaatttatggaactgtacatcaaataagaataaatattactatatgcaaattatgtcttaaagctcgactaaaacaatgataaatatgtatcaaaaaagacactagggaagtaaaggagctaccaataatacaaagtgggagagaggagatggggatggaatgagtcacaaaaaactgcagaaaaataataccaagttagttctttacatattgcaatgtttgatcaaagactactgctccagaagtacttgtggaagggtctgtgggaaatcttcacttttaagaaggtccagaagtaattcttatgctcacaagtatttactgggcacctactatatgccctaatactgaaaaatagtgacacatcaaagacaccatgggaaagcagaacatacacagctaaagacacctgggatggagccaaaagagccacttggtgagattctggagatataaaagtgagccaatgcagatggctttatgagacttgcatttgagtgatgcacgaggtagtaataacacaatagtattagtgaatgcatatcacagcacactgaggtgttcaatggatctgtgaacataggatggtgactagatttgagctataatctgaaacacgaagatgtgattaggggaagaagttggggggcaggcaattcagacacatggaacagaatttgcagactgtggtgatggtgatactggcatatttgctcagaaggctcaggaagccaaggccaatatattcagatctttgttgccctttgatcactcaaagttcaaacactctaaactcaaatctagacttgcaggtcatttaaaattatatttgtcatgataggaggataagacataatttaatggtgtcctacctttaaatacttaatatttaattttaaatatttataaaaaacatcatggagatctacattgtgctgttattctctaccctaaaaatgttatcaccagggacagggaggataatttttaaaaagatcattaataagagaacgtatcttatttaaggttcactgcttcttgttgtcacagaatcaggcaagaaaaacattaggcctacagtctacctccctcatttttcattgcggtgttacacaaaagccttgtttaataaaccacagaggtaagtaaaagctgtgtctgtcttggacctttttcaaggagatttattgctataaatgcttaagacttcactatggcgttgttttacctgcagccagtttcatagcctatggataataccattaccgatgctgtgactgcaaagattgtatatatggaatgaagttcacacacaaattgaatatattaaagggttagtctagtgcgtgttttatgtgtctcaaatcttttttttttttttttttttgagacggagtcttgctgtttgttgcccaggctggagtgcagtggcgcaatctcggctcactgcaagctctgcctccccgattcaagccattctctcgcctcagcctcccgagtagccgggactacaggcgcctgccaccatgcccggctaatttttttgtatttttagtagagacggggtttcaccgtgttagccaggatggtctcgatctcctgacctcgtgatccgcccgccttggccttccaaagtgctgggattacaggcgtgagccaccgcgcccggcagggtctcaaatcttgatctagaaaaagaaagttcttactgaaagtattataggcaaaggttcagaccttccctatgctctcaaatccagatttttccatagcttttaattacaatgttgaattttcataaacaattcaaatattctggattataggttagagtacaattatggctttacgattatcattaaaggatcctcagagttcaagcattataaatgtagactgagtaaagcacaaatttaaataatcttccaagaattcttacaatgttaagctactgtacatttatcgtcagaaatgtgactgggaaattggcactggggaggtaagccaatcgttccttccctggtatgtggcccaaacaagaaaaatgaaattagtggtatgtgcttctcccactctcctctttggggatatgcttgaaatgtctaactaaacaaatcaagaaatctatgaaatatgatcagcctgtttccttttaatttccatcttccctcttgctccacgtggactttctaaagtttctctttttgttttttcccccactcttatcttgtattggttctctcttttactatttccataatttaacttctatgttgttttcaatttatctttttctctctgagaactagtctatattttgactttccctttctctatgattaattttctcttatattacatgggtaattttactttaaattactagtatgttattttttagcctagagtaaactaatgttttactcctttaaaaggtttccaaattccatatttgagagtttggtttgaaatatacagccttttgttgcttttccttatctctttgatattgtctaatttgaagaattttcaaatggttaaacatgctaggctagctggctttttgcttttaggcagtacttaaaacagattttaaccagaggtggaagagatagggccttgggaaagcaactgattctctgggcaccttagttttattaactgcaacttcatggagaatatacatgtgacatttccttataaatatgaataaccagatgcttcagcttattacagcttcactcattaccactgcttgtgttctcaatgtgacattgcttcagagcagacagaccatcttttattttcagtaatatattcctaacgttttcttctaagcaaaaggagttgaaaatcatgaaaggatgataggaaagtctgctttcaaattcatttgtaaactattattcatttatccatttgtccaacatataattattgagtatctgtgcatgcaaggtagcgggttacaaaagcatatcacctaagagacagatataggtagctaattttagaaataacaaagtgccctaatactgaaaaatagtgatacaacaaagacaccataggaaagcagaacatacatggctaaagacacctgggatggagccaaaagagccatggtagcggtggccttgaaactgggtcagcagttagattcgtaagaaatacagatgaagaggaagggaagtcatggaagtatgcgaagtgatggtgagggcaggataattcattcctggatgaagaaacagtaagtaaatgcacactatgtcaaaatggcgtggtatattctggaaaaatttaacagtccaggattggctagaacaactttcatgtgtaaaatgtgattgcagatgctattaggcaagtgatctgtaaacaaatcatgtaaggaatatgaaatctaaattaaatgtaatattctcttgtagcttgatcgtcagccataaaaaagaactaaacttactactttaatcaatcacagtaacaccactgtgattacaggtttgaatgaatgtcagtttcatgaggtcatgggacttgtatcactgattcgcacttgtaccctcagtgcgtggcacaatgcaggtcgtaggtattgaaaatgtcttgaatggtaattgagtgagtttgtaattaaaaaggtcttgtagttcacttgccactgaacatgttcctcttaagaagacattccaaactgtgagttttggaattagtaactaaaccagtttaatgtaacataggagcagaattttgtagagcaaaccacaatacagaaattaaatagtttaaatcataaggaaaggagaaagtcagtgatgtgtattattaaattttgtttagcctgcccctgtgaagaaaaaataccaaaaaggtctaaatatattttgggaatcaaaaggctgctgaaatcaaaagtagcattttgattcctcagagagcctgtggaaattatgtcagtttatgaaatactctttttagaaatttgacaaatgaactgcaatgtatttggcaagagagttcaagaatattttattattttttcatgctgaatagataattctcagagctccatatgtttgtttcagcaaaataatacaaacatatgagcaagcaaatgaaaaaatatattgccgcttcttaatggcaaaatttagacattccagacaagatgttatatccaattttacaaaattggttttaaagttctcaagcactttctcatggtggttaataaacctctatgataaaataaattctatttttgtttttaatagcaaatgagtaggcttaaatctgtcctaaattattgtaagatttctagttccctacattataatgatacattaattaactgacatactaggtctttattaacattgctaataaatctacagtaatgatttttcctacacacatatgcacatagtttattacacagatagcaatttaatctaactttaaagacttgagttttccccccaaacactataattttccgttgtttgatgctttatatagcttaagccttccaagtagattaattctttttttcaaacttgggtttatagaataatttagagattgaaaaacaaagatagcattttggggttcattagaatgtcttttaaaaagccctatgttttcagacattttcggtttggcaatactcagaatgaattttgccagtgactttttttctttctattcaaacttgcttatacatcaagaaaaattcaatccgtatgtttctgattcatttgtattcaagtcatcaaaatgtcgttttgtcagagagttgtttaatgtccaagaaacattataaggttattttttagaagtaggacttaagagccattttgaaaacaaagtcagcataattttcaaccacatcaaggtaaaacttcaggtttaaagtcagaaagtttaaagtttcactaaattttgtacccaaatcaagaaaaaaaaaagatttcagaggtattaaactgtcaaattaaattatatggtaactgatacttaaatgtaaaataaagaaacattgcttacagtaacttagaatttaaagttttgatatttaaatgaggaggataaatgaacagatagctacattctggaaataaacattttaaaaagaaatcattaggaaaattagattaaaatctgggctctgataaaatacttaccattctagccattgcattgcatcaataaaatgagtgtgatagtaattacctcacaaggtatgtgaagttgtattagatgatagtagctggcacatggtagggcacaaataaagttctgtatgataaattggactagagattgcacagacttttcacttacattagctctggttatcactcctttaacttgggactagttcttttattgtggaggttttgcagatgatttaaatacattttagataaattcacaagtgatagtccacagggaaaaggtcagattgatgtatattctgaaactttgagttgacagcagagtatataggcagttatgttattaagctcatgtttaataacattgattgataaaataattactaataagaaagttttaacctgtttcaatctagggtgtgaagtcaatagaaatgaacccattttgttcttagaaaaacaacatatttttggagattactaatttaatcaatgaaaataagggaaacaagcttttcgtaatgcaataggattatatatggggctaatttattaaaggctggccaacattagcataaaaactcctgtttaaaatgcctcaggacaaattactagtatttgagttaataaacctattagtaagcgttaaacagtagaatggattcttacaaagataattgaattacaagcaggattttaatgttcatagaacacaagatcaaataaatattagtagtctttgataaagagtagggtccaatggtccctaatacatgttgtgctgatgtttataccaaaccatataaaatctccaccatgtaaatggtatttcccaaaaaatgctgggaaagctgagattttagattttgagatttagattttagaaaatcagagattttctaaaagtaccaacagtttaatcctcttttattttcgccaatattattctgcaaacttcaaataaagtcttttgttatcaggacaattatcttgaaagtgggtaattttacatttcattacccaggatgttgctgtgttctctccttttcaacctgtgataatttttgttgttgttgttcattcccagtaattgacaactgttacagctatgttaacaaagaacaggattcatctttttcttcaacattgggttgtttttcattcctacctgcacagtaatttaacatactgataacatttcttttccaaattaaaatatccagtaatatttcctaaatgtattctgttaaactcagtttttccaaaattgccacatcttttgaattgcagtatattcctaattagaaacatatattccagtatctaaagtccacatgtgattatatattaaacaaagatataatttacaactgaatattcttttaggtttataaaatttaagtgtatttgtgtgagaaatgcagagttcttaatataatatctacttaaatttagtaagtcctagaatctgctatttttaaatggaagtatctgcctaagtttgttgtgttattcttcgtatccctaagagagtggtttttacctcagggaaagagctccaaattaagcctctgtgttgtcagaggtttaatttatctgtgtcaagggttagatgatctatatggctgggtaatctgaatatcagctgacagtgctaataagtagcagaagaaattcaaagatcaagggtgatatttttctttttctcctgctgttttgactacagtttctcattattatttatctaagttcaaaaagttgaattatgtccacttatctgaggatcttttaaacattctaagatttgataatatttccttctcttatctgaatcttatcttttgaagtaattaagtcatttttgttcataaaaccatatggctccccttttgctgaatttatggtgatgacaattggttttaaataaacaaatgagagagtatctatatccaagaaactgaaagaatcacatatcttgctggaggttctgaaaggaaaaaagaagatatacacttatgatttgctctagataaatattgttataaataagtagttctttatgtattgtctaatgtttaaggataattagctttgacttctggattaatatttaagaataaattaggaagacagcagaagaatagttatcttccagtacctgaagaaatgaaattaataaataaaattgaactttttctctacagtccacaagttaaatcaatgtgcataaaaggcaaactgagggctctttacaaaagaaaaaaaaagcctgaataatggaagccaatggccttagaattgtttgttctgtgaggaataagctctatgtgacttgaagaattcactatttagttgacttcttgtctaggaattatacagcataatgtaaattttcaggtaatttctacagtcacttacaaccttgctgcatcatggaatggtacgccaattgtaatctttaagcatatatttatactttaagcattatattcatgtataaaaaaacactatatgtagagagggtacagtgaatggaaatgcattgtcttagaggaggctggtattaaacagttacattcaaaccccaacttaagatatggtataaaaatagtgatggagaaactggtaaagagaagcgagaaagttagacatgtttttctgtgcgcatgcatgggtgtgtagacatggaatacccaggcatatacacattctcaagtaattgtgttagggatcaaatataaattcatagttgaaaatctataataagatttctagagagttctttttacagcatttagcaggattgtattttctttttaagtgccatactaaatgctttagtatcatagcaaaacataaaactcaatctaaatttttccataacattttagagtgccttctacttttatcaaattttttcatcaaatttcaaaaacatcaaaacataaattatctatggccatgtgttactttctgaaaaaatttttttttttttgcaagaaatcaagccttggagaaatatttaaaagatgtggctaagagaaacaactatgttggtcattttaatgtgaatgtttagcaaaagtgtcattgagaattcctgtacatttatggtaaacatgactagatttctactgaaaataaatatgacatagatttcccttggggtctgaaatcagtatttgttaattttccaaacccacgtatgctgtgacccatgggttttctaactcgcgtaatgtcttaaagcacatcggagaacataaatcttccctgtatgctttagttttttgtcatttgcccactgcatacaaatgagcaaaatgtctttcatggcaggagtaactgaacataaataacggatcactgttaaatttctacttggttcaaccagagatctcgttaattctcttattagccatatagaattttcataaaatatactccatgtattttcaaacattcttcttatcaacttattttctgtctatacaaatatcctcttttttatacgctgatttcagcaataccttttgccaatatcaatttgttctttcatgctaatatttagtatttttaaattctacatagttaatccaggtttaactttctaggtatatttttaattcattttcagtaagaatttaaaccatgcatttcctgtgatggacaactgaaatcaaataaataacattagtggaaactaacattgctgagagcttactcagtgttaaccattttgctaagctctttaaatgaaatatctacttcttcttaacccattttgtacacgagtaaatgtagcttaagaataaatctgaaaacgatttgttttcagagccaccctcttatatgctgactcttacaaattaaattagtcttttataaattctgaactgaaaaataattgtattgttataatttccaaataaaacaatgccattaaaaatgattataagggagagaattgaatttttgctgtatctgttgggaattatttttgggtttttatattttctgcctggagtttaattgtgatgtggtccacaatatgtaacagtaattctgtcacattttttattttctaaatcaaccttttcttttgtctctttgtgtaattatagttaatttgataaattaataaataggaaaggagaaaaagaaacttttcatctgctgatgattcacttcaacatgaaatttagtcaaatttaatctttttatttagaacttgataacaaaccccctcttcttaatttagtcttgtatgatgattcttaggcaggaaataatttctctttatagttattgattatagaatatattcaataataaattgaaagactaaattttgctgttttatcatgtacattgtataaacaatattttaaaaatagtctttttttcttttgaagacttgcatctctttgttatgtcctcttaggataattacatagcagtaaacattttaaaaagaataatatctgaaacatttggcatagtctagttactaagaaacgacagttctcttcttcaagtcccaaagcaggtaacatatgtaaggggagaattgcaggtttgatcatacttaagaacatcttacactggcagatcacaataacttaattcggaagtcttagcttttgttttaatttagtttatttatatttgaatgagagccatatggttaacatagtttgcttatccaaagttcagcatcgcaactaaaaaacatatatgaaaaaaggttttaaaattattgatttaaagtaagcagttacaaacaggagttagttgtggttcactatctggcaaaatatatattttactaatttttaaggtttcttttaatgaaaaggggttcagaagtgcttggctacatctgtatttctgtttttgattttccctaattcagaacagtaactatagagcaccagtcttaccaaacaaatgccaaagtcagaaatattttttagtttttgttgtttgttatattttctcttctagactctagctaaactgatgatctgtggggtaaatattttcatggtaatatcaatttaggatcatgaaaaatataaaatactacttattgtcatcatacactagggttgactctttcttttcttttctttctacttaagtttaacttattgttgacatatctctcaaagatatattgcaaaactagcagtagtgctggtatttgtatcctgagcagagagcacaagtgagaagaaaagagaacctttaatccttataaggcatgagcaaccacagtgtatctatactgctgagagttaaattttggcatgcgggtaataagattataagagagagaggaaaaccaaaacagaaacaaacaaacaaaaaacaaaggcatctaaccatcaaatccagtagtatatattggaagtggcaatcaaaatttggattagactaatactactttgacaattaaattatatatccccactccttaaaaatgtatgctaatttctctgtagtgtgacagtaattgaatctaagtttcaattagagtggaataggaactggggaagccacctgccttcttatggctaataagaagtattgagtcttcatcttcctacttacttactaaggaaagtctgatcctgaacttaacgaaagaagcagctataacattattcttggaaactacaatacgtatgccactgacaggctatttttcctccattcttctcaaggtgaaaatatttatacaggaacccaagatgaaagtattcaccaatctctaaaaagtggactactgtgtacttagaggaaaagcatactactttagtagtgtgacaaggctgagttaaaaatctgactcttttttgagccttattttaagaggataacagttgctttgctgtgaggagtaaataagatgtatacaaatcaactggtaaaatagttgtcttcagtacatggcagctgttgcttctctcttaatttcagaaatgttgaattggctttttcaattcccaatgtccctgatcctttcagacacgcttcttattactctcaggtaccagttatgtttatatgtagaagtattcttcacgttatttttctctgaagtaacacaactgatagaaatatggaagttgtacttatgctatgaggtcagatgacactgctgacctagattgagcacaagaaaacactcttggaaaccagctattattttgcatgcaaatggttcaggatgcttttgttctggaggccagcaaggaatcatggtggtgtaagatttcaccttgtaactcgtcccttatgtggggcaggctagatggccttctggccatagccagatacatgaaaaaatggtgaagaaaaattctgcttccttctactcagaagaatgctttatgatcagccttcatatgtgaagaaaataagccccaaatactaaaactccacatttttaaatttactttttatttataattgaaacaatattgcacatatttttgcggtacaatgtggtgtttcaatgcatgtgtacaaagtgtaatgaccaaatcaaagtgattatcatatccatcattttaaacgtttattatttctttgtggtagcagcattcaaaatgtgttcctgcagaagtagttactatggcatattacattaggtatctcagtatcagttctctactgcatattttagaaaatatagttcactttttttttcactttctttattaggtgccgaataatttatttttcttctattttgctggtactagactgatccaaagatcctggaagtagcctatgatcatttgataggttcatgtacaaatcaaaagggaaggtcaaatatttaacaaatagattttctgtatgataggccgaggtgggtgaatcacctgtggtcaggagtttgagaccagcctggtcaacatggtgaaaccctgtctctactaaaaaaatacaaaaacttcaccaggtgtggtggcacatgcctctagtcctagctactcaggagtctgaaggaggagaatcacttgaacttgggaggctgaggttgcagtgagccgaaatcacatcactgcgctccagcctgggcgacagaacgagactccatctcaaaaaaaaaaaaaaaaaatttggaataatatagtagctggtaaaagagtatctcctttagatactcagtaagtttcccaagtaactaagtttcaaagaccactttaattactataggtaaaatgcagaatactaaaatttcactgctgtgaaacaaactaaaatgtgtttgacatctaaaagctttttgtcattgatgttgtaacacaaagaaagagtttttaaagtttttggttgatttctgctgaaattctgcttccctatagttttactaaaatcccccaggcttctgaaggaaaagattctttcatttaagatatgtataatttttattttaaaaagtcacataataactggagaagaagaagaaaaataattcactgttctcatgattttgtgaaaagaatgtttctactttcttaaaataaatgagggctataagaccaactgctaaccaatctttttggggcatgtgacagatgatgtctgtaaagttcataggacctcaggggaaaggtgctatatataaagacaagagctattaaaaagtaagtgcttttgtggaggtaaactacaatccctagcgtgagattcatatttctagcggctgaaaatagggaccaagtaaaacacatttgttgggcttgtcatgcccgagacagcaagcccctcatttcagagtgatgtcccatggaaggaaactaatcattttccatcacctcagtcctgccctccatgcaataaaacatttcagcattctggacagcttccacaactgggcacaaacctctggccatgctgctttacagttctcagcttctctgtcctcaggccctacttcctggaccctcatgagcttgggttctcaagggtttgtgtttctccccctgcatgactttagttatcctgccaatgtttctgaccaaatatcccgtttcttttctaagccccgtcactttatcaaactgtggggcacgacagtatcttctgcaaaatttttagaaagaatgtcaacactttaaaaaatctctatcccctttaaacttctttatccctaacatacccaaatcatatagaaaaatggatttcttctactgctatatgttaccaggagttgtaaccacgtttctttctttctttctttctttctttctttttttttttttttttagtagtgatggggtttcactgtgttaaccagaatggtctcgatcttctgaccttgtgattggcccaccttggcctcccaaagtgctgggattacaggcgtgagccaccattcctggccataagcacgtttcttatccacagaaaactctcaactcatagttcatatcagtgtgtcagggtactgctactaataatagcccttcctggatttcatttttccagtccgtcttttttttcccctttacttatgagccacagaatcctatgcttgtttgtacatattattacatttgtcccttcctttgattttcacacattaccaataatatataattatcaatatataatactggcaaagtggctttttttttagattactcttttaaatgtcagtaaaaagaagagaagagaaaagtccagccaaggtattgtacgccaaacctcatttgttaaacagaaccccagaattactgtgaagaatcactcaaaaatcttatcctgttctctacagttaaaagaaaattttaatacttaaaaaatagtttaaaatcccaacttttccttatttttgtttgaatttataaagcaatgtaaaccatttgaaaaacaagaaagtaataaggaggaacgctaaatttctgtttgtgatacttcaagtctgtatacttaactctggcaacaggtctgcgcttttacaataaaactacaaaagatgcaaatttttcatcaaagtataacaaagttgaaatttgtagctagattacaatatacttaatttaagattatagtaaatttaagtatatatagaatttaagtagacaagattctatcttcctcacattccttaaaatctcatataaaaatgatttattctgtatgctgggtggtgaattctgtacgttttaaatgatcagtttctaaaaagggtagaattctagtataatttagagtcatataatccataatttcacagtaccagaatcaaagttaatcacaggttgaaaataagtgaagatcagatagatgtgtggatgggagataatacactgatttgactactgctaaggagtccataacggatactgcaagagccatttttgaaatgaagaaaagataatttgtgcacaagttccatcacaggtgttttgggttaagcagtcaattaccgtgggtttagaggagaaaaaaacgaactggaatgtatgctaacatctcaaagtgatatcaacgtttagactctgataaatcctcaaatgaatgtttttcaaactgtgtatcctagagggaaactcaatgatcatatttggaaccacttatccttataacatcaacatgtgtctgaagagctgttttatgtcagaatctcctttaataactctgttttgaaagaaataaacattttgaaaatcatattttccaaaaggagtggtctgaaatacaaaaccggtgagtctgggatagagctttggtttgccagtctaccttccctgtgactataaatttgaaatagtttcagttgtgttcttaggcaaatgtgaccacaatacactaacctcagtacttatatgaagtcatttgggttagagtagcagatctagaaggattgaatctccagccccaattatgacaaaatttagtagttcagcgctccagcctcatctacatccttcttgatctctttatgaatagaataataatttcttagaagatatcagtccaatcctatctttgttcactgagttaataaaactgtaaaataatatacccatatatttgctgctcaaattgtttctttatgattctggtacaataattttgaggagaaaataagatggacaaggtataaatatttcttaaaaaacttttcacgagcaaatatttaatatttttgtttgttttttgttttgttttgtttttgtaaatacaaaaagacaatatctatgtcaataacaaactctggatgcctacagttatagtcattaccactttcatttcataatccaagtattatatgatacccaaacctgaaataattaggaataaacaatgtttctttgggtctaactgccaccagcaagatcactgaaatgttggcacatccttcaagaaccctttcaatctcctctctgctgtctcttcttccctcccatttgtgtgtttaagcttgaacagcttccagcaaccaagctttttacctcctattaccaccccatccatttagcagatcacatccctaccctctttccagtgtccacatcaagacatggatatcatacaagggaatttttctcttgcaattggagccactttatcccattactggcattgtctcttgctttgctttggtatagttattgatgcacattaaaactcccagtgttgtcagattgctgctccgctcagctttgagctggtactactctttgaagtcaatgctgatgactaatacagaagataatttcggagatcattctgttgctgccatcctgacccaatgtggaactgctcagaagccattcttctcatatagagagaatctttgttcaccacttctgccagtctgttaactaagttccaaagtagtgctaccttgtcttcccagtattttagagactttgggtaaaagggatgtattagattttctttgattccctttctttctaggagttaaacatgcatctattgaagctgtgccagaagtaactctgagttatagacttaaaaaaatatcactgcagctcatctttttcttaagatgacttcttgcccacaaaattgctcaatcttctttaaatatatgcctggcgaatcaaatctatcactgttctagctatgcctggatgtgtctgaatcctaaggtgactaagcttgggctcaagctggtatccttaccatactttattttaatgttctttttgttacctcacccccattttcatttccactgtatattcaatgcttcatctttatgtatgtttttaaactagaaactactctaaaacaagaatcagctttgaaaattaaatccatgttgatacacacatgtaaaggtaatgtgtttctaaatcaaaatgctttaggtaggcttcttcagttatatatttgcaatatctaaaacatactgtatgtttaataatatcatttaaaaagttcaaataaagttttataaagaatttactttttttttaatacatacggtgtagtctgggtttctctcagtacttctactaaaataactattcagtctttgaaaaggtttagtcaacataatcaatataagtgtattgtttctgaaatactaggtcaaatagttaatgcatctatggtgtagctcaagaccaagggtaactgagcaagcattaacttgtggaatcttaatagtcactccattgctgaagtaaaaaggaaaccaagaggaaacttaataatattaaaagttattttaaagggagttcacattggtttggagggtactttgcttcaaatacaatatccacctttgtaaaacccaagaaacccgtatttgtaacatacacacatcttttcagtttttagaacataaatcttcagatccgtattatttctccacagataaaaattaaaatattgaaagtctttggaataataacaaaagaaaccccctggcaacccaaaggaaacttggaacttcttgttaagtgcttatttaactataaaagagtcagtgtgtgttgtaatgaatggaaaattgattttattgtattccatttatgaacatctctcagcaacctatttcagtattagaaagatcatacattaaaaatgatttctgcagtcatcaatgtatacaagttaaaatttagctcctgttaaattaacacttcattaaaatatcaaaataaaagcttcgtcaaatacttttttatgttgtactccaagacagaaaaaaaaaatgaaaaaatttaaagaacagattgctagttattctattctataacagttaagtttctcagttcttttttttttcttttgctaagctctctgtcactggaaacatcttaaaccaatttcaagtgctacacctgaataaacatgttgtaaaagtgtttatgtattgaagtgggtcagttcaaggtatggtatttggctggaacttctaatttctctttttacagtgaaagggctgccagaaggaggaagtctgagctgaattaatacatttgttacagtggaagtagaatggaaactgctcggaccacaaatcaaactgcctctttcatttatgccagtgatagagtttttctaaaaaatatagactctggcatagagccactgtaagtttgcatttaaaagagaaatctatatgcttatttgtttaaggtttactgctttgattatttgtaagtcccttctcttgtagaactcagtatagtggcatttgtgaggcagatggccattttaatacttgtaggaattggacaacttttcccagtaggttgtaagacaactgtggaggatacctatgctgtctaaattgatgcagcctttttttttttttcaaccaatacctccacatttgaagaacccctgtgtccgtccctctcaacagctgcacaaccttatacgacacggtctcattttctgacggtcttgttctctgcacaatggaagtatacacaaaagtttttatgctgccaaaataaattttgttaagagcaagggtttatttgctaaaatgccattgatgccattttggggacttgctttcctttcctttcttctaaggtgggtcaggttttataatggactgaggttgctccacagtctttactgaataaatattttaagaaaacatgcacatctctcatggggcaagccagagtcaatcatgcacatatttcaaaccacattatatgttactcttaaaagattgctaacttctgtatctagagtagcaactttgcataagatatacataattcttaaccaaatttacaatttaaggttaaatatcatctttgaatgattttcattgaaccagatatcaatggttttctttttcacatatatataaaatataattttcagtgattattttaaattagaagagcctaataaaaactactaaaagaggatactattaatacctaactgtagggcatttgtggaatccaattaaataatgcatggaaactacttagaaagatgcctagcacagcaaccactccaaagtgatttgacatagttttaagtattattattactacccacatgggagaggtactttatcaactttatctctagggcaccttgacttttaactcactcctatattggtacttgttgtgtcccttttcactgatatataaccacatcaaagaacacataagggtctgagacacaggctagtttataggcaaatttgagtcttgaagctcacttggattgtttattcttctttctgagagtctccaggcttggtttgcctcttctgaattcctttcagtaaacatttaggtgtgtcaaaactcagaaggggaggaattccaaaatttctatgtttatttcacaatacttcatattgataattatcaggttggtgcaaaggtaattgcagtttttgccactacttttaataactgcggcttaaagcagacctccatccccagactaggcttccagaatgacttgtgaagaactttaagtgtagtgcagcttagtaaaggttgctgggcactggccagaagtgaaggtggaaaggctatcaccactaattaacacttgaaaggcttcgaataggctggagaaagtagaaacaccctgccaagtattcggcttttataacttaaaggaaaattacagggcatttagtgccgaagagcccatagctaatatttttttaaattgttatttaatgtggacatttccaggcgaatgagtagtcaaatcttccaatttatagtattcttgacttcaaggtctgagaagctctcagtgagtgaaagcagctggagggtattctgtggtggaagaatgatgcaagatgtaacaccatagatggataattgtctgtaatagtaagcctcaatatttataagaatcttggcctgtaaggaaggcattctgataatgttttaaaacttttccccttttcaaagtaccctcagaattcattcacatcaggtaattgttctttctttttcataaaccaagtgcttttgtattacgttctaggacgcagtatcaacgtaaaatctgctggtcttgtgggaagacagggacctcagtcaaaacaaccattcatggtggccttcttcaaggcgagtgaggtacttcttcgatccgtgagagcagccaacaaacgaaaaaatcaaaaccgcaataaatccagctctcatcaggactcctccagaatgtccagtgttggaggtaagaataaacccgagcagcagttatgcacagagagttatggggtcgtatgctgcaaatcaagtagccacaataaatttaccctctatgtataccttcggatggtacattaaatcttccagtgatgtttctagcatcccagaatgtttcatcagtgaatcactcagtaattcattttaaaatacatatgagttgccttcatatgttgaaagattcagttcaaattaaagtcaagatgacagtaataaaattatgaaatggctaatcaacacaatctagccagaactgagctacatgacttgctgagctaacttcctcagggcctttcaaaaatggatggtcaaccaggtaaattaaatgtaaaatcctttctttcgtacttaagtcaatacatgtgaattatgctactcagttttatttttctgagattagcaggagaaagacataagaagacaatgattaaaatatttaccttttcattatttggaggactattatctaattttcttcaggtgtgtctacacacacacacacacacacacacacacacacagtctttcaacaaaatattacgaatgcacaattcatgtcagtctttgcaaattaatctgttaattatagagggatcaaatttcaattgatcagaaagcatctaactgccaaaatttgtagtggcttaatcgtattatttataccaagaagtaccttgtttagtccaggatgcaaacagtaagctgttagatgaaaatggtggctattttagttcaaaaattgatttcatgtataaaaataaatttgaagggggaactcatcctggaacatctcaatgtagtatcacatacttatctatttgtcaaatatgcattcttctgtgataatggccaatttatgcatagcactctgccaggcatgatggatgaactaataagcaaaagatacatgattcctatatatattattttaccaaattgaaattctaacttcaaacagtctttgtcattattcctaaaatcttcatttttctcaggttacttgaaaatgacaggtcatacagcagctatttattactcaaacatgcatgagtgtttagataagaaatagatgacgacctttatttgtttgtttttatttgctcagagacgctccataaaactactaggtggaattcattggacttttcctaaagggtaggcaccaggagaatcacgttagaagtcctatttgtgtggcaagcaacagaagcaggagggaagatttctgtatggaattgcattatactgaattaaatgctgcttataaggtgatgttttaaaataattttccaacaaagaaatttaaccacttttagtaaagcatgacactagtgccttattacaacgctattttttaaagatattcacaagatatttagtttggcaaaaagctgtaattacttaatatgaaagatggagaaaaataactttctaagaccttttcttcctggtaaatactaggctgtcaaacttgtatatttttcttttcatgtagaatggttctaagtttggttgaaatgtttttaatttaatgtagcagactgtattaagaaaaagttttgctaaaccttgaatagaatagtaaataattttggaggaaattacaaagggaaaagtataagtcacatacttattatttgagctcataatgactctggcagaggtgttccggtgactgaaatcatcaaagtccttttccctattggttaactctatttatcttctcttcctaaccacaagaaacaaatgtacgtctataagcagagatgaataaaacacatggagcagaaatcacgtaacttttcaccagtttcctaacaccatttagagtacaaaattattctaatatagaccaatattttctttttgaaattttgtcattggcaaccatttctgtgaaatatgtggtagatggttttggagtgtgttcatattttgataagaagaagaaagaaagtagctggtttgtgtctataagacttaacctttcaataggtagtaatcaagcagtctgggaaaatcctcataggatttggtctaaaagacaaggctttaaggaaagggaatgctaatataaacagaaaatttgatacttcagagacttgaaatgccagtgaaatttaaaaattatccaaatataaataacaaagttgtaatagtaactagattttacaataagatattgtgcaaaggctctatggataagaaggggtgggatggggatggagttagggaggaaagttgtattgcctgtttgcctgattgctgggttttttgcaaagcatattatcaaatgttgaaaatctccattagtacagaagaattaaaacccaagtcatttctgctatctttatcacatttcttttctacttcaacgattcttccttctgacttcctgatgttctttttttcttccatattcctgtgggagagcttagaacagaaaccagcacagaataggagtccccaaaatacttgttgagtaaattaacgtgctgacagcataggaaaaactaacttcgtttttcaagtaaaggtatatagaaccattacttccaggtttcctgcagaaactgcccggcactgcttgttcctcttcaggtttttggcaagatggttgaacagacacattgtggaagatatttcctgtttcatgttgaggcagtgcaaagggtatttctttgaatttgtgtatgagaggaaagaaaatggagccaatagctaaattctaagctagctatccttgaagatataaaggcactaggtggataagatttttttaaaaacctccagaacatgatgctgcttgaaggagtatattcagtgttgaaaagaatagagtacaggcataccatgttttattgcattttgctttattgtgtttcaaagataatgtgttttttacaaactgaagttttgtggcagtcctgcattaagcaagtctattggtgacattttttccaacagcatttgtttacttggtttctctgtgtcacattttggtaatttttgcaatatttcaaaattttactgttattattatatttgttatggtttatgttatcagtgatctttgatatttattggtaattgttttgtgacaccacaaattttacccatataagatgggaagtaaatgttgtgtgtgttctgattgctccaacgatcggtcattaccccatctctttcccttctcttgggttccctattccctgagacacaatattgaaataagttcagttagtacccgacaatggcctaaaagtgttcaaatgaaaggaagatttaaacatctctcactttaaatcaaaagctagtaatgattacgcttattgaggaaggtatgttgaaagtccagatagattgaaagctaggcctcttgtgccaaacaaacagttgtcaagttgtgactgcaaaggaaaagtacttgaagaaaattataagtatgacttcatcaacacaataatgataagaaagcgaaatcgttttcttgctgatgtggagaacgtttgagtggtctggatggaagatcaaaccagccacaacattcctttataccaaagccttattcagagcaaagccctgattctcctcaattctatgaaggctgagagagctgaggaagctgcagaagaaaagtctgaaagtagcagatattggttcatgacgtttaaggaaagaagctgtctccatagcaaaaaagtgcaaggtgaaacagcaagtattgatgaagaagctatagcaagttatccaggagatctatctaagatcactgatgaaggtagctacactgaaccacagatttttaatggagattaagaagccttattggaagatgttatgtaggactttcatagctagagaagagtcaatggctggcttcaaatcttctgacaatctgactctcttgttatgggctaatatacctggtgagattaaattgaagacaatgctcatttaccattctgaaaatccttggacccctaagtatcatgattaatctactcttcctgggctctgcaaatggaagaacaaaacctggatgaacagtgcatctgttgatagcatggtttattaactattttaggcaaactgttgagacctattgtccagaaaaaagattcctttcaaaatattagtgcccattgacaatgtacttgatcacccaagagctctgatggagatatacgagtagactaattgtttttatcatgcttgctagcacaacatccattctgctgcccatgcatgaaagagtagttttgacttccaagttttattattttaaagatttattttgtaattctacagcttccataaatagtgattcccctgaaggatctaggcaaccttctggaaaggattcaccattctagattccatttaagaacactcatgatttatgaggggttgaaatatcaacattaacaagggtttggaagaagttgattcctacctcctggatgactttgatgggttcaagacttcagtggaggaaatcattgcagttgtggtagaaatagcaagagaacttgaattacaagcggaacctgaatatatgactggattgctgcaatctcataataaaacttgaatgaatgaggagttgcttcttatggttgagcaaaaaaagtggtttctggatataaaatcttcctggtgaagatactgtgaatgcaattgtaatgacaacaaaggatttagcattttaaataagtttatttactagagtagaggcaggatttgagaagatggactccaattttaaaagaagaccttcacaaagtaaagtgctatcaaacagccttgcacactacacaaagaatcttttgtgaaaggaagagtcaatcaatgtgacaaattttatcgttgtcttttaagaaattgccacagccacatcaaccttcagcaatcaccaacctgatcagtcagcaggtatcaacattgaggcaagaccctttactagcaaaaggattacaacttgctgaagactcagatgatcactagcattttttaatcaatagattatttttaactaaggtatgtacatttttaaagatataatccaattacacacttaattgactgtagtataatgtaaccataacttttacatgcactgggaaaccaaaaaatattgtgacactcactttattgtgacgttcacttcattgcagtggtctggaactaaattcacaatatctccccagtaaatgtctctgacatatgcctgtatgaagaatccaaaagaattaacagggcaaatggcaagtcctggatcattacagaactgctaagaaagattgctattgtatgctggatactgagaatcttcgaaaaataatccaatcatgtagtggccctgcctacatccatggtgatttcgtagggcaagtctttggtatacaggtgctcttcaacttaaaatggggttatatcccaataaacccaaataaagtttgcagtaccataagctcaaatatcatagcttagcctagcctcccttacacatgcccataacatttacattagcctacagctgggcaaactcatctaaaacaaggcctatttcataattaagttttgaatatcttatgtaatttattggacactctactgaaagtgaaaaacagaatgcttgtgtgggtactcatagtatgatttctactgaatgtgtattgctttcaaaccatcatcaatttaaaaaatcttaagtcaaagcattgtaaatcagataaaatgcatagttactaaaattgaaacattctattcttgttctcaaatttgataggcgctatctcttgcctaataaatacaatgtaaatttatgcctcttggaaaaacagatattagtcaaaacaagaaaataattaattgaagttatttccatcgaatgttttatattatataattaatacactgttttagtgtttagaaataataaaatcataaataaagctaaagttctcccttgtttacctaatccatacataatagattaccttaatatgctgatatcaacatggtacaaacctctctctcatctcttttgagagaatgtatttttgttatatgcttttaattacatgaattatatattttacaggttttataaacaatgtttagccatatgtcaaataacgtgagctaattcttttcaactgttgcagcttagtattggcatcagtttatttaatcatgtcactccaaaaagacattttgctttttttccaagttggcactctcaaaataaatgctgtactgaaaatcctgcaatgctgcacaagtgagaatatttctaatccacgtaattatgacagtaactaatattaaaagttgctatctgtgccctgaatcatgaaaaattctggaaacccctcctgaaacaagtatgttgatgcatatagtatgtcgttagctagctctctctatctatatatttatctatcatctatccatcacttaatatctaatactgacttcactacttactagttgtataatcttgcacaagatatattacctctctctgactgtttcctcatgtataaagtgggaatgttaattatacctgccttgcagagcaggattacaagagttctgaggattaaatgagttattatatataactaatttaaaatagtggtacacggcaaatgctcattaagtgttgaacattataattggttttatagaactggtacaaaaggagttcaaactcttacatcagagaaaaccagaagttcacactctctcttataagtactcatacctgtggtcacaggatttcttatcttttgagactttagaagcaagagaaattttagtctttaacctaatttggctaatctatattagcaattaactacacactttaaaaaagacttgccaatagacattaaggcattgtgtctgttgttaaatttctctctaggaaaaatccacaggaagaatatatctgggtataatttcttataaataatatttattcaatatcaaataaactcccattatatgccaggcacagcattatatgctatataactatatgccatgcactatattaactatatggcccaaaatactacatgagggacttatctgagaataaatagacattttctagaattaacagacatggatgaaaccatttcaggttgtagaaatgaaatggctctacagttgtagagccatggaccattgtcaaatggctggggtatgcatgtatttttatgtgagaggaatgtggtatcagctaggaaattattaaggggccaaatcataaagagtagggtatgtgatgataaggagcagtgatgtcttcccataggcaattggaaaaagaagaatcataaccagatatgcattttaaaaagttaattttggccatggagtgcagaatggaatgccaagggtggagacagaaaactcaaataatgattagggtctagtataatactccaagcaatgaagatcatagattggagagagagatgtaagaaccaaaacacactggataaggccagcaggggtttgaagagggtggataacccaggactctggagaggggagtgttgagagtaagtggaatgtgtagggaaaagatatagctataagccaaattgttagatgtaggatgaggctgaccaaatgccacaggaaacaaagaaagaaaaaatataagatggagcctccttggggaacatcaacactgtaagtacaggcagaggagaaaaagaaattccataaaataagccaaaaaaaatcagagatgtcaaagaggagcagggataaagtgttattttagaaaaggttagcagaagaggacattgaggaagtatgaggcaactaagagtgcaaagggcttccaacaggatacctagattaaatagtgaaattgatcaactaatgaggctttgtggatccatttaatataggatcagaggggaaaaatgaaaatcaagaagcttattaaattttctggcctggacgactgatggtcctattaacaaaaatagtgaacattgagtgtgaggtcagaagtagaaatagtgagcaggaggcgtcagggaactgtcctttagaggtgtctagcaaattcaggtttgtggatagatttttatatcaaggagctctaaagtgacgatgttaattacatgatccacatggatactttgctgagcagagttatgcaaacacattacagagttattttgtggtgtcttgcgtcacacattggtacctacacaaacacaaaattgtgttaatatatctacaaaataaacaacagtacgtattactggcttgtgtgtaaatgcaagtgaataattcactgggtatagaaaataatgattaagctagaacaacaatagcattttaaagccccttatctttgggtaggattgttatttatttttgggcttatcctgaatttttctacccccaaggtcatatcaaaatccacattatggtagcaccattcctgctttttcaactcttgtaccttcattcatttatcattttaaatttttataaataaattaaggtcttctgatgctttaggtatcaacttcctttttccctctttctctttgggaaataagagtgaaaacactaacatctcctcttttgctttgaaacagcagcatatcatcatatttagctcattgaagctgttgtcatggttaaatgttaagttttatttctgatttttctttgcttttatagctatatctgtgtttcatccctttaataaactaatactatgttctgaagaaaaaaaatggtatatgaaggtttttggcctggattgtctttgtccagttcacagcaagtctatcccatgtttatttatttgtttttttcaggagctagtatgcagaactttgacagtccatgcagatttctggaatttgtttttattgatacataataattatacatattcatggggtacatgtgatattttgatagatgtatacaatgtgtaatgatcaaatcagggtaattaagatatccatcacatcaaatatttatcatttctttacattgggaacattcctaatcttgtcttctagttattttgaaatgtagaattaattatcgctaaccattgtaaccatactgtgctattatcgaacactacaactgatttcttctgtaagttttttaaaaagctgtagttttgtgttcattaaccaattgttcttcatcccctctttctgctaccattcccagcttttggtaaccaccattctactctctacctatcttcaggagatctttttttttttttttagcttacacatatgactaagaacaggggttatttgtctctctgtgcctggcttatctcacttgacatcttccagttgtttcatccatcttgctctaattgacttttttttcttttctttctttctttttttcttttttttttttttttgagacagagtcttgctctgtcgcccaggctgaagtgaagtggcaccatctcgctcactgcaagctccgcctcccgggttcacgccgttctcctgcctcagcctcctgagtagctgggactacaggcgtccgccactacgcctggctaatttttcgtatttttagtagagacggggtttcaccgtgttagccagaatggtgtcgatcttctgacctcgtgatccgccctccttggcctcccaaagtgctgggattacaggtgtgagacaccacgccaggccaatttcattctttttatggctgaataataagctgttgtgtatatgtaccacattttctttatccattcatacactgatggacacttatgttgcttctgtatcttgtgaatagtgctgcaatcaatatgggagtgcagatgtatcttcaacttattgatttcctttgttttggatatatacccagtggtgagattgcttgatgatatggtagctctacttttacttttgggaggaacctcaaaaaagaggttgtattaatttacatttccaccaacagtgtactagtgttcttcttatcatattcaggaatttttgtgttttaccaacttttacctccacgtatttattttgtttttcatgattttattctaagacaaaaagaatcaaactaaagaaaatcgaactaaagattaaatttatacaatatctagaaattgaccataaagaaatttgcataaagtatttagcaatatgtttactattttggcatgggcttcctaatattattactattaagagacaaaacagagaaatattattgataacacttgcactatggataagacatgttggtttactttttctagtgttgattgtagaacattttaataatttttgccatgactcttcatttgtaggcaggctcattaacagtagaattatatccatttcatactaatctcctaaaggctgcccatcagtattttaaaagacataaatctaacttccttgcccttcctcctacggcttattctgccaagcatttagagtaaacctaactgcaggcttttctagtttgggtacaacatttacttcactcactatccattaatttttatttctgacagaataagcatatggtcctaatgctctatgaaatcagactcttggaaccagattctgttatacatttcattgcttgttacatttatgtgatgttacattatatacatcacttagcctgcataaaaagacatatatatggaacagatatattttgactttaaagttttattttctttattttttatatacatagaattcaaataatcatatttgtagtttatggcttttcatataaacatgtatgtgctattggctacaatgttgttattcatatttaatatttttaattaagacaaagatgaatagataaatattcccattattacctaatgcagagtttgaaaaagtaaggcctaataaccaaattaagcctatcatttgtttttgtatgacctactaagagtggtctttacatttgaaaatgtttgcgtggaaaagaaggacaatattttgcagcatgtgggaatcatatgaaattcaaattttagtatccataggtagttttactggaatatagccacacccattcatttacgtattgtctacggttgcttttatactacagcagcaaaatcgagtagttgcaaggagaccacttagcccaacatatttactatcagtttctttaaaaaaaagtttaaagaagtttaaaaaacttttaaaaagtttgctgacccctggtccaatgcatagctaacatttgtttttccccgttttgtatatcaaggagtttatgaaatcaaaccaatagtagaatcaattatttctttttctaaacacgatcgaggaaatttaaccatttcatgtttagtgttaaagtgttatttatccattgcctgaacaaagttagctgcaagggagatatttccctgaagaagaaccagaatgtagagtctgaaataaatcctctctcccccatttcccattatctacttatttaatctgttttaatgaagttaattgcatagtaggaataaataacctagaagaaaaataccttgatttcaaaatttaatcattagcttgttttttagattaacattaaacaaataattacttgaagtaaccatgagaagcaaggccctctatgatgggctcctttgatctctaacttgcctacactttcattagaggttgagagtaattaaacaggaaggtgacactttaacaaaaactgtaaaacaaattattttttaattttatttctttaatattttattttagaaataatcaaagtggactagtttttcgaatgttatttgtacaaaatgtgagcaaacccaacacaagacaagaatgaaaaatgttccataaatctctgtgtttcttcagtattttactttattccagatgcaagattgaaattctacatttatatttaataatttaaaacaattataaaaagttatgggtatttcagattacattccaaaatatgtaatgatagtatttcacttgcctcaaatcacttatggaacactatgagaaatttgtccattaactcctcagatacttttttgaatgtttattttatgccaggcactgttcctggcactagggatacatcagtgagcaaaacagagccaaacgagattcttgcccctatgacgcttatattttagtgggaggaaacagacaagaagccacacataaataaatgaggaaatgacatagcatttctaaaagtgataattgagatggaaaaaaatcagaacagagtgagagaaatcaggtgtatcagggtgagagttgcaatattaaaagggtagtgaaggtcttgttgagatgttgcttaagcaaggacatgaagatgcaggaattagccatgtagctatccagggagagggactagtgagagaaaaggctctaaagtgggagcaaggttgactgtgagtgaaacagcaaggaggtatggtggctggagcaaggtgaaggagaagaagtgagagtcagaggggtaataggatcaaatgagtcagaggggtaataagaccaaaatgtaaagagccttgtaaccactctgagaatatttcactcttaatgatatgaagaccatagagggactggcagggaagtgatgtaattaagtttacttgttaaaaggtccacttgactagtttgctatagaggagcaagggcagaagcagggagactagcaatgaggatattgcagtaattcatgccagagatgatggtgtcttggaccaagaccaattatgaagggcgtgagagcaggtgcattttggacttattgaagatagtgtgtgagatttcctgacagattggatgtgtaaatgaaagaaaaaaaaagaactattttgattcttgttgttttgttttggtttttattttttaacccaggcaactaccattagtcaagaatgaagtctacaggtggacaggattttgggggatgattagaagctcaacttgtggtatcctgaggttaagatatttattaaaataaaatcagctaagtaagatcccagtatctgcctcatggaagatgttacaagttattgcacaaatattatatatatataatctctctcaatatattaagtacccctagagtatgaatgaattaatgaataagtattcattgagcagatggtactcaatgaacgacagacaccatgctgtgccctgtcaagtagatggcttaacagaatccatgttagagcttcatcaggtaaatggtattgtctacatctcacagaagaagaaactcaggacaagtaacttgactgaagttcacatggttagtaagtagttctaactttaagattgaaactcatttttccacaacttcaaataaaacccctttaaaaaatcttaccagtgatctcacaaaagaagtattagtatatctgtaagcaaccatttattcaaaatgtggtttttatcttcagattataacacaagtgagcaaaaacaagcctgtaagaagcacgaactctatgtgagcttccgggatctgggatggcaggtaggaattttcagtcaactttggtgcttcttttctgaattatcataaatccttaataagtcatagtctttggcagtaattttccaatataatacccaatgatttttgacatgaccatttagaatatggcttattcactttattttcatttctcaattaaccttttaccattgaaacatgattagtaggtatcacagtcaaacaaaaaaactacgctgaatgagacatagaacactaagatatttaggaagaaaaaaaagagtgccgttgtttaagtattccaaacttttaattttattgtaaatagaagatttgttcatattagtataagtaactccactaagcctctgagggtctccaactattggaatgtccctgtcatggggaagatgacagacatttttttttcttgcacttaaaaatgtattgctatcttttgggtagcctttagaaacaggatgaggaggaaaatttcaccaaagtaattttttaatggctctatgtggtgacagtttaaaatgaaattttaagacttctcctaatattctattagaatggattctcatatatgagttcctgtattgagaaatactattaaaatgtaaatatattcaaaattcatgataaactttccacatgaataactcaataattcctacatttgtgccaagttttatttctctgtgggaaaaatatcaaggcaaccattcatgtaccaattctttagcttcccgaaatttatcatgttcagtttttaggaatttgctccaatttattttttctaaagagaccataaagttaatgcatgaatggaaagaaaaacagcatgcagaaaaaatattaaggctttaggatgttgtcagacttataaaactaagaatgagttcttaagaagtaatgagaatgatctcaattaacttgattctcctttttctttcgggttcacttgaactttccagagttcatcatttcctgtttaaacaatatttagaatgctattttcttataatagttttattcgtgaatacatgtttaatacatactatgaatatcttacataactaccccttgggagtaattagagaggacaatttcttgtgaaaatatttatacttttgtcctaaacttcagcttaaaattaaagggtgtggggaagataattccattagaataattgttggaccaagaatagaaacctattcagatacaatatatttcaataacttttaagattttttaaaaatttttactttggtgatattttttcttgttgtttttttttttttttttttttttttttttttttttttttgtgtgtgtgtgtgtgtgtgtatgtgtcaggactggattatagcaccagaaggatacgctgcattttattgtgatggagaatgttcttttccacttaacgcccatatgaatgccaccaaccacgctatagttcagactctggtaagctttgtttttgaaggattaagaaaagcttagaatgcaagcatattataaagttgttttagaggaaagcatctatttacaattttaatgcattattttatcttctcaaactcatttgtttctttttagagctgaagtaacaactgtgggtatagtcaggaaactcgggctggtttagagtaatcccagttacacaatggagaaggattcagctaggaaaactggagtaataacatgaaatggtcatcttgaactgtttgttcattacacagtatgactaagcacacaggttccctggggctgtttctaacctagcaattcattagtaatcattgcaaaaacattgagtaatagctgtactaaatttcatctgagggtttttaattatttaagaatgttctataacatactttggtattataaaagttcttcaatgtagtatacaaataggaagctaatttctatttcttattgttctcctcctcctcctgtaatctttaaagtagaaattatacttccttttctttattcctcaatctcagaaacttagcagtgattaaatctctaataatctaggcttatttttatgaacaatgtactgaagggttgacgtgattaactgattgccttgtacctaatgagctcatgaaacctattgagagtctgatgtacctcatagcatctggcctatcgatttggcagaggaacaatctccctaagactaaatgagaggctcctagaaaacataccagactatgtgacataattttaaatcaatgtttgggctaatataaaaattttaacttttgtatttaagaagaatgggagagaacacattattttagaatcaaggcttgatgggagtggaattatttggtggacgccagtaagagaaaagtagatagtagacaatcttgtctttgtgggtgaggtttatttatggaaaaagaaagaattactcttagaatttgtgaagattcgactctccataagtttgctattttcccccacaattaatttaaaacttaaagctgaattaaggaataaacaatgatatctgtgaactggcaaaagcaaatacttgaatgacttgatatttactggcatctttattgacttaataaaatacgacagaatatctagacaccaaaaagtgcaatctataacaactagagcatgaacgttatcaaagactggaaataaccttgggctagagagcaacagaaagataaagcaaatatacattttgataataaattatttataagtattcttctttttattgattcatgaccagtgagaatgcctactttagtgccatatacaaggtaaagagtaaatttctggggggatttaaagtctgatatgacttcacctttgctatctgtaagtataagctcttctttatatggaatagtgtttccaggagtatggagtgtaggtaggctttgcaaggatggatgttttgcattcaaacttctaccactaaaagaatttttaagaagctaacttttctctttgtatatgagaattcatgttgacatgaaagcatatcagataaagaagaatgctgttgtttcatcctatgaagagaacttcatgatcactgtctttctgtaaggtcatagaataactcctatcagttgaagtaatgctatttaatttctcagaaaattctttgcctctttttatcatcattttgatgactatgaaagcagacttttgcttccttagatatggatctaatgtatcaaaaattccctcaggctaagcaatgcctacttattgaaaaataccctttgtcaaatactcccccttctctcattttttcttttttaaaataaataaatacatattttcagctcttatggctgtagtaaagtatcaaaaaacaaatataaaaaaaatctgacacaaactttgaacaagagtctgctctgtatctctaccctgggatgtaggacataagtcattgcaaaactggagcatacacgtgaagtttgattttttttccctggtgttgtgcacgctttatgtttgttctgtgaaggacatgaaacaaaaagacggaggaaagcatgtttgtgactaatatattgagaaaccattcaagaacaatccattttttttccgttaggctgccaaggccattgaaacagcaggattatcaatcatgtatgtgtgggttatggaagataaagctgatgaaggacataagcagcatcagaaatttgtagaaactatccaacttttagttttgtgaggccttaggaaatttcaagttcatgtcagatcacctcatttttcctgctgtttctgtccacatgcaaggcccctatatcatttcagccaggacgttgtacagccaaaactgtaagaggctgtatttgctttttgtggatcccgtaagactcatcagtgggatttcccataaactcctctgggggaagggccagaataggtgggtgggaaatgggggaactgtgttctggctcttttctcaattatttcaaatcataggcagactgccagtctgatcaaaattattatcaaccctttacttaagcatttcacttttcatgtacagacacctttttaggcttttggggaggtggatgttcatttgtaaagtctctaggccctttgcttctgatttagcttagcctgctttttggcacttgtctagggggcaggcaagggagaaaaaaagtaaatggatattaaactccagccaatgtgataaaaaaattctatgaagagctgaaatcattgctctaaggcaagtattggattatatgtggattttattttattatgatttttatgcttcttttaccatggaaaattaagagttggcttaaaatgtatgatttattgcttaattttccttttaaaagataattcttagatccaaatctttctgcaactatgtgttttcattgatttgctcttgtaacttccatattcctcatgatatatataggaacagttatttcaactaaaagcaacaacgtgctagttgctgtgttctttccctaggaaaacttccactgaatattctatagaggaagttttctttatttggtgagatatttttcaaggttcaaacacataattgaattggctgggttgattccaggtgttaatgcttaagaatacatccttcagtcccccaccccagtcatggaataaatgggagaagggagatcagcttaatggtgtgcctgattatgagtgataaaataatcataccattttaaaactgcaaaagaatgtatattttatttcttaataaaacaaaaccttttttctttcccaggttcatctgatgtttcctgaccacgtaccaaagccttgttgtgctccaaccaaattaaatgccatctctgttctgtactttgatgacagctccaatgtcattttgaaaaaatatagaaatatggtagtacgctcatgtggctgccactaatattaaataatattgataataacaaaaagatctgtattaaggtttatggctgcaataaaaagcatactttcagacaaacggggaatttcct

SEQ ID NO: 36755 - DNA, 120136 bp, Homo sapiens; identical to SEQ ID NO: 36754

SEQ ID NO: 36756 - DNA, 64558 bp, Homo sapiens
agtaacagttgattgttacattcagtaacactgaatgtcagtgcagtccaatttacaggctggagcagcagctgcatcctgcatttccccgaagtattacatgattttcactccttgcaaactttgccatctttgttgcagagaatcgggtaagttgctctgaatttacaccttcgtgtagagatccaagttactgtaaagctcattctgtgggatgagagtgatctcttcatgtgtttgttgtgtccctttggtgctctgtggggaacagttactgaagcttgcaaatgggacagaggaagtgagccagcaggcacatgcatcaaatcttcctattattcagggaacgcagactttgtttatttaactgctgagaaaataatgaatttattcaactctgtataaaggaccatagcacgtgtggaatcactgtgatatatattcttagtgagtttcctaagaaaaaacatttcatactggcttacccttaaatgcattgtttattgaatctctctgtaaaagtaatctttgattagtcttcctttttttttctttttaaatgggataaagttagtagttaacttactttttcctgaacaaaatacttttctcaatcaacattttgtcacctaaaactttaacagtaacaactggcaaatgagaggtctgtttattttatgtaaataaaaacaaaacctgttttctaatttgatttacagtgatttatgagcgtgtcccctttgccctttgtgttcactttttatatgtttgtttaaattgtagcaaaatattttacatttgctattattttactattatagaaatagtaagcaaatgtactttctgctcatcctataatcttgtaaaactattattttgataacatcagttccactttaaccagggaattaaatattaaggattataaaatctatgaatgactaaaagtaaactgaaatgtgatttcattgtttatgatttctatttattatatatttttattttatgagtatgtcttctacatttttatgaatatatttcatgataataaactcaattaggagctcctgtcactagtctgtgtaatgccttccttaatataaactatctcatagttacaataaatacaatgacagtttacttatataagtagttactttgtttaaggataagcgtgagcttttaaagtgtgactttaacatttgaataaaaatcttcagaattttctctggatataaaataaagtagtcttttggatgccaaataaatttctaattgggttatcaaagttctgttttgttctcctaattttttgttgttgttgtttgtttgtattgtcctagttttttaattgtaaaaatatgtttgggatgtattccatatttcatttttataaaacataagctactaatagctaaacaagtcacatcttatctataaatttggttccttcttcgagtcatttcttgataagtataatatatatttacattgaatattatcttcatttcgatggtttcttgccagcatctgctcattcttaccaaaattagacggtcccagatgttaagagaattgtaattgaatagatagcaacctaagaggagatttaattttcagagaagactcaagaaatctctctaataaatgttcaaattattcacacaatgaagtttgcaaatgttcttcctaattgaggacagataaaacatcttaagtttcttatatctaatgtagtgtcttctatatgtatacatgcctaaagcatagctgaagaatccctgaaagacagtgatgtagtctatttataatcagacttcctcaattccccacttcacttagtctgcaacaaaacaagctttttaagtttgatataaagacgtcgttgttccaatttcttcaaatacatttaagagagcttgttctagatcatattaatattatctagatggctctttctctaccattttaagagggtttatttccaagtagaaataaatatttatttaattgtaactttttaaaagatagggaaattatacacagggaaaatattttgaatatttgcttgaacatcttttaaaaattcttggcttgtcccttattttgaaaatctggttgatattcaagtatcccaaaaaatagctctttatacaaattattttatcacactcacatcttatagtataacatttagtattttttgttaaaatcagctagggaatattaatagtactttcaaaattgaattaaaaatacaaaaaaagatttgtcaccttttttatttgaaagttattgttataacagtttagcattttcaaaaattgccagtaaattttcttaattccaaacaaaaactcagttcctcaaaaactcaaattcctcaaaaactcaattcctcaaaaactagaatggtctgaattccaaacaaaaactcctgtctttatttccaatattaaatactattttgataagcaaattgatctaaattcagatacacagctgtatttgtgaaaatgtgccccatttttatgataatgtttatgctactatgttctctcagaatcatgtgagacagtatccaattgcaccagaatttattaaaagaaaaacgatcaaacctgcacgttgtgcacatgtaccctaaaacttaaagtataataataataaaattaaaaaaaagaaaaacgataatgttttgttgaatatcctaatcattaataaaaattttgagatatagactcaatatttttattctattttcatttatttctctttcgattgctcaattacatgataaacatatcaaaatttttaaagtcttttaatggcaaaactacagagtagcatgttagaatagataataccagattataaaaagggcaaagtgatgcttatttaaaaaataaagtactgcaattaaatataaaaacattagcctacaatacactaacagtatatgaacatctgcatatttttatattaaagtacacattaaataatatgtcatatgacactctgcaacaatacatatgagttagcattatattgtcatttttgcaatgaatgcatgcttacaagaattgctttgattgttaccaattacattatttgcaagttgataactcagatatcattatcgaaaaattaaagattttaattcataccatattattatataacaagacctactcagcataaaatataaatatcaacatataataaattttgtattaaatcaagttaagtgacatgggaagatattacaaccatttagatgttatagcaactgtttaacataaacaatgaaacatcacatttcataattacacaaaacacaaatacagttttgtagcaactatagtacttgctttgcaataatataaactgtttgtagaacaagtttgaaaactatcagagaccaaaatttatttcaatttggtgtttggtttctaaagacaaactaatattcaaataaaatcaaggaaaaaatagatggcttttgcattagacttagaagaacattgactgagctaggcaagagggagaatgggtacaaccagggatgatgcaattaatttattaaattgcagcttagaacgaaccgcccaatcagctttgcaccttattcactttttcttcccagaggatgttttcaaaacagaaaataaaaaaaatcatactagcactttgtttttctccagatgctctcctgcatttattaaagagaaaaggattagcggttatcagaaagaaaaaagaactgaagcagtagagtgcctctaaaactttgattatgtctgaaatgttattagtgtcaggtaacaggaaactttaagtcattgttatattttacttatttatttactgtgatttatgatacagtcatacaatacataatgatgcttcaatcaataatggtggtcttatacaattataatatagtattttcactgtaccttttctctgtttacatacacatacagttaccattttctaacaattgcctacagtattcaggaacatgttatacagatttgtagcctagatgcaacagcctataccatatagcctaaaggtgtggtaggctatggcatctaagtttgcgtgagtacacttataatgtgtgcacaatgattagatcgcctaacaatgcatttcttagaatgtatccctgtcaataaatggcatatgacaaggatacattatataatagtacctaaattatatataatagtacctaaatatcatgaatgtagaaatgctgctaaaaatatattttaattatgttttattgatcttagcacacatctaattgtaccaaacagaactgaaaaaataataatcttgtggcttgatttttttaaaaccttattattatagcagtcattttatatgtaaatatatatgcatatacatatgaatattgttagaattagatatagaaatagatatatccattaagtatcaagccctgaaccaaatgctccagaccatggattaataaattgagatatttattgggataaaaaatacttgtaggtcactagatatcctatgaccattggtgaattaggctgatttgaaatatgataccctacgtctgggacataggcattagaatagttatttattctctttctttgagaaaatctaaattaaataaacaaagacaaaactaatacaaatgcttagtatttgtaggattcgtttattggttgtgtaggttggatttcagcaacctaattacagcatgagaaaaaataaagggaaggctttgtacattaatggatctttgttattattatgtgaatgagaatcagtatttgtaattgactattttagttatataaacacattagttcttctatggccgggcgcggtggctcatgcctgtaatcccagctctttgggaggccgaggtaagtggatcacttgaggtcaggagttcgagaccagcctggccaacatggtaaaaccccatctctactaaaatacaaaaattacctgggtgtggtgccatacacctgtaatcccagctacttgggaggctgaggcagaagaatcacttgagcccaggaggcagaggttgcagtgagccgagatcacaccactgcactctagcttggcgacagagtgagactccatctcaaaagagacattagttcatttaaatgatatttgcatcacattttgctgtccctctttgtcacagagtttccaaatctgatttttaatttcttttttattgaaaagaaactcacatctgcattatgaatttctgataaaacttagatctcttctaatagtctatgtcatccattaaatattatttcataaatgtcaaatacttatgattttgtaggtcacaaagattatttttgcttctgccatgtggcccaatagtttctaagctttgatcctctaatttcagtcatttttttcattataaaaaatgcaaataattctgactgtgctaacacatttagcttcactagttgcatatactttaatctgttaacaaattgctataacaaatatgaatacatattgagtaatactgagtataaaattcctcttaagccacaatcttctcccagacattataatgctagcccctggttctctctattgacattataaatctggtaaagagtccctcatgtttattaaattttggagaaattacctggaatatatcctcagccttcgctctttattttttccatagcccttactagtggtagcatgtttgttagtttttacaatttgtagaataaatggtgactaccatatatttgttacttaatattctgtgaataaattgtctaaattctcttcagtttgtataataggattgtatagaggaagatgtcacttggcaaaagggaccacagaaaagacaaggaaaacagaaaaggacaataatgacaatctattgatccttaaaagttcttaacctacttaacaattctgccaagaaccagccagtcatgatatttcagagaatatatgaacttgtattttctcctcttaccaaggcagaaattatatctgatgtaggtagactactgtttactgcttttttggtggagctgtacatatagtcagaagtaacattaaatttggctaggacaaacattctatttaaaatactagctcttccttacaaagatttgacaataaatatccctaaaatgaatattttttattttccattccactatttttttttctaaattgaaaactaaaatatctctgttttctattttttcctatgtaggcctttacagaagcaggtttatttgttttcataatttgtagaattactaacgactatattttaggtaattatcatcaataaagtataatatgctatatgcagaaggcttataaaacattatacttacctctctttcagaaatcaatatgcatagcaaagtcacaatcatatgcatcagatttctcttttggtttcttttgctctgcatgcttattgggaagtcacatactgaagatgacatcataattgcaacaaagaatggaaaagtcagagggatgaacttgacagtttttggtggcacggtaacagcctttcttggaattccctatgcacagccacctcttggtagacttcgattcaaaaagccacagtctctgaccaagtggtctgatatttggaatgccacaaaatatgcaaattcttgctgtcagaacatagatcaaagttttccaggcttccatggatcagagatgtggaacccaaacactgacctcagtgaagactgtttatatctaaatgtatggattccagcacctaaaccaaaaaatgccactgtattgatatggatttatggtggtggttttcaaactggaacatcatctttacatgtttatgatggcaagtttctggctcgggttgaaagagttattgtagtgtcaatgaactatagggtgggtgccctaggattcttagctttgccaggaaatcctgaggctccagggaacatgggtttatttgatcaacagttggctcttcagtgggttcaaaaaaatatagcagcctttggtggaaatcctaaaagtgtaactctctttggagaaagtgcaggagcagcttcagttagcctgcatttgctttctcctggaagccattcattgttcaccagagccattctgcaaagtggatcctttaatgctccttgggcggtaacatctctttatgaagctaggaacagaacgttgaacttagctaaattgactggttgctctagagagaatgagactgaaataatcaagtgtcttagaaataaagatccccaagaaattcttctgaatgaagcatttgttgtcccctatgggactcctttgtcagtaaactttggtccgaccgtggatggtgattttctcactgacatgccagacatattacttgaacttggacaatttaaaaaaacccagattttggtgggtgttaataaagatgaagggacagcttttttagtctatggtgctcctggcttcagcaaagataacaatagtatcataactagaaaagaatttcaggaaggtttaaaaatattttttccaggagtgagtgagtttggaaaggaatccatcctttttcattacacagactgggtagatgatcagagacctgaaaactaccgtgaggccttgggtgatgttgttggggattataatttcatatgccctgccttggagttcaccaagaagttctcagaatggggaaataatgcctttttctactattttgaacaccgatcctccaaacttccgtggccagaatggatgggagtgatgcatggctatgaaattgaatttgtctttggtttacctctggaaagaagagataattacacaaaagccgaggaaattttgagtagatccatagtgaaacggtgggcaaattttgcaaaatatgggtaagtgctgatttttgtcattgttctctggcttggtttgatccgttttgcttagctttgcttggtctctggggtagactttagtataaagacacagaaatgttttaattatttgttctatttgtaccaaagctggttttattttttcttatgaactgcatttcaactccctgtgtcagagtgtttaaatcatcatcttagaaattttataaaaaatatcttctgatttcatctccaaaatatttcaaagtatttcaacaatgttagccaaagtttttatagaaaaagatgcttagttggagaactaaaattaatgtgagaatactttttaacctgcaagtttacaatgttcacagatttacgtcagagtaggactatttcttcccaagctcttcagcttggtaccatgatacctgatacatgaagtaatgtatctctgcttaggaaattgaagggacatgatggtgatgcagttggccctcagtttacccaaaatatacatttgccattgtattgtttggtttttctttttttcctaataggcctgatcagatttgaggcagcctgtgtttgactggggccatgaggttttagctaagccgttctccacctgagcagtcttatggctgacattagataatcagagacattacaaaaaacatatttcccccatatattataagtattgtgatagtatgtccaaaagagtcagaaaaaataaccatttagaatatattttctaaatatgtatgtgtatctatagaaaataaagtagtttttttttctcccactacatttgtaaaccaaaaccacattttatacatgggagtaaattgcaccaatgtgaataatttaaaaaaaatagaaatttagaaatttacttatacaagaaatgtttacataaatcataagttgattgattcagtaattcagtctatcacactatcttttataactaaacaaaatgccgatagttacattattgctttctggtgttcttttccaccctccatttggaattctttgtatttcatgttactgtatgtatgtttctacaatatcagttgtacaattcttttcaaaatggtttaatacttattcactgtggataaagttataattcttccacctagcattaaaaggcctctgtaatcttgctgcaactcacattactcagtaacaccaggttctgggtaagccagttatctcactaataccaaagattctgagtttaactgcaccttagaactttcttctctcaatgtgccctgtttagaacacctacctctttcctctttaatgacaaagtcctacttttttaaggtcttaatctactacacatctcatgcaacatttctttaattcctagagttgcaattgcttcagacttcttgttcactctcacagaagttgactgtaacttgtctatttcctctttcattgtaagctgttcttcctcaaccatactaaactacgttcttgaaacagaacctgtggttttgatttgatattcattgaagtactatgatgggtatgtatcatatttaacaaatatttggctaatgattgaatgagagctggtaaaagatagtatgagtaaaaaatattatattgccttttcaagatatgtgggttattatattacccgtagctgtaaaatattttattccttctcaacatcagcataaatttctgctcaaggaaagaacgatcagcttatttttagaggtgtattagaattacttatatctcattctgctctctccctcaagactttatccatattacatcatttatatatgtttttaattctttctttaaattctaggaactgtaaatcatttaaggatttaaggatgatttttgaaattattgaaacctaaacttttcaaaggacttcatttttttgcatgttgcaatcattgaggaatttatattttctcatttcacaatggagaacacaaagaatcagatgtgttaaatgccttgtttatggcacccatataacagaccaaagaagaaaatctttgacacttaataggattatttaatacttaattatttaattattaattaattaataaggttatttaatattaaccttataatgggaaataaataaaaattgacattttaataataataatacatatatgtcatggagatcataagctataaagagttaaactgtaaagtagtgtggcaataacaagatgttattttagtaattttatttgcagacgatatttgcacagttgaacagagataataacattatatatttgtgttaagggttgatttgatgtcaagcataatgttaatatcctgatgttcgttatctactttcaaagtatacatgcgaattaatatagaagctttgaataattaagtgaacggcagtggaaacaaagttgataactgttaggtctggaaatctatccacatctttctgaccacagacttgatgtcccaaatctgtaatttccaagggcaaagactttcctcctaggcccctttctttctacccaccaatgacatttaacaatgtctggagccctttttgagtgtcagtactagggaaacagatgataccagcaaggtaaaggcccagcatgctgctaaacaccctgtaatgcacacggcggcattccacaatgatataattattcattccaaaatgtaaataatgccaaggttgagaaactcttctagtctctacttcctcagaacttcaaaatgtcttattaaggaagtaaaagtagaattggagctgtaattatcatttaggaaaatgagttttcaagttcatgattcatgaaatgttttaataaattcttcttaattagtaaatctatgtctactatttataatcttcattgaaatataatgtacatactgtaaaaatatacacaataaacataaagatcagtaaatttttaccaatatgtacaactccataaagataaagcataattccattgcctcagaataaagtccccccccacctctttgcaaacagccatcttactccccatgtccagtcaatcactgattctatttttattatagattagttttaccttttctagagctttatattcatggtatcatagcctatataatcttgtgtctcgcttcttttgctcagcataatagaattgcaattcatctgtgttgtatgtgtaaagtagtttatttgttattcactgctaagtgctatttcctatggatgattgtaccactacttgtttatccattcactcatacgttgtttccttttggggatattatgactagcattctacgaatatttttctggaagacttttgtcttgttgtagaagatgttttttttctcttattttgagtaaaaagtgagaggaattgcaggaacacatataagcacatgcttattttttttaaagaaactgttcaactattttccttagttgagaattttatactcccaaaagcagtgatgtaccagagccccacttgtttcacatcttcagcatcacttgcaactaatcaatcttcaattttagctgttcttctggctttgtaatgacatctcattgtgcttttgctttgtttctatctgatggatatagatgtgaaacatcttttcttatgcttactggtcattggtattttttctattttgaaatgtttaagtcttttgccaatttttattgggtttatctctcattgacttgtaagaattcttatattcataggtggaaattgaacaatgagaacacatggacacaggaaggggaacatcacacaccggggcctgttgtggggtggggtgagcggggagggatagcattaggagatatacctgatgttaaatgacgagttaatgggtgcagcacaccaacacggcacatgtatacatgtgtaactaagctgtacgttgtgcacatgtaccctaaaacttaaagtacaataaatataaaaagatacatatcctatgtattttcaatattttctcccagtttatatcttactttgatttttaaaatgttgaatttcaatgaatctcagcttattaatttatttccatcttatcaaataaatatttccctacaccaacatttgtgaagactggtttttttttctgttttcttcttgctttatggttttagctttttacttttgattcataatattatttacattcatatctgtgaacttttaatgtaggcattgaggttcattatttcccatataaatattcagatactacatcactattctttagaaaagacacttctttacttactaaattacttaggctactttcttgaaaatcaactgaccatatacgtgtggatatgaatgagtacattttattctgtcccactaaatggtctcatgtctattcttatgccagtactggagtgtcttatatagtatgtctacacagtatttttttaattggagagtttaaaggagtacactatgttttcacaaacaaaacttttgatttgaaaaaaaaacagttatgtctattttagttttgcatttccaaataaagattagaatcagcttctcagttttcacaaaagctgattaggtgttgaaatgattgattaatgtaaagagaatgttcatattaacattactgcttttaaatccatgaatatggtatacctttccttttattttgttattttttaatttatataaatatttaaaagttttacatgtacagtccttggatatatttaactaaatttatccctaacagttttatgtattttaaaatttagattttgctagtatctaaatatacacttgattttctacgtcatgcaagcttgctaatttcacttataaagtttggtagatttatcaattttttaatttgggggttaaataagctattttctgtgaatgatgggggacagttggcttcttccttttcaatatttatatctatcgttttcttgatgattttgttattgcattctctaggattgttagcacaatattaaataatagatgtggagcatatagtttcaaatcttagagggatgagttcacaattttggtattgtctatattaactatagttttgcccttcgtcaaatttaggaaattctcttctattcctatttcttgagagtctttattataaatagatattaaattgtgacaaatgctctttctgcttctattgaaaggaccatcatatttttgttgctttgtcttctcattaattttgttagtgtggtgaattatattaaaacaatcttgcattcctagaataaaaacaactttatcataatatagtgtcattttaatatatttttatattgttttctaataataatataatttattgatgttttcctcttattcatgaaaaatataagtatacaattttgtttattttaatttctttgtaaagctttcatgtaagaataatcttaggctgaacatggtggttcatgcctgtaatcccaccactttgggaagccaaggcaggaggactgcttgaagcccaaagttatagactagcctgagcaacaaagtgagagagtccatctctacattaaaaaaaaaaaaaaaaaagttggttgggtatggtgggtatggtgccacacacctgtagcctcagctacatgggaggccgaggcaggaggatcacttgagcccaggaattcatggctgtagtggactatgatcagggcactgcactctagtctgggtgacagaacagatctcctctctgagaaaaaaaatatgtagtaatcttccttctgcttcaagattttttagtttgcaaaccattgggattatttaagtctttaaatatttaacatatttcgtcaatgaaaccacttagatctggagttttccttatgggaaaatatcttattataaatataatacttcataggacatagagctatctagacatctattccttcttgattcagtagtgataggttatagttttcaaggattatttttccagttattccattatcaattggcattccccttttcttaactgtcataggtttgcattgcccattatccagtttctgaaattcattgccttgtttgttctgtccagtattataattgtttatgatgagaaggctaatctcaccttatcatggatgaaggtgaaagtccaacactttcctctccgttggtattttaagggcatcttaacatttatagatctcattcagttatataaaactcatttttcagttactttataaattatcaaagagatacaagatttttaaatttgatttcttaataaaattaaaggttattttgagctagcactaaaggacatgcaaatttgatgtctttggtttcagtgttttaagatttcttacagaatagaagtcataatataatttaggcctttgctaactggaattgctacctatacatattttacttcgttttgttcttcctctaatgctacctgtagaaatgaacttaaaattttacctaaataacacacaggtctatatgtgcattatgtcttttatattataatatatgtgaaaatatcagtacaacataatacgtctaccaatcacccatccaagaaataacttgatagcgaaaaaaattaagtcaaccagaacttaatgaaatgttgtcaatactatcccagtggtacagaaaattggtgaaattaaacttgggttatgagaaagaccagagcactaaagaaggaaaatatgccaaatgtaattagtaagatagtataaaatggaagttatcattatttcaaaacccctccagcttctttctactcttgcagatgatcttttctttacaatatcctcccttggtgctgtattcattcagagcttcttcagtgtaaaatctcagagagaaccattcacagtgcagttacacagccttccagatcatgtgtgacagccaatgtaatgttcccagtgtcaatctttttacagatcctttgtatatgtaaacttaggtaagctacttaaaattccctgatatttttttcttatctgtaaaatgggaatataaatataactctctcattgccattaaaacttgtcattgacagaaaattgtattccacttctctatttaaaaaagtcagttcttcctcatgctctattctcatctaagattaaacttagcttccacaccaaaaaaagtacaattgtttaatttcctgactcaaaactacttaattaatcaactaagctttcaaataaaggtaaactttaatattgaggcaatttacttgcttctatactttttcattcattcattcattcatagcctcttatttatttatcatttatttattcagaacctctctgaaatggttaatattttctaatgcttttttgccaggaataaatgttctgacatgtcacttttattttgtcctgttttgatatcataaaatcacaagctacttaacaaagtaatttggaagtaacatcacagcacacatgctgctattctcatatcataatattttatttattatttattcccttacactttaaggaaatttatcacagaatgagcaatttattaaacttgaacaaaaatgtattaatacatttttcaccactgaagttaactgatctggaaaaaagtaaatgagaacagttcttgatttttgtaatggggagtgggtaagacaattacatgctaagccaaatgctgttaatacacaaggtattttaaaatgattgggacaatttgaaaatagatattcatctttttactaaattttaattgtaataatcagaaattgcagatttgacagattcctaaaggaatcaattttgtttctgatttgagatacacacacccacactgaaggaagggtggccatacagatggccataacgtcattaaagtacctgaaatacactcaataatttgttctctaatgtttttaatgtaattttaatttaatatttagcatttaatttgtatatttttatatgacacagtaaaaaatggattgaaataacagtattttaacatcacttatttcccaaatgggtatattttcttggtgcgctctctctctctttttttttaattggaatcattccatgtttttaaatgacaacagaaaaactggggaaaggtcaaagaaattatggatggagaaatcgtgctacttcattctaaatgtctgtataggaatttagcatatatttatacttattatatagtatttgtgcaaatcccttcaccaagaaattaatttccaaattataattgaatttactttttgttatatttttcaactaataaatattatagaactttaccacaatacaattcttagaggtctcttcaatatatcaaaataatatcagttaaagatactcttaacatgaacagtgtactatcacaatgacaaggtgtgaggtatatgcattctattattagaattttaaagtgctgaaatgatgagactatctaacttttttaagtgagaaaattgtgttccatagaagaaaagtgaattgcaactaacaggtgacagaacaatgattaactgtgactcaaggctattaactttcatttccttgtattatacattcgccaggctgccttcaccatgaattcttaaaagcagtcattaagtatgcttacaaaatgcatttggttgtaaacttgtaattttaaatgttagcatgcttatacctgcttggttaatgttatagaggtaagggcagagaacagactaaaattagacatcatgagacttagaggcaagtttaagtttgtgagactgtcatctggccatctagtccaattattatcagacttataattagattttccgacagataatagttcacgtggcttccagagtgaagagaaaaattcttaccctctgattctacaattatttgtggtatattatcataattaacccaatggaacattttcatgactttaaaaaagaatcagggcttaaatccccttggatttattttattgttatcataacagcatcaatgttctatcactttaaatctttttttctccttagaaattaatttaggagttactcagaaaagaataaggcaaaaatgccaactgtagtattcctgtaacttaccttaattttaacagatagaatataaatgtaggtttaaaaaaaatggatacccattagtgtaatgtatttgaaaagaaataattgtgttatgagacaatttaaagtgtatataagatcactttcagaaccatttcagagtgcagcaatatttttcaatgaatgacagtggaatgagatagagaaatccgatgtcccccaaaggggcaaatctacaaagagagctataaaactgagatatgtttgatcaagtatttcagaatactctctcgcagtgcagcagaaaaaaactaatgcactcagtataaaatggctcattaaaacatggaaaatctcatttataggatcgatttacttggaaataacctgatttgttttctatgtttctgcacatgttttttagttggaaaaagtataacattcagtccacttgtacatattaaattcagtctaatattaataaatcatttttttagaaatcaaagtaataatttcaggaatgtacacacagatgtaatgcttcaaaagacctgtcagaaataatagcttaaatattgcaaagtaacaaaacatagtaaataaaatgtgaatttatatatttttctgtatggagtttttctgttccacaatcagatatgactcaggctaatgattatttattgaatttagcaaaaacataagaacagaaacacacctaaaatatttttaaaactacaaacacagaagacaaggttaacagcataaaagaaaatagtggtagcagcaaaacagatagagccttaaaataaataagtatgttgattaaaaactattttgtggttaacactcttctcattgtataaaccatataaaaagtagtgtcacttactggtaaatgcatttatgaaggaatgtacttcctagaaaagaattggaatgataattttttaaattataaacacttttaagagatgtaatactatttattttaattacttttaattctaaaaatgttgaaataatcccagttagaagttaaaaacctaggccaggcatggtggctcatgcctgtaatcccagcactttgggaggccgaaacgggaggatcatccgaggtcaggagttcgagatctgcctggctaatatggtaaaccccatctctactaagaatacaaaaattagctgggtgtggtggtgcacgcttttaatcccagcaactctggaagctaaggcaggagaatcgtttgaacccaggaggcagagaatgcagtgagccaagattgtgccagtgcactccagcctgggcaacaagagcaaaactctgtctcaggagaaaaaaaaaaaaaaaagaagttaaaaacctaaacacacagtacttaagaattaatttttttgtttattttttcacctccaaagaaaggccttgacttttaattgaatttccaacatagcatgatgcatcaaaagagcatggcattagaggaaaatagcttgattttgaagccatgtttgccacatagttgccaagttaattgttccctctatgtctctatttctcttataaaaccttcctcacatggttattgtgaaaacttgcccagtgaataatacgtatatatgtattttattgtagatgcaaatagatctgggtatacctatagataagtctgtaagcaacaactagattggtaataggatggtattgttgttcttttcactaacgtctcttcctctgcttcatgatcttcgtgttggtagtttccatttactagatgtttcagtaagatccaagcaagagtctaaatattccagatagactttgcatgtagtctttacaaccactctgtgtaaaatgcattaatatccctattttacaaagaaagctactgatgattggaaagtttaggtcacacaactaacatttgtctttaattttttaatttttaatttttgtgggttaatttttccacctgcatgtcttgatttaaaaatgatattttaaattatggtacctaaaataatgctttagtagtcctaaaatcagaaaaacagtagttaaatataagaatatattgttggcagaaatatgtctcatcctccttatgaagttaccattctcagtgtactaggtaaactttatccaaaatgacattttataatttctaatttcaaaatctatttatttattttatagtttatattatatgctttgtttcatattttgtaattatgtatttatataaaatgtgaaaaataaatttgatcataacaatttacctgtagctgtaattataaagcagtataaaatttaataaaacaagatgcttctgattcttcagcattccctcagatagacatttttgaatgaaagtcatgagattgtttccaaggtacactgcttttaaaatcacaagttattaaataatacttttcagtataaaataattatggtcagattgatgagttttaagaaattatacctgctgcaattttccttctttagattgtaaggcctttgagggtaaagattttctctctgttctccatgcctcactgttttttatttgctttgttatctttgcctatttatgttgtgtttactgctgcatccctattacctcaataatgcttgatgcatgtgagctttcaaatatatttgtgtgttatcatggtgagagttctggaaaaactataaaacacagaagcatagagcaagatgcagatagaatgtgttatcatttgtaaggcggtcacgtaaagcttctgacaaagttctattaaaatagagggacagagtaaatcatgtgaatatctggggaaaaattttcccagaagagagaacaacctctaagactaaagtatttgggatgttgcaggaacagcaagaaagatagtgcggctggaataggtatgtgaaggggaagtgataagaggtaaggtcagagaagtacaaagagccaagatatatgatttgaagcttggatgagtttctgaaatctttcctgagtgagacatttagttatgaaatattcaggaatttgagtagcatattttggctcaaacattataaagaaatctctgactggtaggtacacaagcatgaagtgtacagaagaactaggaggttattacagcaatccagttgagaaatgatcatagattaggtaaaagtgggaaaaaatgatcagaatcaggttatactttgaaggaaggtctgacaatatttgctgagatattggatgtggaatataagagaataaattgggacaaggatactacactgcaaaattttttatttgagccaccagaagagtagaggtaacatttcctgagatattaacaactattggaggatatggttgggagagtgaaatcaaaagttctatttcagacatttcaagtttaagggacctgtttttccagaaatatttaaattaaattgtttaattcatatttaaatttttattgtgccaagacatctgaaattcaagggagaaaaaggggctataaatttggtatctaaaagtatgaagatggtgtttaaagctatgagacaggtttatttcacttacggaggttttagataaaacacatgtctaagcacctcaaggttagagggagggaggaggaagaaaaaactgtagagagagaatggagtagccaaatgaattggagggcaactaggagaacatggtatccactcaagactaaataaagagaatatttcaggaaaggagtatccgtatagaatatagaatgagtacaaagaaaattatgtgaaattgtgtatgattgtgggtttggaaatgtggacatattggtagcaaagatgtggtgttttgatgggatggtgggaactaaaaccttaatagagatgcaaaagagaatgagaggagaggaatcagtaattgcaatttgaggcaactctttcaaagagcattactctaaagtggatcagggaagtcaactcaggggatggctggacaagagagggtagaggtgttttcgattggccttgctttttcatggggaatattgcaacatgattgtgaactgatgggaatggtacagtgattataatgattaatctggttttgtgtaatcatcaactctatctacttaattttatttactttccttatagaaaactatcctcataaatacaatgcaaaccacttggttagaacttaggtcatcagtaattaagactatgtggatctaaaataaaaggaatcaagagacaggtagcaaagagaaaaacagacaacatcctagatattctgaacatcaaaaaagtatgacaaatgtttctttgatatgtattccatagaaaaggtcatattgaaacctattgacttgtactgtgccctaaattttaagagaattactcattgatttttttttgatgaaagacaaatcagaaacaacaattttctaagaaggcataggcagaaggcaagtaaccttacaatagaactgagaggtcacagtctaattgcatgacaagaaagcgggggaaaataacttctcataagcaacctggtataagtagtgacaaaatattgaccctagaccacaaaacatgtacgtgctgctctctgtgtgtccttgaacattcatagaagtattatgtaatgtctaatagaaaattaatctgttaaaatataatgaatatgtagtaataaaaatacttgtccttaaagaatatacttcttatgtaatatgtaaagaataataataatttagcctattgtatagtcaggatattctaaagaaagtactgaccaggtagcctttggagtcataattttaaatctataatattaaaaattacatcaattaaatttattattgctaacatttgctagctattgctaacatttgctagctccctgctcaggacttcactttcatggttgtagcaattctctaaagaagtatcatcatcctcaacaggtgttgataaggatattgaggcttacagagctgaagctactcaaaattccacagctatcagtgaaaaccggaactccaaattgaactttgtggtgtgatggaggaacccagatccatcttccctaaactttgctccctctctattagaatttttgcgtaccactagggaaggaaaagagcaagaattcaatctcctttgcccttatttttttttttttttctaaaatcaaagtgttaatacctatctccttggctgttatggaaatttgagaaactatatgtaatatgcctgacattattccagatacatactgtaagtaatattgccagataaaatacaggacattcagttaaatgtgaaaaataagctaaaccaggaatatatatatgtaatatacattgttttaaatatataagtatgatactaatactaacatatattggtatgaatataatactaatactaatatttaattataaatatttactaacactaatattatagatataaaatttataattaaatattagtataagttaaaaattagtataaatataatactaattctaacatatattagtataaatatgacccatacgtctgatgggacataattatactaaacattatttgtattttagttggaattcacatttaactgggtgttttgctttgttttcactaaatctggtaaacctaactgcaagttagggactaaagagactaggaagtagccccaaggaacaaaattttgacaaaagctgaaaagtatgtcagacataagtttagagaagttcagcaaagggcccaggagttggtaggcagaaaagaaatcaggccagcaagtgttggaaaatggggactctagggacaagctgcatttctaagatttggctgaattcctgaagattggcccttggctaggcagggctcagcatgcacgtttcaggtttccagtaagtattagtgagctgaggaaagtaaggattaacatcataagagcaaaaactaaactattaacattatgattaaaataaacttgccttctcctttaacctgaatctctaaagctataactatgtatttgcatttattttattgctttggatttttctttcattttatcttcttaaaaaaatggtaacatctggagaataaatatttcaaagaaggtagtcataaaaattttgaatcatattaatgaaccctgaaatagagaatgagaggagaataacataaaccagaaaatgtgttatttgtaaaaccttaaactaattctatttacagcactagactgcaatctcagatttcatgtgcaaattatttattactaaatttactaacaataatcttatatacttagtatacaattaattcagatatcgtaatatgagggatactacctatatttattataatgaaatcattgtggaagtcaaagaaacctaacacttacgaaaaattactgtatttctgggatgtacaaatcctaatcttgctttctccatcaactttggcgtcagatattctgttagttactcagacttacattagagtatatgtaaattaagactttttttaaatctctaccttaaattataggtgatagctgaactggttgttttttatctttcttaatttaattacattatttatcttcctttagtacaatgcagaccatttatatataaagaataaataatattagagtcagataaatgattatctactaaatataaaattaaacctttataattgtcctttgttatccttgaaatttctgcagaaaatatgcttttaactcatacgtttatttttattgtgtttcaacattttttccttcttttctggactagaaaagattttgaagtaaaggaatcgaaatgataagttcaatcacagttgtaacacagtatgcttgtaataaacttttcaatgagatttcaaaaagaataaatattattttgtaaatagcattgactttacaaaatattggtaaaccagaggtttgaacctactttagatatagacacataatcaaatatctacaaatggaaaagaataagatgatgaaaatgcaatatttagtaattttagaacgagatattattcatttaataaggaagaaaatatgagtataaaatatatgattattataaaatagtaaacctaatgatttgattacttaatacctaagcataatataaaaattcattcagcaatagagagatttcaactacatattaaattatcttgtaaattttattggtaagtagtcttatttaatagtatgattcagagcactgtttattataattttgcaacttctcttgctaaatccacagtagtctctaattttatgatattttttctggtaaaaaagttttaaacaattatcctgataggaaaaaaaaggactctcatggaatgcttcaaaccaaaagtaatgatgatagagtaattagaaaaatgtaaaaatcctattgcattatgaaggatattgaacatttatagtagctttcaatgaggacacagagaaagaggtatagaaaaaaattctggaagaactaatgctggtgtaaactgctatggaccccagtcctttaatgaccagactatactttcatatctgagggggcatttaaggaagcacctctccaatactcacacacgattagagtatatgcatattcactgtattatgctttctttgagagaatattgaagcctttttcattatgagaaactaccacattaaaatacagcccaagtaaataacaattatgccactggcaatgaaaaacaacatggaaatttttatgtaaaatatttaattcttttttttatttttctattgttctacagtagttgagttctaaatacaaacaagagataaattttcaaatgaaataaagatgtgattatacagaaaattgtaaatgcccatgctaaatccagtttaagcatggaacactccatttgtttgaaagtatactaaaatcattttattgtttccctatgtgtaacatgcaaaataaatggttagattatcatgccaataagaatagataatgtctaaaattatatatagagtaaaaatgttgataaatacttgataaactgtgtgataaagatttgataaaatacatgataaacgtagtgggacctcaaaaaaaaaaatcaaagactcatgagatccatttttttttccattgatagattgatgtctaagaaatagttggataaggatattaatagtatttttagtacttccaaactgttcagctactgataaaattgtatatcttagagttggtactaaaatattgagaatgcaaaaacatttatgtatataaacttgtttattcctgatgtaattcaggtggtcctccgtctgttcttgaaggtcagtattcacagtctttagtatacagccttcagatactttgagcttgaactaatctacactaaaaggaatctctggagattgaaagatgagacggacagaaaggaacaaaaggagtaaaaatagtcaaaaggctagatatgctttgaaatgggcttctgtatccaagtctttctgacaccaaagcccatttctttttactagaccacctagctaccttgtcactctaaatttactgttttgattattatttcttaatcctcactgggctcagtacttattattaataatatttctgtgtttaggctctaactctatgcattaggaaggtaaaactatggttatctgtgtacactatcatcttgctcaggaaatattattctaaattattatattgttttatttgaaatttataaattaaaaatgtaatactgagaacagaattccaaaaatagaattttctaagagcaaatcaatttttgtcagttcagtgttttttggtagacacagagaattcagttattcctagagcattaccattgtctgttcatgcaaaacctcccttatgtttaaaataattttattattttttcatttatcacacattctttcattccacacacacacttacactgctctcttaggcacatctacatacaacttgttatccatccatgaatatgtaggtaaggatgttttcacttttttatcagcctggtttccttaggtatcaaatgtaaattcagatagaagaagccttaaacatgcacctgcatatgtagagatcatttctaaatttaacctttctgtcaagagtctaactgcctacaaaatggagcggtctaatcctcaattttaaattcacctataattttactttttcacttctgagcaagatagtttcgattcttgggtgtttatattctactaattaaaatataacattgctgctattttcatgactgattttttaaaataaagatttcttgcgtcttaaatatcaattaggtaatgcagctctacttgtatcgtcactgtgcaataaatttcagtcaatttaacgtataactccaataagatgtagaagaaaaaggatacttcactccactacgtattttagttagagttgttatatattaatcttgagccaaacctctgttcttagaaaagttccccatcagttttatcagctggatatgtcatggtgtgtcctttgagatgaaagcaccacaccagttcttcatttaacagtatactaaagaccaaaatattttgaaagaaaatgaaagagtaacagcaagcttacctcaaacactgctaaggaagccaatgttgaaaaacttaccattcatttcaaatggaggaacttaattctccagatagccccaaaacagagctaacgaacacaatgcatccccactcccagcagcacgtcgactagtggtgtttgttttcatatttcctatcatgtttgtcatgcctttagtagatgatttggctggcacaatatcctagcctagcctcagtgtagaaatctggcaataaaataacacatccaaagataaaataagaaccaatgttaagtgatgaatccatgcaaagtactcagtgaatctcttaaaatacgcctatctgcacacacaggaaggaaatggatgtgctgggaatctgcattcttctggaacaccatatgtaatgtctattgagatattttgagtgggcataatcttcctaggagggataatatggaaaactttcacagacactttctgtgaactagaatctgctgctagaatatcacaacttgaacagaagaatatccttacctcacactgggtgtaactgaagataactaacacttgttatcagatatttatgtttaaaaactcagtaagcaaaagatagcctatctgaaacatactactttgtctacaaaataaatctcaactctgtaactgatgttaaagaattatttcaatctgtctgtcacttagtaagcatgactaagaatagtaattttaatagtaacttatgctatcaataataataaacatataaaagtttcctaggaatgtgtaaaattctactgacccctgtaaaatactaacgaaagagtggaaataggagcattttcccataagctgtgataaaataattcttagtatgataatactttttaaaaagttgacagttgaagaaatttaactaagacaatgatgtactagacatccttaaagtgagctgctgctattactgtaagtttaatcattataaaagccatgacacttctcttagaggatttgtgtacattatcattggggagtactatattatgatagtaagctacccttgtgttatgaaaatgcatggaaatttgggtgaattattagagtaaaatatacctcacaaacatttgccttaatacaatttgccttaatacatttgccttaatacaaatgataaatttgtgcaatggatctaaaaagttatacatgtaggattatatagacatatacatagtgagaaataacattttaatgcacattgcatatacaaaatttaaaatctgctcattcatcctaaatgtttagtgcataataaaaacattaaaagtatacaataagtaagttttactcagaatgccatacaaaaaaaacacatgaacattcaaatttggcaatagtgtaatgctttcacaaaagctgaaaactctcatacatgtttaaaatttaaaccacatggaagttgggtttagctatggttttatacttggatttaaatacgtttgcttatattggcttaatgttgtccatccaatccctcaagaggaccacataaaatacaaattaacatttttgcgatatagaaacatgaaagtccataacggtttttttcttccataagctaaataccaaataacattatgatatccattaaaaaatttaataatattttgagaaatacatatggatcatttactttttaaataaagtaagcatagtcattggctttcttactttttaaacttaatataatatataaagtcaaaagggataaaaactgtaagtacattactccataattgatagtttccttttttcttatgttttactttcttaacttatccagagagaaaattatatttagcatttttctgcagtatatgcccgtgttttgtagatatgaatggctctttagaagtacatttatagcaacctagatgtgattcaaaattagtctttttggttgtcagaaataaagtaaccacagtatagtcacagccttttttttgaaaagacaggatcttgctctgtctcccaggctggggtgcagtggtgcaatcatggctctcacttcagcctcaaccacccagagctcaaacaatcctctcaaagtgctgagattacaggaatgagccacctcacccgatctatagtcatagcgtttcaaattaaatatttatttatcatgtttataaaaaaccaaattggtattcaagtaaaatacatttttaatcttacaacatcatagattatgtagcatttgttcataaaagtgactaaagtattacaaattaaacatatcaacagctactaaaaggaatatatgactttctcattattttcatatggtacaggtatctggtatgcaaaaattaggtatgtatttgacatattaaaataaatcttgaaatctattttccatcagcatatataaattaatgactagaatctgtcactgtttttcaatagctggagttggaacacttaacattatttacaacaagcaatatcgcgcctgtaatcccagcactttgagaggcagaagcgggctgatcacgaggtcaggaaatcgagaccatcctgactaacacggtgaaacctcgtctctactaaaaaaataccaaaaattagccaggcgtggtggcaggcacctgtagtcccagctactcgggaggctgagacaggagaatggcgtgaactcttgaggcggagtttgcagtgagctgagatcgcgccactgcactgcagcctgggcgacagagcgagactctgtctcaaacaacaacaacaactacaaaaaaaaacaagcaacaatataccaggttgtcagtttccattaaaggaaattcaaatcaacaaatgttaagcatacaattttcactatgagtaaataatttttgcattaaaatacatcagccaggtgtagtggctcatgcctgtaatctcaacattatgggaggatcagttcggtgggccacttgaggtcaggagttcaacaccagcttggccaacatagtgagaccctgtctctactaaaaatattgtacaaaaaaaaaattgccaagtgtggtggcatgtgcctgtagtcccaggtactctggaggctgaggcaaggtaattacttgaacctgggaggcggaggttgcagtgatgagccaagatcatgccactgcactccagcctgggtgacagaataagactctgtctgaaaaataaataaataaataaaaataaataaataaataaataaataaataaatctcataataacatttctttatctttatctcaatcattattaaataaatatctgagtgtactatgccgctgatggtaactggttgttgaaaacaactatgttttaggtatattaaagtattattgtattctaaatagggagaactttatatttcctaaggaaatttattagacaaataaggttctagaaaatatgacttgattttaaaaatggcctttatcatgagagatcgcagaaaaaataaaaatcatattatgtcagaaaggtagacaaacattataattcaattataatttacctcaatcttcaaggtttttgcaatgaacttataaaaaataccagtgtgaaaaatttaaatgaattaacatgaagaactcagtgaaacattttcttcagttttgtaatattttagctctaaaattaaaaaggaaatgaaaattagataccatttacatttcctactccgctccaccaaccccccaaaaaagtaataatttcttaaggaaaatatgatcgatcatagttgttttaaagttagagattttgattgtatttatttaacataacctcctaaagacacggtgtcatgatttataattgtttctataagattatagtgttctggtcatgctgttttctttctctaatttaataactgagttttgcataatcattcaatactgtcataaagagaaccaaatatggccattaaacaattagaataatacttcatttatgatttggctattatttaggcagatttaaaaaactatataattattattataaagatgtgtttacaccattatttgtgtatctgattctaatcccttttggttttatccaacattatgaatgtaaatgatgatcataaaatatctgatattttatattaaatgttacctcacatctgtatgatttactataatcacttcacaaatatttattgagcaccaactgtgagccaggcactgggctaggtgctatggagtcagtatgaatatatcgtagagtaaaatgcaggcctaccatcactgaggttaccacttaccgctggcagataacagcaaataagcaatttaccaaaccacataatgagaactatactatgattaactacaggcttgggaaatacaacataggagaaactcagtccagtcttagaagcttatagaaacctttcttaaagaaataaaaagttttggggtaagatgaaacagtacaggcaaagaccgagaggtgatagagaaagagaaagtaaaaaggcaggtgtgaggagacatgaatctggggagttatgaagaaaccagactgtacatttgtaaaccaagcttgttttagattacgtgccaagagcaccatgtgaaaacttttttttttaatgtgaggggagaatgctatcaaatttgaattttagaaaaatcattttgtgtgcagaagagagaatggcatagaagagagtaagaaagctgacagggagaatgagaggagacacatggtcgtgttccagggcagcaatacaaatggtctacactggggagtaactttgggaatgaaaagacaagccagaggatggatttcagatgtccagagaatattatctatgagctctggtaatcaggtagatatggagagtgtgtgagaagaaaggaaaatcaatgaatgttattcagttttcttacttagcaatatccagggccatttcatgagttaagaacgtatgtcggactgaaaattaaagtaagaagaagtgttttaaaaattagaaaaagaaatgtgtcatttctaaaggcaaagaaagtaagtttaacaaaaataaaagtaaaagattggtaaagattaaaaatatgatctttatgtttaatgatttaggttattgctatcatccatctgtgctgtatctcagatcttacagaatcatatgaagagacatgtctttccatctgcctacgtgcatatgagtgtgcaaatatgctaaagaattaaaatatgtaacaaaacattgtatgccactaagaaacatgttttaaagtccttcagaaacaggtttgtgtaacctagcagtaacctttagtaacctatactgaaatctacactagtcaaactaacacattttctaagcttctaaagccctcaactcttcttttgtgatttgcaatctggcagcaaaactaactgcagtttcaacttatgaacacttcttttacactgatgcctgactgatcgtgaagattctacttcatcttcacccttctcaagtgatggcttttttattctgctattcgtgtaccatagagccatatatatgtatatatgtctactaagagctcgttatttttttcaaaacattattcctccttcttccacagaataaactctcttaaagtagattctactagattacatcagagtatactatttacattttattcttgctgcattcaactgcttaaagcctgctgaatcttactcatccattgaatatgttttagcatctagcttactttccttctatctactaaaaatcttgtaaacatttttaattatctcagtgttcatacaaataaactgtgaaatgctttggcctttttctcttaatctttctcacctgcaagaatcacaaccttgtttatgtttaaatatgtgattgctatcaaacagcttaattaatgtgtctggatataaacatgtatacacactatgtgaataaattcaagaccttaaactcaagagattctttaatgttgcctggcattaatgtctctagccaatttattccttcaacacttctaaaggatatttatacctgttctgtcttcccaaaactcaaacatttcttctctacttgcacagctacaaacttgctttttacacactcacacacaagaaaacaaaacccaaaattaatcagatcgcaaaatcaattaacttatcaaaaaccctggccaagtcctctctacctccctccagttgcaatgtcgattatgcccttgtctcccatctagacttgccagtgggattctctagagcccatccacatatgactatgcaagactttagttctaaaagtatttttcttctttttttaaaaaatcatctttgccctccatttattcatgtagttttactactgtaaaaaaaaatatgtaatctgaaaaaaagacttcacattgtttaatagctactttcccattttcatactcttcttgacagcaaaactcactaataatttacctctaccaattgcccacttttatcctctcattctatatttaaactatttcactatcccaattatctcattccaactattctcatattggtctgtatttccatgttgcgaagtcacttaattatttctgaatcatcagtatttgatgtgtgtgtagtctctctcctccttgaagcatctctttcagtggagtcatggaaacccagaaatcatcagagttttttttttttctaacctttctaggcttaccattttagtctcctttgtgatttcttctcatgtcaaaatattgtaatatactgcagctcaatccttggaccactctttcctgtgcatgtttattccatgggtgatatcagtcagttttactgccttaactaacatctacatactgatgacttccagttatatctgcagcccaggtctcttcctaaacccctgtgccttatgtacgtatctacttaagtatttaatatgcatttcaaactttatatattcttaatttacttttaacattctcctcacatacttccccacttcagttaaaaaaaaacttcattatatctcttgcttatgccaaaaaattcaaggtcaatattgatcatcattctccactgccagttaatcagtaaattctgtcaacttgacctttagaaaaataaccaaaccagaattctctttaagagtgtacattgtttataattattaggtccattacatatttagtaatttagaatagtaagaaatatagtctgggaattggatgatattaacagattattgttaaataaatgtattaagtgtgacagtgttgttttggctcagtaagaatatgactttttattttttttagaagtgcatactaaatttcttagtgtctgtactgcagaattaagcaagtgaatagaatgagttagaaactcattacaacttcctacacacttagaattttccttagcatgtatttacttaacggattgatcctgctcatctttctctctttcaccaacatgtaagctctaaaaagatgggacttttcgtttattttgtttgcaactatattcccagtacctacgacattattaggcacatattaggtagtcaatgaatactttttgaatatatgattaattatttattatgtagattcttcccaccttcccaacctcctaaatcttcccagagctcagttcttatttctcttttcttctcttttcctgtactcttcctttaaaaaatatcatctattggccggagcggtggctcacgcctgtaatcccagcactttgggaggcaggcgggtggatcacgaggtcaggagatcaagaccatccaggctaaaacggtgaaaccccggctctactaaaaatacgaaaaattagccgggcttggtggtgggcgcctgtagtcccagctactcaggagggtgagacaggagaatggcgtgaacccgggaggcggagcttgcagtgagccgagatcgcgccacggtactccagcctgagcgacagagcaagactccgtctcaaaaaacacaacaaaacaaaaacaaaacaaaacaaaaaatcatttatttctatgacattaaacatcatgtaaatgctcatgaatgtatatctctgtaaatgtctccatttacaattacaaaaaaaaaaaaacaaattttcctatttttaaaatttttccccattccacatcagcaaattctatcagcttgatctttaaaatggatctgcaagtaacttaggtctcattttcagaactacaagcctaatctgagccaccaaggtatgttttctggtttactacaatagccagtctccctggtcctactcttttctctccagtttattctcctccctatgttggagcaatcctttcaaaatataagccagatcttagcactgcctggataataactcttcagtgattttttaattttatcttgaataaaatctaaatttcttatcattatctaaatgggcccatatgacaaattgtttgacaatctctgataagataatctctctgctcactatactcaaccaacttggtctccttgatatcacttattgcaaattaatggataaatacgctctgataatttgaataacttcatgcaaattcaaccagcttttagtagcagactctggttgcaaagctggtgattccaaaccatgcagcatacagttctcacctcagagtgtaatgtgccactggaagcaagttggggacattaatgaaattacagaacataaaatatttgggctggggacagtgagggttaatatagtgtggtcctgcaaaatagaagtgggcaatagctaaatataggtgtgtatgcagtgtgtgtaatattatgactagaccccagcaagatattgtggatgaaagaatgtggagagacagatatgaatcaccatgtataagaataatgagaggcaaaaacggatacatttgtcaaaatagtgtatagagaacagaaatttgggtgagcttatgtcttgggaactcagaatctgaatggtcatttgactttttactttttacaacctttaagtagtaaggtcttacttgtttctggaataccaggtcaacataaacaagataaatatactattggcaggaatacttctcatgtttcttataaagttaccatgctcagtgtagtaagtaaacatccaaaaatactttttttaaatttctaatttcaaaatctttctatttatttatctttataatgtatattatatgctttgttccatatttcataatgatgtatttatataaaatgcaaaaaacaaatttgatcataacaatatttctgtagctgtaattgtaaagcagtataacatttaataaaacaagatgcttctgattcttcagcattccctcagatagacatttctgaatgacagtcatgagattgtttccaaggtacatgcaaatcataagttattaaataatagttttcagtataaaataattatccttgcggttttcattatggcacatccgccttggacagaagaaacaaaatcctgtgactgacttagctgcaattagcaagtcattcagaaatcacattcatcactgtcatttcagaagagtctagaaggaattgcttgtgctatatttagcatgcatgagagctgtaaagtccagcctgttcatctttctcacgtttctgtttgtttgcaaaagctagaaagctgtagccaagaagggcaggaaggaaggttggctttcaatacccttcttcagttcagctgagaactcctttctatgactcaatagccagttccaaattaccacattattaaaaaaatttggttatcctgcttatattttcttcatagatgatattactacataaattaatatctattaatcaatttatttattattaatctccaatcattaaactgatggatctcagagatcagtgacttacaggttctgtttactgttatatccattgcccacattcctggcacatgtcaggcaataaaattcaattattgactaacaaacagcttcctgaaaaaaagtcagttcagtttctttattgtggatttttaaaaaatcaacagaaaactagccctcatatgccatttctccagataagagtaatctcattttttcacaatgaagaggttatctttagtcttgaggtctatatatacagagagagagtagcagtagtgaatacatctggtgtcaagtacaattaaaattatgtcatagggagaatttaaatttattctataggaaaagcagagaaaccctgggtaaaatttatggggatatttttgagcttaatattatatttggtattaataaagacatatttctctttgagaaaaaaaataaaaatagccctggggcctggaattctagtagggcctgaatgcaggtctatttttccaactagatttagtaacgaataaagttgtcagggattggaatgaccttgtccagattgtgacacatattccattattaaaagtgaaaaaacagaagttagaatagctttgtgcagatatactaaagagaataaaacactgaatggaagattagacaacattacttcaagataacttgaaattcttttaaagggcctaatattatttttgattcaaaaaaagtattcaagtaacagaaaaaaaattttggaggaaaaaatacccagaaaattgttacctgaaataatttaagaatagaaatctttgattataaaatacttctaattgcacgctaataaagtagttccatgagaaataattgaaggctaaatgggacattgtaacactttcaaatagtagaaaatatggatgggatatttttaacttactaatgatcagtaaaataattgggaaaaaagaattgtggaaaaatatggcattttatatggtaggtagcacacatatctttattgttacctctctaatattaatatagatttgaaattattttggttaaaggttttcaccaattacttaagtatctgaaatcgattattaaaatgaaataagattattttgtgtgtatcaccattttaatcattacaaattcaatgttcaatgctcactttgaaaaattcattaagcatgatttaggctcgagtctgtatatatgtttatggtaacaaaactgacttacaatgtttatttgttgtgctgacagcttcctccataaacagtgtcattgctgtctatgcaccttaatgtggcacatttggttgtttcatcttactttccctatatacaacatcttttatgtagatatacaaataaaattaaatacacatagatatatttaaaattttagcttcactaaattcattacattacctaaaatcccctcattgcatattagacactgtgtatattaatacataaaatgatactaggttcaacaccttaaaatttttaacctaaattcactgctaggcaggagtgtaggttcataaaaggaagttaaactaaaataacatacagcttttctaaagcaggaagaatatgtaaggcaattatattctcatgattccaagttgaaatctgtgccatttggaaggaaacacaacgctaaatagagacaaaatattttgaaaattggataggatttttgtaaagatttcaaataaaatagaaaaaatattttaacttaaaagttgaaaaatgatttatttatcaaagttttctaagttatctgtcagatgatatagatatgttttgaataagtactaaagaaataaggagatgagctagtcacccacagccacagatattatcctaaaaactgtattatttgtaattctatcattgagaatgaaatttgtttatattccatttgtatctctgtatgcaactatatactctagtttttttttattatttgtttgtttgtttcgttttgttttagaaaaactgcatgagaagactgcttacttctttttttgttcagatggggagctcactatgttgcccaggcatatctagaaacctagggctcaagaaatccttctaactcagtccagcttcccaagtagctaggattataagcacacaccacaacactcagcaaaattgctttttattaggaaacagtaatatcaatttttttaatgttaatgttgaggtacttagttgaaatcattaaaacaccagatttatgtttttgacattgtaggctttgagatttgaaaattcacctacctcagccattcaagttgtgtgatattggacaatctcagcttccttatctatataatctgaataataaaattgcctctttcaaagaattatagtgaatgttaactgagtttttgcataagaagtgctcagttcagtgtctaatagatacaaaatttctaataaatgttttttaaagtatattcttcttaaatttactcatatacctctgaaacaggtctcaaacaacctcaaaatatcttagccaacatccacaccagttgtttagaagagaaaatacacctacacacacacacacacagacacacactttgatttttcatttgaaaggatacgctgtagtttcaagtgtatgcagtataattctaatcactttaaaggttctttctaatacaattagtctaatggtttacttactcaggtaaaacctttaccaaacagccttttatcagacactgactctatgcaagtctacaagagtcaaaaaaacagacatgttgtctgctattacggagccttaaagtctaatggaggtgattagtcaaatgttgggacctccagtgaatagtgatataaagtcaataactttgaattcaagaacaattatttgatatgctgaaactacccattaaagaaaaacatcacaattaaatttttgtataattttcttggagtattatttcccaagtcttttctaatatttaagtatgcatttaaaatcaagctattttaagatttgtatatgctactacaaaactaagtttccaggacattttctggcagttcctagactcatccctgaaactgtgggcttgctgccatcaattttatggcacagactaaagcaaacagacgtgaataagagcaaaaccgatagaatttggaagactcaaaaaagaagccaatttgtttcaagtttgagattattttcttatctataattaatgcaaagtctgcccccttattaaaataagtgttctagtgccattatttgaaagtacatttgagctttctacagatcattaggctgtcactcctctgggattcgtatgatcgcattcaaatgataacagttgctttgttgtctctggaagatgaaaatgggtacaaacataatgcatcttcacatttggaaattagggaagacatctggatgcacttgcccagctaatgaataaagggaaaaagggaagaataaaggaaggaaggaaggaagaaaggagagactggagggagggagggaggaaggaaggaaggaaggaagggggggagggagggaggaaggagggaggaaggaaggaaggaaggaagggaaggagggaaggaaggaagggagggaagaaagaaggagggaaggagggaaggaaggaagggagggaagaacgaaggagggaaggaaggaagggagggaagaaggaaggagggaaggagggaaggaaggaagggagggaaagaaggaaggaagggaaagaaaaagtttctgattttctttaatatgatttagtattcagcccaattcattttctgaagttggaggaggctaaacattgcctcgtatctcctctttaacttgccagctaattatgcaaacctttatatccaaacaatgcagaggaaagaagacagaataatcttccagaccatgaaagctttgttcatccatcataccaacagtgtactaaagatcttagagatcttttgtgtggtaactctttgccctttcagctgatgaataactgaagatgtgcaatacaaagaaattactaaaagagaactgtgcactggaaaccaatttgttttcatgactctatccaacgactttagtgaagtatttaggagagtgggttaagtacacaagcctcttttaaatacttattaagattaaaatgttcacataatatataaaagtatgctttaagtgggcacttgattcccagttagaaatttaggattaaaaaaacacactacatctcagcaacggtgaaaatacgtgaagattttgatttggattaaaaagaaaaaatatttctttgtgcttaaggcattttatactccattttatttcttgaacagaacagagcttaacaatactgactgacaatatgaacaaggctcttcattaggatctagtaataaaacaaatgattagagtaaaggaagacttctgataccagaaatcattcaagaagtctcaccttatatgcaggattcagttttacatttttgtgtgtgtttttatttccccttcaaaccaaatgtttctttcttacttatgaggcatccactttgataacagatgtcaagctatattatatcataattggtctttgcttattgctagtgatgaaacctcatccaatatttttgcatgcctccatttactacagctgttaatttttcttaaagtttgaaaattatgtgcagctagtatgtcttcttcctagtatttttttaaatgaagtgtaatttgttcccctttattagtgctggatgaaaataagtcttcttttttatttcctagaaagtttagcacattgaaatgttttgcctttgatcaaatttgtgtaaaggatcatacagattatatatttcctgtggggttcttctcttctcctcttctcctctcctctccctttctcttcccttcttttttctcataaaaacctatatccaaattctctgtgaagctgaggatgtattccaatccacaagtcaggaatgatgaaacagtaaaagtttaataagctacttggccatggactcttatagcacagtatatttagatacaagaaatcatccttagttaatttatgaatttttgcaaatttctaaggtatgctattataatcctgtccctctaggtaccttgattcctgcccaaaaatagcaaaccttattatttaactaagaaaaaaactgaacaaactataatgaatctagggaattgttcttcggtaattatttttctcatttctaccgttagcaatagaaatgtctggagatgggaggaagcaactaataaaagtgaactagattgagatatttgcattaaatataatctaaattgcaaataatcctcttacattctctatgcacagctgcattattatacagttcacattgctttggtaactaattttttctgcctttattacatcttccagaaaacaaaaagaatacagttataaagaccttcctaacaaactatagtaagtcaagatggagaatataagtgggccttggaaaatctgagttagattttagtttgtgaacaggcttaagagaaagtcgtctatataatgactcctcatcagcagatgaaggacattgaagtcaaacgttttgctatgtcacgacacttgaagaatcagtgtgagttttcaatgtgagttttagaagattaatatttacaagacatttttctttaacttaacacatgagaaaatgtgagtttcttttttaataaagtgaaaagttttattttagaactgatactgaattgatccaagatacatccaaagttccgaaagctattcacttaattcttactgcaaaaaccatttttttcagtgtatattttcctaggtttatgataggcactggacatgaaaaaatagataagactgattttctctgaagctcaaaatataattttcaatttatataatttggcattgttacagtatttcatttgtatgttataatataaaataaaattttatataaatgatatttgttcagttattttgggtatttctaatattcaatttgcagaatacagagatgcaaacacacagacacacacacacatgcacacacacatgtttgtctgctctataggctgaaagcttgtgtgcttccaaattcatatgttgaaatactaactcccaatgtgatggtattaggtattaggaggttgggccttgggaaagtgattaggtgatgagcgtagagccctcatgagtgagattagtgctcttatatcagagacctcaaatagctcccttctcccttctactatgtgaggacacagcaaaaagactgctgtctatgaaccaagaagtaagccctctcatcagacaccaaagttgccaatgccttgattttgaatttcccagcttccagaatatgaaacatcaatttctgttgtctgtaagctatccaatgtatgatattctgttatataatcccaagcagactatgacagcttgtgtatatgtgtgagtatgcaaagaaaaaatacttacatttttcttttatctttaaagattcatcttagaagcttgtagaaaaccatgaaagaaaaggttttataaaactaacaaattacctaggacattgccttgtggattaaaatggagccagtgtgattaaattactagtaatgcattcacggattaatattaaattgctgtaataaaattcagtggatattaaactcattttatttgggtatatagttaagaataaatactataattaatttatttaatttaagaaatctgtgtatttttttttttttatttgagatggagtgtcgctccatcgcccaggctggagtgcagtggcgcaatcttggctcactgcaacctctgcctcccgggttcaagcaattctcctgcctcagccttccgaggagctgggactacaggtgcacaccaccacgccccgctatttttttgtatttttagtagagacggggtttcaccatataggtaaggctggtctcaaactccttatcccaggtgatccaccgccttggcctcccaaagtgctgggattacaggcatgaacatggtaaaaaatggtttgcacgtgagacactgaaaagttgtcccagggtgtctgattgccacaacaaatagttactggaagcagaatttcacattacttggtttggaatactgtttttcttaaaaatacggaaattgtcatttgtgaactattttccatgtggtagtagtttttaaatgtgaacatttactgtgaaggacgaagaggtaaccacacatcagttgtgatgtttcttacttattttactcatatttcttgcctgcacactatgagtcaggcacaatttcaggctgtgaacaaagcaatcaaatgatagtttgaatgagacttaccctctcatgagaaaaaaggaaaaaggacagctaaagtacatagaaaaatatgaggtgataaacactgactacttcagtttggttcccaaggaagatctgtctgaagagatggtaggaggagaataggacaaggagctatgctttggggaaatataggcattgtatatcctatgaattggtatagtgcattatgtgtattttataatattatagctgtattgaaatttgtaaattgagtaacattgttagtgtagctgggagaacattacattaaaaagcttaagacctaaagccataaaattactagaagaaaacatatggaaaacactttagaacattgatgtaggcaaagatgttatggctaagactgtaaaagcacaggtaacaaaaccaaatttagacaaatggaactgtattaaactaaaaaaatcttcttcacagcaaaagaaacaattaacagagaaaagggacaacctccagaatgagaaaaagtatttgcaaatcaataaaagacattgtttataggaaaagtaagatgaaacaaccaaatgtacaactttaagttgcccagacagcaatgatagcagtttttggaggaagatatcagcacaacaaacattttaaatcagtttttattgcaatacacatacatacagaattgaacccatatcatgtttaatgaatttttcaaagtgagcatctaagaacactgaatttgtaaccattaaaatggtgatacatacaaattaatctattttatcttagtaatcgatttgagattcttagttaattggtgaaaacctttgaccaaaataatttcaaatctatattaatattagagaggtaacaataaagatatgtttgctaccttccacttataatggcatcttgtttttcaataattcttttctcccaattattttactaatcattactaagtaaaaatatcccattcatgttttctagtatttgagttttatgatgtcgcaattcagccctcaagtatttctcatggaagcactttattttattagcatataatcagaagtattttataatcaaagattttttattcttaaattgtttcggttaactcttttccgggtaatttttcctaaaagaaaattttccgttacttagattttttttatcaaaagtaatattatgccctttaaatgaatttgaagtttccttgaagtaatattgtctaatctcctattcagtacaaagctattctaacttttgttattttttcacttttaatcatggaatgtgtgtcacattctaggcaaggtcattccaataaaaaaatgcatgttaagtaagaactggtggatctaattgaaacgcagagattctatcagtaaaatcaagagtaactacaaatttccagctgcgtacttaccatctccatttggatgtaaaatttaacacgtgaacttaacatgtgaactctttattttattttattttattttattttattttattttattttttgagatggagcctcgctccgtcacccagggtggagtcagtggcaagatctcagttcactgcaacctctgtctcccaggttcaagccattctcctgcctcagcctcccgagtagctgggatcacaggcatgatcatatcgggtaatttttgtattttcagtagagacggggtttcaccacgttggccactctggtcttgcactcctgacctcaagtgatccgcctgccttggcctcccaaagtgatgggattacaagcgtgagccatcatgcccagctgtgaactcttgatattgcattccaaacgtgctcttcttgcagtctttcctatctcagcaatgtcaactacattcattcttccagtttctcaggccagaatctttggaatcaaccttgcctgctcctttcctctttatatctaatctatctgccaagtaatggctctacctacaaaatacatgtaagatctgactaattatttcaatttctgccactacgtctctagttcaagcaaccaacacttctcacctaaattattttagtagcctcctaattggtcaccttgaaccatctgtagttattcccagcactacagacagatgatcttttaaacaatgtaaatgagatcttattctttccttcccgcccgccccccaagatggagtcttgctctgtcacccagtctgcagtgccatggtgtgatctcggctcattgcaacctccacctcccgggttcaagccattctcctgcctcagcctcccgagtagctgggattacaggtgcccgccatcactcccagctaatttttgtatttttattaaagacggggtttcaccatgttggccaggctggtgttgaacttctgacctcgtgacctgcccacctcggcctcccaaagtgctggattacaggcgtgagccaccgtgcctggccagtcttgttctttctttgtgcaaaccctccaattcttccctctcttactctgagtaggcacaaaatgctttcaaagacatacatggcactaaataatgtgaacttactgtcccctctccaacctcacctcctacactcattcccttgctccctccactctagtcacactgtcccctttgctttccttggaaaactctaagcacgtgtttttctcatgatctttgttttccatcccttctactgaaatactatttccccaaacaactatttggctcatcccttctctcctcaagtcttcacttcattttctattaaatattacaaagctcccttacccagagttagagaaagtcaagtttaatcttccagtcttcgaaattggtccaagatttctcacaccagtcgtaagtttagggtccttatggctaccctcacttcagactagctgtttacaaatatggagtccctgtggactctgtcagattttataactcagaagagctattcatagaactcagaaaagccctgtaattacaatgacagttttcttatagcaaaaagttacaaattagaaccagctgaggaatgagacacatagagcatcttggacttagaatgttccaaatgcaaaacttctctgtcctcagagatctattatcttcaggacatctattgtgccggtgtacttatggagtattgccaatctaagaagctcacctgtatctctagtttttattgggattttattactatatttaggcatgatcgattgaatcattgttcgcatggttaaaatcaatcttcagctccttcccctccatggaggtcagtatgatatcacatggctaaaagtctcaactctctaatcacatggacagtctttctggcagggagagacaaaggacaatcacatgttttattatggactccctcaccatccccccctcacacacacactgatacttactcacccgccatttctatttatccccagtcctcattttattatcactagcacctagtatcatctaacatattacatcatttctttattgatcttatttattgtctttctcatcaaataaaaatggcaagataaaggaatttctattttgtatttgttgaatctcttaccactcaaataatacctgatctagtacacactttataaatatggttgaatgaaggaatgaatctgttttctaaatttaggtcttcttatagcccttctattccttattttacaatagaatatcatttaagtgacatggaatggaatctataaatattttaacattttaaaatttattcaatatattttcctcaaacctcttatgacagtgaaagatttcatctagacttttaatatgtaactattaactatagcttcattttactagattttaaagctaattaaaatatattctctcaaaaattactatagcttacttagaaataactgtctctgaattcctaaggataattttaattctcgttttaggcttaggtaggcagcactaggattctataattccaagaatactttatttttgaagctagatgcataatttttcttcatatcagggcatcctgaatcaattgatgtctttttctttaatctgttcataaaatgagttatcaactatgtgctgaaatatcaatgacaagcaagtaattttctgtaacacagatgtaaaaaaaaagatactctgcttttttttgttgttaagttagctgtgtcttaaaacctttcaaacctacatatgaagaaaattctaatgggtgatctgtagagcattttggtataccacaaagtagaaaaagaacctgatactaagaatagaacacatacaacttcatggaaagttttagttattactattttgaagtatttattttgtgacgagaacaaaaaattctttgagaaatagcaaagtcaagatgtttaaatttatgttataattttgaaataaaaaatatgtagtgttttggaattgtgcatggtggaaatatgttgtatttcacaaagcttttaattgatacagacagaattgtctctcttgttattttgtaagtctttggagatttcttcaaattatagaataaaatactgcatcacttcaatagctatttcaatcttttgaaatagctgcatctataggcaaaggaatcttattatctctaaattacaatttggtatgtcatgagttatttcataggacaaagtttgttaaatgaacactcactggcagtgtcattagtgctttgctcttgaactcaactacgagtcagctctgtttacgttgccattcacagaagacagaaatgaatgcgcagttaaaatggtgccataagtaaagtagagcagaattagaagaaaactggacaatttaggaacataagaattgctgtactgaatcagaccatcggttctcctggtttaatatccagcctccagcagctgtacttgttagtttctacagctttaaaagaaagaaaaaagactacataatttacctagacaattgtgccatctgtgatctggagaaattttctccttgacctctctcaaataataccctaaagcaggaggtttcaatcttgctatgatattggtttagcttgaatagctctgattattaataattcttattaaattatccaattcctccataaaataaactagtacatcaagaaactgtttgtctctaaagctcctgaattcatggttgaacatgtctgcatctatgataaaatatgaatttatggtgcatattcaatataagttcttgatggcaaaaatctgcctcttgataaccatactggatgaatgtttacttcttccaaattctactggacttagagactttggccaaacaaaacaaaacaaaacaaaacaaacttagatcggctcatactactccaaaatttctatctattaataatatacagaaggtatctgaatgatgaaggattttttgtgttgaacttttagaaaatttcaaccagagtttttcttaatatgatttagcataaggtagaataagagcaaggaatgaattacttatctttgtcactttaatcttttgtttatgttagaaaaggctgaaaaactttatagtttcttgattattctaaataccaccttcagatcaatatttctaaaatattatgctcacactagccatttagtcaaaagttcctcaagagtagtaaatgcctacaagttcgatttcaaacaattttccagggctgttagaccttaatgtgacaacactgatatcctaagtccatatattcaattgtatctccttctatcctagaattcaacaaaactagttttttcgtcattatttgaactaagaagtagattaatcattaatgtctatgttaattctatccctttttctagctttcccgactttcctttctagctcaggtccttatttcctctctttcagccagattcccattccatcaggtaatttcctttcaagcatgtaatgactgctccttcttctgaacaatttgtggccctttttttagactcggtttatgctatcttatgttgtagttctttgtttccctgggttttcttgcttataaattccctgaggaaaactttgtgtttcatatttatatttctagaggctagatctgtgtctaactcatactaataacataaagatatattataaggaaatctacagatgtagtgactgtgtagagccacttttaaaaatctctgagttcctgtttgtgtgaccttggcattaatatattattgagtgctataaaggtataaatgagctcaacactgtagatattgaaaagatagagtcgacagttattcattttcaaataacaactataagcatgggaaatatcataaaaagataatatgaaagttttgaatgagtttagacacataaaattggaaaataaaagaattccaagcaaaagtaacagctagagcaaagagaagaaatgaaaaaaggagggatttactggggaactctatctaattccctaactcctattggctgggtgtataaaaagaatatctgaaaataaatttggaaatgtgggtggtaccatgttcattaaccttaatatgaaaccacttaagaattattgaaagatttttaattagtaaacagatctatgagatgttagctaaacttaaaagtgggactgaaagaagtttcctggagtaatgagattattacataataagatttgtaattaaacttggtcttaaactcaagcagtattaataagagtatatagaatgaaatagatgcaaaagatgagtaagtgatatgattccttattgtgaaatttttgggcctaggataagggaagataatgaaacaaaagtaacaccaccctttgagcacgtttaagtgtgaatgaagatatattttattgaaataaaaaatttcttcttccaatatgttaagcagaaatgcatataaaaaattcaactttaaatttcaattcttacaattttaaataacatagtggttctcagtgctcaaaccactaagcccagttcacatacgtttcatatcatcaatatatatccacattttttctgtcttaaattctttaaagctcttgtgaacagtgttagaaaacaatattctttttaatctaacaatgatttcaattttactataatgtctctattttattatttaggaatccaaatgagactcagaacaatagcacaagctggcctgtcttcaaaagcactgaacaaaaatatctaaccttgaatacagagtcaacaagaataatgacgaaactacgtgctcaacaatgtcgattctggacatcattttttccaaaagtcttggaaatgacaggtgtgtctgtttttagtgtttggttatttaatagatgatgggttatgtaaaaaagggatgaagtatactctccaaggcacggtgatggagttactatatgtatctctgactttaaaataacttggtttaatgaacacattatttttaagactttcttctatcaagtttagatatgttttgaactcttactatatgaccagtactttagtagttaaataaagaaaactaaaatatagatttcaccctgtggaaatataaaatagaaaaaggaaactaaaatagagccctacttgttattcagataatctttgtggaattaattaatggacaaagaaataaatatatcaaataatcataatgtatggaactaaaaaataagatgcataaattggtaaaaacagatttattgataaataatagaaccttgatttaaatggagaaaaaaactccgaagtttacatatttaaaaacacaataaaaaatttctaaatattctgaacttggaaatatttatctaagagcacacacgcacattacataatatgatatgatataatattacatattataaacaaatagttatttagttaactagtcttaaggaagtgattggtgagaaatgggtaaggaaatacgatgaaaatttgttcagattattatctcaatattcattattaagaaaatatttcaatccacttgagtgatcaaacatgtgtcaccttagtttgatcttctctgacaaatatgacatatatccaactcactgtctagattttaaaatttcagctgtttataatccatgtggttccttaagtatactttctgaaagtaattgattttcagccatcagacatattgctggtcaggtccttcagagtttgctattctgctcatcatgacgatctgtaattttcaggctgtatatttggtatcataatacagtagatgttttccatttcttgtttagataagttgtgggctagtttcagcaaatatgggcatctcagagctgtatttgattgcttaatatgccttttgattatcagacattactcacaaaaattataattatgtactccatctgcttgggaaatgtttctgatataccagtgctctgtgtattaccaaatgttctgtgacataatatataaccagggatgggattctgcttctcttggcagagcaacagtgccatccttttgtcctccgggtgtaaataacgatgaggtaactcattaatatgccaagagacccaaagagatactatcatttatcatatcacatactatatattattaatctttatttaaaatatttttatatgagagggttataatttgagatataatgagtgggttattttaagtgacttatttattataagccaagctgagcccttctggttaaatcatgtgtgatctattgcaatttatgcgatgatacaataaaatttgaatatcagcattttaaaaaactatccttcacaaatttctatttccaaatacttacctgccagaaagcagattaaataaacaaactccaaagtttttgccagctgctgctatttcccatacaatgttgaacaaattcctagcttgtgtaacgctgagctctatggaaatacctacctagctgtggtctaggaccatgcttaaggttaggttcagtgtgtcttgaaaatataattttgtattataccattttttctaattaattcccccataataaggttttcatattagatatattttataattttgaagtaaatgcacgatacaattattgtaacatgtattcactagtaataaaaatgttacatttgaacaaaatcagtttgaagttacaaggatttaggttttataaataaatagtgtggacagattaaaaagattaagggcccatgttcttgccatatcttatatttttcaagtcacaaaacttcaaatattttaatctttaatgttttgagaatgcgttagtcagatgacctgggctaaagtttttggaattttttttaaagcaactttatacctaaagaaaaatttcaaagaataactactagctggctttcttaaaaggaaaaatgtttaccttactcaagatggaagcccaataagctttgtaagtaccacctcagcaatagtttacgtttgagcaataaatgttctcaaataaaatgattcttgaaacttgtttaaacacacaaattctaacacttaactttcagaccatacttcagcacatggctatgctgttattgcatgcacctgcaagaaataaaattcacaatatttatttcaaatgttatcaaattcagatttccacaaggatacaactattcaatattacaatatcataactatttgaaaaaagaaaaagaagtagaaaaatgacccactgtcaaggataataatattttttcactaaaagtggaagagtaaatttatttaaagaacagaagtccttcatattatcctaatgaagaaaaaaagttagatccaataattcctccattgacctttgaataaatcatgcttgccaacactaaaaagcacgtgtaaatttaagggccaaaataccctttgaactggttactttgaaaatcatttactactatttgctaatcagttagcaagactggcagtcaaggatgagggagtgcaaaggtgatttggagaaaatgttgaaactagtttattgtcttaatatgcctgaattatcaattcctcattaaaagcaaaacaaaacaaataaacaagtggcttcgaataacttaataatcaagttaaattaactgttccactttaaactacatgaagtcttcacaaagcctagcctaagtttatactagttcactctatgttcttaccccatgctcaaaattacgacagaacaattaatgattgagatttattgcataaagaaatatgcattccatgataagtttaataactgatcaaaaacagaaaaataataatgtgatggagacagattttcagtgaacactcaaatacatgaagaatgttgttgtttcttaattatgatggcagacttaattaaatatcagtataatctctcctatcttcacctccactagcaattgtgggttaattcacctttgcattctcttctgctagggtctgaatgtttgtgtccccctaaaattcatatgttgacatcctaaccactaaggtgctggtattagaaggtgaatcgttgcgggaggtgatgagttcatggagaaaaagcctgtttaaaagggattaatgctttaaaaaaaaaatcctgagggaactcccccattcttccatgtgagaacatagcaatgagactgccatctatgaaccagaaagcaggtcctcatcagacaacagtctacgttgcttgatcttagatggaagtataatctgctggaaagcctcctcaattgtgaaaaataaattgctgttgtatataagctatccagtgtatgatgttttgttatggcagtctgaatggactaaaatattttctaattccttagactttgttaaatagacttagctctggtgaaaatttactcagtgtcctttttggctagacaaaaaacaacaaccacacacaaaaaacttatcattattattttcatagaagagaaaacgattttttttccaaatgtgacaatacatgcaaaacaaagatcacaaagaagtgaactcaaaaagttatgccaatgtgtttataaatttaccgtttcacaaattgccttccacgactattcccttctctttaccctgtgaggcattaaacaaaaaattgattcccatcttttctatctccccaaaacccacacacaaagcaagttgtctctgttttacaatcacaacaagacttggtgacatttgaaataatcttaaagtactaaaatcattcatattactgagttggttaaaaaggatattattattgatttaaaattgggcatagaaagctgaagaataaaaatataacaaattaataggtcataggtatcaaggtgaatatatatatgtgatatattcatgtttatgtagagagcctctaacctcttattagatttatgtcctattaatatgctttgaaaatttatactaaaattgctagcctaggtataaagtactatcatttttccaaggaatactcaggtcaacaatatgagttgttacatttacttatgcatattgtatcatacaaattcacattttctgtgtgtgtttatcattcatccattaggcaattatttttagaaaataaaaactttattatttattatttttcataccacataaaaatttataatctgccagattttaactgttttatgtatattgagccatttggtcttttgcagaattttctttatttttttattttactttaagtgctgcgatacatgtgtagaacgtgcaggtttgttacataggtatacgtgtgtcatggcggcttgttgagcctatcaacacgtcatctaggttttaagccccgcatgcactagctatatgtcctaatgctctccctcccctcaccctccacccccgactggccccagtgtgtactgttcccctccctgtgtccatgtgttctcattgttcagctcccacttatgagtgagaacatgcagtattcggttttctgttcctgtgttagttgtgttagtttgctgatgatggtggcttccatcttcatccatgtccctgcaaaggacattatctcatacttttttatgacttcatagtattccatggtatatatgtgccacattttctttatccagtctatcactgataggcttttgggttggtttcatgtctttgctgttgtaaatagtgctgcaataaacatacatgtgcatgggctttatttatttatttttttgaggtgaagtttcactcttgttgcctaggctggagtgcaatgacgtgatcttggctcaccacaacctccatttcctgggttcaagcgatgttcctgcctcagcctcctgagtagctgggattagctgggattacaagcatatgccaccacgcctggctaattttgtatttttagtatagacagggtttctccatgttggtcaggctgatctcgaacccctgacctcaggtgatccacctacctcggcctcccaaagtgcagggattaaatgtgtgagccactgcacctagttgtgcatgggtttttatagttgcataatttatattcctttgggtatacacccagtaatgggattgctgggtcaaatgatatttctggttccagatccttgaggcattgccacactgtcttccacaatggttgaactaatttatattcccaccaatagcgtaaaaggattcctatttctccacagcctcaccagcatctattgtttcttgactttataataattgcctttctgactggtgtgagatggtatctcattgtggttttgatttttatttctccaatgatcagtgatgttgagctttttttcatacatttgttggccacataaatgtcttcttttgagaagtgtctgttcgtattatgtgcccactttttgatggggttgtttgcttttctcttataaatttgtttaaattccttgtagattctggatattagaactttgtcagatggatagattgcagaaatgttctctcattctgtaggttgcctgttcactctgatgatagtttattttgctgtgcaaaagctctttagtttaattataccctatttgtcaattttggctttggctgcaattgcttttgacattttcgtcatgaagtctttgtccatgccttgttcctgaatggtactgcttagattttcttctagaattgttattttttgaggttttaccatcaagtctttaatccatcttgagttaatctttgtataaagtgtaaggaaggagtccagtttcagttttctgcatatggctaaccagttttcccagcaccatttattagatagggaatcttttccccattcttgatttttcaggtttgtcaaagaacaaatggttgtcgatgtatgatgttatttctgagatttctgttttgtgtcattggtctatatgtctcttttggtagtaataccatgctgttttggttactatagccttgtagtatagtttgaagtcaggtagcatgatacctacagctttcttctttttgcttaagattgtttttgctatgcaggctcttttttggttacatattaaatttaaagtagatttttctaattctgtgaagaaagtcaatagtagtttatgggaatagcattgaatctataaattaatttgggcagtatggccattttcacaatattgattcttcctatccatgaggatgaaatgtttttccatttgtttatgtactcttagttcattgagcaatggtttgtagttctccttgaagaggtctttaacatcctttgttagctgtgttcctacatagtttattctctttgtagcaattgtgaatggagttcattcatgatttggctctctgcttgtctattattggtgtataggaatgcttgtgatttctgcacattgattttgtacactgagactgctgaatttgcttatcagcttcaggaggttttgggctaagacgatggggtttcctaaacatagaatcatgttgtctacgaacaaagacaacttgacttcctttctttttatttgaataccctttctttctcttgtctgattgccctggccagaactcccaatactatgttgaataggagtgagagacggcatccttgtcttgtgccggttttcaaagggaatgcttccagcttttgcccatttaatatgatattggctatgggtttgtcataaatagctcttattattttgagatatgttccatcaatacctagtttattgagaatttttaacatgaggtgatgttgaatttcattgaaggccatttcccttgcagaattttcaaacagtttcttttcctacagagtggaaaatgtacttgcatccgtagtacgagattaatatgttgtcaaaattacaatcagtatgagtaatgctggtataatcccctctccaaaacaccacttaacatttttgttaaagccaacataagtattttgtgggtggggagggtgactggtttgcaaaatgtttattaatgaaaattaatgtgaaatattcctaatagcaattacccacaaaaatataaaaaatggaaagagaaaaaaaattataaatagacatttgtggtggttttaaatgggttatctttcctaggtagttgacagttaactagtttctgaatgttttctggacatcttatcagatgtataacaagatacctaatagaaatataatttatcttttaaaaagtcttttttgtcaactaatttgataacatttacagagcctatatgctgctactgtgagccaggaactgcactagcagctagagctgcacagatgaaaatgacagggtctgcttactcacagtgaagtggagtcagggcccaggaccatggaaagcttttaagaagagaagatacctgcactgaatctcaatgtgaaggcaaagtggagagaagccagataagcaggaaccagagatgaagtgtcttgtgcatcatgctaaagaatttaaattatattctgagtaaagccatttagtaattttaaatgagaaactgatatgttctggttattgattcataaatgtataatcttttactatattcacgagttattcttttttacctttgtcttcttagagtctagattgtaagaatattatatggcatcaacataataatttcatttctgaggtagggtctttcttccaaatagctgcttttgtttgctggttcattcgcatcaggaatatattcacttctcttatatttattttattttatttatgctttaaaaattattgtaaactggctttttcttgttttagtgtaaaagtatttactagtaaatttgcctctgaatgcaaatttggaaatatcatctatgtttgcataaacagttgactctggaaaaacaatctgggggttaggggcaccaacccctgcacagttgaaaatctgcctgtaactcttgaatcccccaaaatttaactactgattaagttgactaattaagcctacttgactggaccttaccaataatgtaaacatttgattaacatattttatgaataatatttttattatatgctatattattataataaagtaagctagtgtaaagaaaatgaaaatcataagagagaaaatatatttactacttattgagtggaagttgatcatcacaaaggttttcatacttgtcatcttcacattgagtaggctgaggagtaggaggaggggaaaaggagctgttggtctcgctgtctctggattgacagaggtggaagaaaatccacatgtaagtggacttgtgcagttcagactcatgttgttcaaggtcaactgtgtgtatattttttaccttttcttttaaacatttgtacttgcaaatttgctttgcccctgcacacagagatttgctttggagaaacttgtttttaatatctctatacatatgtgtacgttataaatattcacaaactatcttaagtattagataatctttttagttgatatgtctatttgatcattcgaaatcttgacataaatttttattttgtaaacatagattatacagttccctattttacatatttatatatttattaaatacaaatttaataagctttattggggtgataactaatgtaacacattatttttaacacattatttttctttggcaaaaagtaaattatctgtctctaaggttacatatgttttaaatcaactgtattcttactacatagttatatgaataaggtcctcaatgtccttatttatttctgctctatttttatttaagaaataataaagttgcatgaaattctacaagaatgaagatatttctctgaaaaatagttacgagaattgtaagctttattaatattgaggatttaaaatcctattaatatatacttatttactcatttattttttggccttgatttttaccatgcctgctatacatttgccaactctatttttttcttttatttacatttctgctatatatttgcccttgtccttttatcttcacttctctatattaccgtattttacatgtattatttaaatgccatcagctgaggtcaatggataaatactatgtgacctattgttgatattatgaattaagacactttttatacatattattatatagtatgatcattgtagtatgaataaagaggactttatatttactctctacataagaatctggaaaggtcaatcgattcatttttctttataaaatataattaaaaccataatatattatggtagtctttccattatgttcacagtgtccaaaacacaaaatgttaccactataaagaagaaaaaataataataaaactctttctacaagttagggttctttatttctaaaattaatttttatcttgtttaaagaaaacgtcacatcaatatttgacctgtgaatttagtatcaagcctccactttctttttctcttttctacacatttccttttcttctctcattcagaatttgattattttttccctttctcataaaaaatatttacacttagagaatgacaatcaacattgctattatcattatatttgtggactttcagacaccatgaggcatgaaaagaaacattggtggcagcattattctttctttgtatctctgaattcatacaaaatatatattgatccccttcacaataagtacattgagttagaagcctgcattttggttgaggttacaattctaagaaacttacattgtttgagcattatgactgttctacaatataattatgttttaattaatcaattgtaaagcaaatacattgcctaccataaaggtctttatcctctcaaattttaaataagttaaaatttgctaatcaagtttaatccttgtttataatgtgccagccctaaattttttattatgatgttccagccacttaagttacatggtttttaatcatgaatattgctgatgttgataataatgtgaaaattgacttgtgactagattttgtcttcttagtaataaacaagccaatatgaaataagaagacaaagaaagagaggcggactaagaaaagaaggagaggaaagaggaaaacgtttaattttgattttgatttacttcaaactcaatattttatttactcattacggtgtattcactttctctggatttcattaggaaataattaaatgtttcatattttattgtctcaatcaatgccccctatttctaaagcagatttagatttatagagcatttgtgaactaaaaagcatttcaaaatactaaattgtatagacatttgataagacacataggaaaaaatgtaaatttatgtaaatcagtgattttggtattattccatgaataaaaaaggaaaatcagatctaggactctttctataaggattaaaattcatggtctaaattttaaattaccaaaaatttatttatcaagaaaaattttttctggaatttagagtttttattttatataagtaagatttaaaacaacattttgttattttttaaaagaccataaaaatggataatttggtatgatatttaacatctttcttccacatctaatcttttttgaccctttatagaagttctattattcaccaaaaaattgtgattatagtgactgatctttttaaaagccatttttacatgaaagtgaaacactttatgtaaactttcaaatatttttccaatgtccaagcattgtgaacatttcaaacctaaatatatcctaaattacaagggatattgtaatgtctgcaaaaaggtttaaatatttttatttttgtactagcttaaaattagtcactaaattttctcctccaaagtaatatcttacaaagtttaattaatttcaaagatttctaactgaaaagtatatattaaaagagttgccagcccctattttcagtatacatgaaattacttaaaattttttgttagtttaatgactgtagcttagcattctaaaagtttaaaaagaaaaccacagttatatatattgcttattatgcctttataccaggaacaaaaatatgtgtcttaaaacattgtaatttaatagtttttactgttcacaatctgtattttttaacaatacacttccaaataaatcagaatttcaaagttcttgaagtatatagaccattagtggttcactgcctcacgctattcctacctacacacccctttctcctaacacatgcatatactttgcaaactacttgaaagcaggaattatctgaatcatctttctattttacaacacaattaataaactgctttcaaggtaagtggctgaaacaatgacttaatgttgtttcccattaaaatgtattggccagggatggtggttcatgactattcccagcactttgggaggctgaggcaggtggatcacctgaggtcaggaggtcgagaccagcctggccaaccaacatggtgaaaccccatctctaccaaaagtacaaaaattagccaaacatggtggtgcacgcgcctgtaatcccagctactcgggagtctgaggagggagaatctcttgaacccaggaggcagaggttgcggtgagccaagatggcgccattgcactccagcctgggtggcaagagtgaactctgtctcaaaaaaaaataaataaataaaataaaacattgtattataataagggtaaaatctatgtggaatgataattaaaaagttatccttatgcattaataaatacagtatgacctttgtatttgcgggttacacatccatggatttaaccaaccacgagtcaaaaacatttgataaataaatacatctatactaaacatatacagacctttttttcttatcattattccttaaacaatataatataataaacatttacacagcactttcattatattaggtatgaattatctagggatgtgcatggcttatgtgaaaatgttatgctattttacattagggacttgagtatgagaggattttggtatccctgagaggtcctagaaccaactccccacaaatactaaggatgactgtagtcatatataattttcatcagaaataattatctgttatataactatatatgtaaatgagaccattaaatgaaatttgtgttattttaaagtgggtcaagaaaagagcataatatctacatatcctcttgaaaactaaagaaaatatatgtaatgtaattatacataatacaatatataaactcattttccattttatatgttatacgttatataaattatatatacattatttgcattttcacataatctgtaaagattttattaaaatctcttttcaggcaaagcgagctaataacaaataataaagaataaataaagaaaataatgctgtactgtgtagttagagaaaatggcttttgtattcgaaattatttttcagttaatgaaacagataaaaattttgattaatacaacttattccatattttacaggaaatattgatgaagcagaatgggagtggaaagcaggattccatcgctggaacaattacatgatggactggaaaaatcaatttaacgattacactagcaagaaagaaagttgtgtgggtctctaattaatagatttaccctttatagaacatattttcctttagatcaaggcaaaaatatcaggagcttttttacacacctactaaaaaagttattatgtagctgaaacaaaaatgccagaaggataatattgattcctcacatctttaacttagtattttacctagcatttcaaaacccaaatggctagaacgtgtttaattaaatttcacaatataaagttctacagttaattatgtgcatattaaaacaatggcctggttcaatttctttctttccttaataaatttaagtttttccccccaaaattatcagtgctctgcttttagtcacgtgtattttcattaccactcgtaaaaaggtatcttttttaaatgaattaaatattgaaacactgtacaccatagtttacaatattatgtttcctaattaaaataagaattgaatgtcaatatgagatattaaaataagcacagaaaatc

SEQ ID NO: 36757 - DNA, 87007 bp, Homo sapiens
cccatgagcgcgccgcggcccgggctggcgtgcgggtgcggctgcggcggccgcgcggcggggccccgggaggcgggtcgctgagcggggcgcgcggccccgaggatgcgggagcgggagcgggagcaggtgagggcgcggtccccggccggcgggaggggcgggcggctggcccgagcggtggggtgtgtccactcgcccggaccccggagcgcgcccgcggccccggaatcccggagaatggggcgcggcggccagacccgtagcgggagcgtaacaaagagaaaagtcttgtttttcaggttcgctctcatatacttgagtaatttctaaaaggagtcttgaacttctattccgaacgccctggccgattgttgcgggttaattctggatcagggttttaaatgtgttaggcatatttgtgcctctcagaatatataaacgtgaaattcgccagataactttggcgagaaggggcgcagggaaggactgtttggtaacgcctgggtttgtttttggagtagagtatttactctggaaacaagaattcttggatctgcaaattccgacttgtgatttctgcaaatcctgattagattggccgctcttggcatgctcgtcctattttcttttttgctgagaaagccttatactaatagcgtatgctcacaaacacattcagaacattcgtgtgctccaagtgacaactgctgtatgcctaatagttgctgacagtttatttatttttttaagtttgggacacgacagtaattttactctgaatatagtccgtttcgtttctagggcattttattctggagcatctacgcacagatgttttctccgtgagaaacatgggtttaatgctatagctatagatattactctaaaaatgtcacatactctctccttttagtgcttattttattttaaagcaactttggcaaaattacatgtggtaaggaccttaataggaaaggggaaacgctgtaagattgagaggtaaagtgtatttgaggaacttttggaaagggttgtagagagggaaaattaaaatgaattcacaaatagttcagactgccttttgtaaacttgtactgaagcagaatctagtatgtatctgtttacttaccacaaaacggaaagattttgtagagaaaaaattatatcctagttttcctttaatagctatttataaattatgtttactttagtaaattataattccagacccaatcactttcatattattgcatattattttatacctgaaacagacctccccaaagaactcttaaatttctactcatcttggttttattatcttcagacattcataattgtattacaccatttggcaacaaatactgcatattactgaaaattaagatgtataaatcattgataaatttgtaaattattaaacaaaatcattgttttaacatagtgggttttatataaataagcaaaaagcaagccattcttatggatagatcttggggggatgcaccatgtacacacacactgcaactttttcaatttcatctaccaaaataagagataattttgacttttcctttatccctgatgcagtaatacatttcaagtctgagggacaattgaaagttttactgagtttgcttaatcagagcttaagttaataattaagttatacagtgtagtatctattgctttcaaggcatagttctatgtagtgaaaagactaccatatttgaatggcacctaatacaaatatttatctttcctctacacatatgcaatatcttgtctgttcatctacactacttaatccgcccggtttccagttaccataatttttatgtaaaattgaaacccaccatctgatctcatgaaagggtgtttagtatgcatatttataatccttaaatatttactcttggtttatcaattttctagttaaaagcttattatttaaagttgtcatttgctaatttttttccatcttgctttacttatttagtttatacccctgaaacagcaaagagcattgaaaactactggaagtggaaaccatatcttttaatacttattttctgtttccctccatagtatggtgcttttacctacagaaggcactcagcaaatgcggttaattaacacagtgctttaggtagttgcagcgttgtttttttcttctggccttcccctatcccttgtttttaatattttgattttcctggctatgggaaataaccagagctcaaaacaaacaaaaaaactagccagataaaaccgtggttgggtccttattagagatacagctctgtatgtaattatagcatggttgtaatctctttaaagacagcgacggtttagggattcgtcttagatttctcacgatgctcattacgctgtcttgttcccagagacgcaatacacatttgtggaatggaatttcaaaatgttaagtttggcaaagccgagggtagtagcggaacccttttctccaggtctgccattccctaaccctaagtgccccatcacctctgggcctgagacgcagtcaggagagcaggacccaggagaggactgggactgtggaatttgggatcgattcccagctcagcccgtcctagcgtgaaactgcgaaagccgcttctcttcctgaagcctgggttctgtctgccagatgagagggtcgggaatagatcttgcctctccgcgcggtcccgggccggaactcagcgtagccagctatggctgggtctcgctaagcgattcatccccaacaggcaatctctgcgcagaaggaaggtagggaaccgtctcaggaccctggaaatgtccgggattttgtagactcgtttagggggaaaaaactaatccagctgatataaaaatccccagctagtgctcgccccagaaaccatcaacaggtctggttaaaaactgttagagcccggcttggtggcgcgcacctgtggtcccagctactcgggaggttgaggcgggaggatcgcttgagcccaggtgttcgaggctgcggtgagctacgatggcgccactgcactccagcctgggtggcatagcgagacttcgctctataaaacacgttgtaaggagcgtattttgaggtcctgtggctccaaagcgggcatcctatggggcccgcccaacctctccaccgccagtagggcacgcgctggtccctttaaatgttcccttcgggagccgagggaccggtccttttagagcgcgtccgtccagaaacgcggctgcagaaagagggttccggggcctccgagtctactggttggcctggcaacgccgcgtgctcttcccaaggggaggacgcgggagaagccggggcctgagtgctccaaggccccgtgggcttcttgggtttgttgcctccggccgctcattaactcaggatggcgtggaagacctcgcccgcctccccttctgggccgcggctccgcttaggtgaaggcctgtttgggcgtccccaccctggagaggggccggggtctggattttcagaactgccactcttctagtggtaaatggataacgagcatttgtagggtcttttatgatgtttatcagtaaatcaatttgatgacgtaaatacttccacaagcgcttgttaggcacctcaccgggtttgaatcacacacctgcctttcttagtggggattattcctcccatttgccttcagggttaattttctaaagggattgggactgaaacctagctcttttggggccatttggcacttttctcacttaaggactaaagaactctgacatttggagtattacaacctgaaagagttacctatgaaaaaacaacaccttatccaaaataggaagaggatcacaattactaactacaaaatttgggattatagtagtgctggctattatctcatttaatcctgaggatggcccagtttgctatccctatttgtaggatacagtgaagggtggagtctgaccctgagcctagcacaactctgagataaaattccaccctgccttccgggtcctgttagtgccttttttccagtggagagggacggcttgttctttggccacagcttgactggcttttctttatacaagcaaagcccagcgttacgtttgcttaactaacggcgttcctctttccccagcgctggcgtcaatgctcccttcctcgggccattggagactccgttgctttttaatggcggcagcggctgctgggtgagcagctggaggccggacagtgttcgtcccatccggagaggatcgctttctcctggcgtcaccagcgctgggttggtgggggtagcttttccctctttgctcctccattcttgaagaaagaagaagatgccactgccatttgggttgaaactgaaacgcacccggcgctacacggtgtccagcaagagttgcctggttgcccggatccaactgcttaataacgagtttgtggagttcaccctgtccgtggagagcactggccaggaaagcctcgaggccgtggcccagaggctggagctgcgggaggtaagccacctaaagacactgcaggccaggcgcgggtggctcaagcctgtaatcccagcactttgagaggccgaggctggtggatcacctgaggtcaggagttcgagcctagcctggccaacatggtgaaaccctgtctctactaaaaatacaaggccgggcgcagtggctcacacctgtaatcccagcactttgggaggccgaggcgggcgaatcacaaggtcaggagttcgagaccagcctggccaatatggtgaaaccccatgtctactaaaaatacaaaaattagccggacgtggtggtgggcgcctgtagggtgtggtggcgggcacctgtcatcctacctactcgggaggctgagacaggagaatcgcttgaatgtgggaggcagaggctgcagtgagccgagatcgctccactgcactccagcctgggctacagagcgagacacctgctcaaaaaaaaaaaaaaattggctgggcgtggtggtgggtgcctgtaatcgcagctactggggaggctgaggcaggagaatcacttgtacccaggaggtggaggttgcagtgagctgagatcacagcactgcactccagcctgggcaacaaactctgtctcaaaaaaaattaaaaataaataaaaaaaacacgacaggcttctctggcccgcatgctggctgtgtgttctagcccacgggccactcactgtgtgtccctggctgggatgtctgagttgagcctgtagtcccctcctcatgaagcaggaatagattagattaagaagtctccccttggggtgccctataagaactaatggttcttattttgaatatgtttatattccccctctaaggtaatccagaatcaaatgtgaatacactttgggttgttcaaatttccattttctaatatacccccaaaggtcatcctgatctctagtacagtttactgacttcattctttcttttttgttcattttaatttttttagagtcaaggtaggtctagctatgttgcccaggttggtctcaaattcctaggctcaagcgatcctcccgcgataggcatgtgccaccatgtccggctcttgacttcgttctttcaacattcattgagtaaaattcattgactatattcttacaggccagatcgaggttctagaaacatactgcctgaactcagtttgagttctagtttcctcaccatctgcttctgttaccttgggcaagttatgtgatatctctgagccccagttctccatctgaaccatggggatgactgtgacacctaattctcagagtagcataaggttgtaagctctgctaactagtctattagagtaccgattgggaggtttgcccaggaaacccctaatctagttggtaggaagttatggagtactcatgtatccatataatgtcttaaatttaaaatgttatgcaaggcctgtgaagaaaggtctctaattaaacctaggaccctccctacctttggctacctggttcttgggtaagggaaagttagagaaactggttattccacctaaaaagtcaggaatagatgaactttgctcctggtgaccatccaatcacttatatgatcactcagtactgaagatgcgtaagtgccaagcacatacatacttggaagctcaccctagtgttgttgccagtaagaaaacaggcatgatgcatgctgtgataagggaagtagagggtgtgctataggccagagggaggtgcagcaaagggaaggctgctcagggaatttgattctgagctgtgacctgaggatggggcaagggagtcctatcaagggctggaggagttccaacaaagagaactgcacaggaccaaagacgcagaggaagctggtctgcctgaagcctgaagtgcgtggaggaaaggccgactgtaagggccacacaatgaggattttttgttaaaggatttagatttatcctgagggtagtggggaagttaatgaagggtgtaaacaggtgtggtacgattgtttctgtgaagagtgagccctttggagaatgatttgaggggagtggttcaggtacagatggtagccacctggagttggatagggttggagagaggtggttggaatctggatcaggacctaccgagtaatagagaagggttagcatgggtcctggttgatattcaggttttcagtagatggtggggctataacagagaggaaatgtgaaaggaagtgcagatctattaggggcaaggaggagcgtgtggtgagttcagttttagaaatactgagtttgaggtgccagttggaggttttgaatagacagatggatctgctgatctggagttcaggcatgagatccaggttagagggaagatattgggaagtatcagcctaagtgagttcattaaagccagaagatggtatgaggctctccaggggagaaaaagaggacatcgcagacccctcatggtagattagaggaggggaaagtgttggaaggaaactgagatgaaactgccgaagaagaagaaagaaaaccagaacagcaggcctcagtaaccagtccctgcttacttgcatttattcttttttagggatgaggtctcactccatcacccaggctggagtacagtggcaccgtcatagctcaatgcatcctcaaacacctaggctcaagtgatccttttgccttagcctgccaagagctgggactacaggtacactccaccacacccagctaattttttttttaacttgtgtttttgagatggagtcttgctatgtcgcccaggctggtctgggagttgtttcctctagttatcttcctgcctcaactttgtgagtaggtgggattacaggcgtgtgccaccttgcctggcttagtggcttatattctatttatttatttatttatttactttggttgcttcgactttttttttttttttcctattatggtttcttcttcctgtaattttcttcctcgtgcaccaggtctgtctataacgcctagagagtcagcttcttgaggaactgtggtttatttatttttataccaggtgtggaatgtgttcagtaaatacagggagaactgaacccacaggcattgccttccttctgttaataagtccagagaaattgccatcccttgttagaagttatcagtctcagggaacaagtaactttatatagctgtgggtatattttgagcctgatttttaacagaagaggaaacaggcatggtccctagaaaatgttttgcctgtggagagtctgtcccacaatttccaacataaatgtaacagtcatgggtagaaagtttgtatagcaaactttttctttgaaagccccagaagctctgctctgtagcatataaacagatggctcaggcatcaggcctaatcttaacaaatgactgttcagaaataatctgagtggggtcacacctgtttctagtttgtacatatagtctctgtgtgattcataccaagaaatatcagtatgttggtttcttgcactgttctcccaccaagcaaatctggaattatcgcatatagatttgggtggaaaactttgctactgtccaaatataaatggagggaaaagtccctcttgcttaattgaataccatttcacttctataatgacaattttttttttttttttttttgagatggagtttcactcttttgcccaggctggagtacaatggcgcgatctcggttcactgcaacctctgcctcccgggtccaagcgattctcctgccttagcctccccagtagctgggattacaggtgcctaccaccatgcccggctaatttttgtatttttgtattttttttttttttaagtagagatggggttttatcatgttggccaggctggtcttgaactcctgacctcaggtgatctgtccaccttggcctcccaaagtgctgggattacaggagtgagccaacgtgcccgggcctataatgacagttacaagggccgcacaatagtataacactatacccaggggtttcagctatatcagtagtgtttcttacactgggtatatgggtattttttttgtttgtatttttagctgtcatatttttacaagtgtctaagatattttgtattaaattaaaagcaacgtggttaatatacatgtatccaatgtagttaacttaggttgctaactttcttttaaattcaccatatttgaactacagaaagtaacttctttttttttttttttttttttatttgagacagagtctcgctctatcgcccaggctggagtgcagtggcgcgatctcggctcactgcaacctccgtctcccaggttcatgccattctcctgtctcagtctcccaggttcatgccattcttctgtctcagcctcccaagtaactgggactataggcgcatgccaccacgcccggctaattttgtatttttagtagagatggggtttcaccgtgttagccaggatggtctcgatctcctgacctcatgatccgtctgcctcggtctcccaaagtgctgggattacaggcgtgagccaaagtaacttttaaaaatgggaaaatgaattattcccttaggaaaatattgctgttcgttatagcagtagtttctcaaagctgttgaaattccctgcctatcattcttctgagtttcaaaacattttttcaagagaggctgtgagtccttgtggaatttaaggggagctagaaaattttctccaattttaaaagcatatgctgtagaggcttgaaggaggtggtgacacaagtggccacctgggcatgggcactgcctggggcatcaccttgacggaatcagcacaatccagagtgcaagagtcaggctcaaaaatctcatgtcatgggaagacctgatttaatctagctcgctaaaaatgatgtgtaaaaccaggacccaagtttagtaatttataagcagtaaggaactgccaagggtcccaggtatgtgtgccctctgcctaggccaagattttcctatagttagggcacatgggaaccagaacaaaccagaagtttcttggtgaacatggaatcagaagaatgttaccttgaaaaagtagatattttcataagtcggccaggcgcggtggctcacgcgtgtaatcccagcactttgggaggccgaggtgggcagatcacctgaggtcaggagttcaagaccagcctggcctggccaacatggtgaaaccccatctctactaaaaatacaaaaaaattacccatgcgtgatggtgtatgcctgtagtcccaactacttgggaggctgagacaggagaatcacttgaatccgagagacagaggttgcaatgagccgagactgcgccactgtactccagcctgggcgacagagtgagactctgtctcaaaaaaaaagaaaagaaaagaaaaagtacatatttttataagcagagaattgctgcctccaggaccagacaaattcctttgagtcagggcaccttttcctctgcgcggtgcttcagtggtgcttcagtgcctgtctgcctcttgagatggctgcttagtaaagtggttaagacagtctgcagtattcagaaacacctaggttgcatccaagtgctgtcatttaagtaattattaaatcacttaatttcccaagttcattgatttttcatttgtaagttggggataataatagtacctacttgatagtggttatgaggattcggtgttaaatgtaaaacatttagcaaaggacctggtatttgggaaactctcaataagtgttcttctttattaccatttttgttgatgttatgttattgttattagtgactcctatcccctgttgtagtaactgaccaaattctcttcataggaattcttttcttttctttttttttggtgagatggagtcttgctctgttgcccaggctggagtgcaaatggcgcgatctcggctcacagcaacttccgcctcccgggttcaagcgattctctcacctcagcctcccaagtagctgggattacaggcacctgccaccactcctggctaatttttgtatttttagtagagactgggtttcactatgttggccaagctggtcttgaactcctgacctcaggtgatccacccaccttggcctcccaaagtgctgggattgcaggcaggagccaccgcacctggcctaaaaagttttttaatcctcaggatatggggaagttgtgaaaccatggaagtctcttcaaggttatttttttcatgtttgctgtggtatattgtgttagttttataacttagaggacagttttctttcagctgtttctgaggggggtgtgtgcatgctggggcgtctttattgttgttcccatatatggccttcatacataactattgttttgaagttgagttaaatactgagccactgctaaaaattacctccagggtattttgttgaagatgaaagtctagcaaaatatatatagtggcctctcatttcttaattataggctttggtttatcatagatctttacgaaatgttttttaaattgtgtgtttagtgcgttacacacaatgtcaagtttttgttccatagactgtaagctccatcaaagtaggactcttgttgactggagcattgccagggtctgggatggcaccttgcacctatgttgttgctgaataaatgtttacttagtttaaaaattaagagtttagttttgaatttagattgataaacatggacagcagtacaattaagtcagcctttgtttgctctgattttatttcctggagagaggtaaacatttccaaagttttgtatacagatagaaaagcaccattttctttagactcttctttttcactttggggcttcttctgaaacacttagaaagtgatctagttgtagtggctccctgatgtaagattgctgtgtcaagggagtgtcagcttcctcactggactttgaacagatacttctcatagcaccttatggcagatggggatattttttcgctaggggatttgttagaatagagaggaatcaagcatataacgcaaaccataaccctcaagcacaactttagaaagtgttcttggccatcaaagtgttttattttaaattagtgtcttaggtattccaaatatccactgaccttatcttgactgttatctgagtagacatcaagaatttcatgcttatttccttgtgtactagctgttttcatttggactctaaaaatagctgatatatatgtaaagtaaaagtctagtacccagaaacttttttaccttttgggccaagtagttattcatttaggtatgtacgttataaaacaagtaagaccgaggtagagacaagaatctgtgaatattttcagttagagctattggaccgtctgaagcaaatataatgttaggttggttggcctctcacctagatagagaaagctttcccaagtctaacaccaattataaatgatcagggatttttcttgatgtttaggttttgttacttttcttctttggtctaggtaattaagaattagccatataaataagtatggaaattacacatacaaacatggaggatatgcattttaaagtctattctacaatcacaagttattgcagaatttggaaacctgtttatttgaagaatagagtattattcaacctagacttagtgcctaataaacttaaaggctaataacctaagatgttttcctttcagtattggatttttcccttgagataccagatgtccttattttcttaccatcagtctgtcacagtagtgtagtctcaggaccatgtggaattaagcatgaatttactcattcgagatttgtaaggtgaattacaaaatggtggacatgagggaactgatggtgttttgggggctctaagtgctgtcactgtctttggtgtatagaatcagattccattccttctaatatctctagaagctttgactttctgctgtctccatttgggtaaatgagcgttattgtgctggaagctttatttacctcatttaatcttcacaatgagttaggcgttgtattatcttttccattttcaaattaggaaactaaacttaagaaaagtttgagtgattacgtagctaataagcaaaagacccaggatttgagattttatatcagacttctgctcgaactttgacctttaaatttgtggcggtcatggacccctttgagatctgatgcaaacacagaattttgtatacaatttcaggtggttcatagccactctctcccccaagtccatccatgggcctaggctgtgggcctggaggcttcctggttaaggcagtctttccctttttctccccttgtcacagagcaggatctttcttccctggtcttctacttcccagagtgaaagatgctggaaggatggaatatttgtgaacaattcaagaccttcataattaaaaaataataatttgcctctgaatatagagcctcccctcgctgacccttctactacagatgccctttttttctttggccttcatctttaggtctcaggaagggccattcattgctcagtgggacaacttactattaaggaaaaagcccctctcaggggggacagaggggaggtcatgagtgggaattcccccactgtcctgctgatggtagatccatgtctgtcttccctgctaggcagcaggtatgtgatgcatcttcaggaattgaatggatgattcattcttcctttatacattaatcaagttcccaggccaattgttgagccctctgtatcattcttcttgtcagatacacactttatgtgaatatggcattttcttttctattaacaaggattcatcattcttttaacagtatgccaatttagcgaatattttcctattcagttctctgagcaatttgttcataaacaaatgtcacttagatttcctttatcttttaatgaattgacagaacatacagaggcaatttaagtttttgcctaagatgctaacattactagaagaaactgtgtatgtcacaaatccttcatgaggattggtagcatgtagtagaaataacttcctatcaagggtttgtaccactttctatagtagattacccaaatatgatcattaaaaggtgtatagtgttgagatttatatatggggcagagtagttttgttattttaaataagttttgacttattttgcctactcaggctaagaaaatatacgggtaatctcatgctgagtggcaagctcatgtgaatctaaaaacaacttattggccgggcaaggtggctcatgcctgtaatcatagcactttgacaggccgaggcagtaagatttcttcagtccaggagttcaccaccagcctggggaacatagtgagaccctatctatacaaaaaattaaaaaattagctgggcatggtgtcatatacctgtagttccagctactctagaggctgaggtgggaggatcacttgaacccaggaaggcaaggctgcagtgagccatgatcatgccactgcactctaacctgggtggcagagcaagacactgtctccagaaaaaataaaaataaaaacaacttgttatgttacagttacttagatggctcagacttcgttgacttgtcaaatgaacctcaatgtcaagtgaattttcagcacattgaactttataccatttgattcaactacatttggcaaagtggggttttggaagaaaagaggtaaagttttggtgctcaatggacttgggttcaaatccctgcagactacctgtgtgaactgaggaaaccaacttccctgggatttgtttcttttgtatgtgatatggctgcatgtaatagtaagaatgatagctctgcattgggtactgaccatattccatgccctgtgctagttgctttacatatgtgtaaccctgtgtataatcaactttgtttcctcccaccatctcgttgatggagtggaccaaagaccaatagcatccataggacactcattaactggcagctcttttttagtattctttagccgtttccactttctgtttcatcatgtaaatttgttagttggaataatacactgagggataataatggattggagaaaaatcactggagaggtattattgttaagtcaggcaactgagttcagagctgcactgctgagaattaagatattcaccataacatcctttctcttcctgcaagtttggtatgaaatatctagaaaataaccttctcagtcccttgtattttgcacttagaaataatatgtagacacttgcatacttgattcgcctgtgtttttatgattgacacctattttgaagtcaaatttatgcttagtgacttaaggaaataacacttaaaccatacagtatgataacagaaaaatgaagcatgtttaatagtgaatatgtctaaaattgtattattattatttgtataatgtatgctacccttcaatagaatgcagatttctctgtatgatgctatacaactaatgcctggctagggcagctagttggtgacagccccctgctagaattcaggtcttccagctcttgttttagcacttttctctcaatatactgcttttccatggagccattgccattttcctaaaagaaaagcaatccaagtgttgatattgtctatttactttaaaaggaaataaagggaaagaaggccaggcgtggtggctcatgtctgtaatcccggcagttcgggaggccaaggtgggcggatcacctgaggtcgggaattggagaccagcctgaccaacatggagaaaccccatctctactaaaaatacaatattgctggccatggtggtgcatgcctgtaatcccagctagtcaggaggctgaggcaggagaatcgcttgaacctgagaggtggaggttacattgagtcaagatcatgccattgcactccagcctgggcaacaagagcaaaactatgtctcaaaaaaaaaaaaaaaattaaccgggcgtggtggcagtcgcctgtaatctcagctactcgggaagctgaggcaggagaattgcttgaacccaggaggtggaggttgcagtgagctgagattgtgccattgcactccagcctgggcaacagagtgagactccatctcaaaaaaaaaaaaggaaagaaaaggaaaagttcccaaagatagaatcctattagtgaaggaagtatttaagtgtaggatctcctctactaaataaatgtaatacgaaattttatactgtttaaagggactagaaaaccatgataagaagatctcgtattacttgagcacttgtttgcatgagacacttttgtaagtgctttaaatgtttttgcttattttgatcttcacaaaaatcctgtatatgaggcactgttatgctcatctccattttactgatgggaaaactgagacacaaaggtattaagtgacttgctcatggttacatggcggaaaccacagctagagtagttctgactccttgaacagcatctttcttcctggtttataacctttgacaaatgacaggtggcctgctctggagctcatgcccttgatgacagcctggctcagagtggcctcctaaatgtgacagtagtttttgtaagtactctggagatatttgttatcatttaatttttgtatttttacaattatcttgcttaagataggtttttgcactcacgtcaggcaaagaaaggtaagcatgagaaggaacatgagtgtcattaggcccgcaagacactgttggggaatccccagggtgtttagggcagagctgtttgatgagaagcctttggtgagcttgttccctggcagagttggaagtatcagactgatgaaatacatcccaggagtgttctctgctgagatattttccaaagcaatatctgcttgcactactgttagatgaatttggtgggcttctagattcagattcttcatccaagcaaggagaaaggtagaggcagtgagtccgttgaagtgctggctgcctttcgtgatgagcccaggctgtgactgaagaataagaagttctagtttatctttggttatgtgggtcgtaaactaaacaacctttatatggtagcacatagagcatattagcttttgactgtattgaaactttgtgcagtaacatctcaattatccctgtcattcttgttggttatatatatacagtcatgtgctgcatatcacatttttggtcaatgacagactgcttataagatggtggtcccataaaattataatactgtatttttactgtacctttcctatgtttacataagtgtagatacacaaataccattgtgtttcagttgcctacaatattcactacagtaatgtgctgtacaggtttgtagcctagcagcagtaggctatatcacatgccctaaatgtgtaggaggctataccatttaggtttgtgtaagtacactccataatgttcacacaatgaaatagcctaatgatgcattcccacatcgttaagggacacgtgactactaaaatttcccctttaatcctagtttactctttaaaaacatgttgatattgtcttaatcttataattcaagatctttctccatagcacttatcagtatctggcataatatatattttgcttgtctatttttccctattggaattaagttacgtgagggcaggaattttgttctcatgttcaatgctgtattcctagttcccagaacagtgattgacatgtagtaggtattcaatcaatattcattgaatgaatagatgaatctttctaaacattagtccagttaaaaatagagtatatttatttgtgtttcagaggcatcatattcatagcatctcattgtccaggatagtaaatagaaaagagataagcagttcatccatgtggacagtaatctcagtttgtgcctcctactgtctttcagtccctgaaattgtcttatcatttgactcttccttaaagataaatgctacagcaacaacaaaaatctagccacacgagaagttcagttacttggacttcagtataatttcagaataatttagaaggtcaagatgtactcttgattattttcttgagtcttcatttagttgtaatagagtataatgatattgcatattaccactttggctgtaaaatatatattatttgatcaagtatagaagaaaactgattaaaattaaacagaaaaggaaaaaatgctgcctgctttgaggcaatgtgaccgccactatctgtcacaaggaagaagtacgatacttcattatttatggcagactctgtaaaggtaagctccaggcttgaattaggttaatacttgttaactacccttgttagatgatctcttcccgggatagactttatctagtgctatcttctgtcatctctttcctgatgaaaagtcttctgacttctgcctagtctaagaaaggcatcaggatgaaattatatttgcaattttagatgggattaacttttatcaacccaatgcatcagtggctttaaaaacccttcagctaatttctgtgtccctctgctctactttaaaaatagtacaaccaaaaagactcttaaaataattagacgagaaatgacttagggattaggaaagggtttacattctgacaggatttggacctgcttttaatagctgacgtctccttaggggactatgatttgggtgctgcacattttttccccatctcaaatttgtaaactctcttttgctttgaacaaaaaacttggttatcaaatcactttgttctcagtcaacatcagttcatgtaaagtaagtcaaccatattgtgctgaaaagaagccaagtttgttttaacttttatttttactgtagtttacaaagcaggcacagttatctgtacaattttagaagagtagctatgaaaaaattttaaacaactatgaagaaatcattgaataactttttgaaaactatcctgatatgtttgttcataacaaaataggaaaggaagggagaatgtaaacacacctgacaatgaaagtttcacaaaattctctacagtgactattgagaattgatctaggggatgctagaagattcagtgatttaacaacttctgctggaatgagtttcccacaggtcaagtcaatttgctttgatcaccagtgagagtggatgcagctgtggagaaagagaagccacgtggaggtaaagtttcttatcaggaaaagcactggaaagttatataacaaagtgtggcaggagacatgaactgaacgccaataactaaaggctgtctgctggaaaacttctgttacaattaaacgaactccattaacaggacgtgcatagtccagaagatttggactcaaggaagagaggatgtgtgcttctgggaagatatcctagaccaaggcagtagttaaaatttcaggcacatgggcctgtctgtagcaaagtttttgcctttcttttagtaaaagtcctggtatgttcagactttaaaggaagaaattagtttgactgttatttgaatagtgatattttcaaggaagaagcatgcttgattcaagttttattctattttctgtcatacctgaagagatcctatctgctaaatataggtaccatgacaaaggtaagagtgcttttcagtattatcagtacgattagaacttacaaagttcttcaccacaattttgaggaaggaagagtacatgttaaattccctattaagaaacagactcagtgaggaagtgagacattccagagctggcaagtggtaaagtcaggactcaaaggccgagccttttgcctgcaaatctagtgctctttgtaccacaccatgctagtggcagctattggaatctcaggcattgtcacccgggggaaatacagccatgtgtcacttaaggacagggaaatgttctaagaaattcgttaggcaatttcattgttgtgtgaacatcacagggagtacttaaacctacgtggtatagcctactgcacacctgctatgtgctgtggcctagtcctggtaggctataataaacctgtccaacatgttactatactgaatactgtaggtaattatatatatataacaatggtgagtatttgtgtacttaaacatatctaagcatagaaaaggtgcagtaaaaatgtgaggtaaaagattaaaaaggtacacctgtatagggtacttaccgtgaatggcgcttgcagaactaaaagttgctgtgggtgagtcagtgaatacgaaggcctaggaagttgcactatagtagtaggacactattgtagcctctagaaacactgtacagctaggctacattaaatatatcacaattttttaattttttaagacagagtctcactctgttgcccaggttggagtgcagtgacgcaatcatggctcactgcagcctcgacttccaggctcaagcattctcccaagtagcctcagcctcccaagtagctggaattataggcgtgcaccaccacacctggctaatttttgtagttttagtagaaatggggtttcaacatgttggccaggcttgtcttgaactcctgacctcaggtgatcctcccacctcggcctcctaaagtgctgggattacaggcatgagccaccacacctggccttcgataataaattaacctcagcttactataacgtttttgctttacaaacttttaaatttttaaaacttttgactcttgtaataacataggttaaaacacagacacattgtacagctatacaaaaatatctatatccttaccctataagcttttttctattttaaagtatttttttgttttttactttttaaacttttttttttttcttttgagacagtcttactttgttgcccaggctggggtacagttgcgtgatcttggcttactgcaacctctgcgtcctgggttcaagccatttttgtgcttcagcctcccaagtagctgggattacaggtgtgcaccaccaagcgccccccgcccccccttttttttaatttttagcagaggtgggtttttgccgcgttggccaggctgatcttgaactctcctcgccacaagtgatccactcaccttggcctcccaaaatgctgagattacacgtgtgagccaccgtgcccggccactttttaaacttctgtgttgaaaactaagacacacatattagcctagccttaaacagggtcaggatcatcaataacactttctttcacctccacatcttgtcctcctggacagttttcaggggcggtaacatgcatggctctgtcatcccctatgataacaatgccttcttctggaaacctcctgaggctgatttccagttcactgttttttttatttgaaagagggtctcattctgtcacccaggctgtagtgcagtggctcaatcacagctcactgcagcctcgaacttctgggctcaagcaatcctcctgcctcagcctcctagttgggtctacaccaccacacctggctgatttttgtattttttgttgtgatggggtctcactatgttgcccaggctgttcttgaactccttggctcaagtgatcctctggcctcagtctcccaaagcactgggattacagatgggagctactgcacctggcctacagttaacttttttataaataggagtacactctaaataaaaagtataataaatgcataaatcagtaacatagtcatttattatcgtccagtgttatgtactgtacatagttgtatgtgctgtgcttttgtgcaattggtagcacgataggtttgtttataccagcatcactacagacatgtgagtaatgcattgcactgcaacttagcaactacaacatcactatgtgataggaatttttcagctgttacagtcttaggggaccaccatcgcatttgtggtctgtcgttgactaaaacattgttatgcggcacgtgactgtaattagcttctatgctactagttaaacctttcaaaaaacaaataacagcaggtaccaaaacagaaatggaaacagctttcatgtttggctttggaaaatatgcttgtacttgtaagtgaagtaatgaaaccccaattaaattggctagagtactgtaaagctttatataaaataagttatttttggaaaataagttatttcttggaaataagttatttctttgggaaatgaagcgcttcataactaactttgcctgataaacaaggttgactcctttgtccaaactatttggagtgctaagttttggaaacaatttataaatttctatctgtcgtaaataaaggatactacctctgcttttaggaacagtgattgttgttgaatacatgactaattaatgtttggagttatttgtttctttagtaagtaactccagactcccatatatttgtaattctttgtaaattctatttaaggggtttttgtttgttatgtacgtgttctcctttgctaaaaagaatgttgcccatcacttccctctactgccaacttgctattattaaataagcccttttcctttaatttgtcatcttttaatctgctttggattggattaccaaatcgctaaactcattaaaagtatgtataaaataagaaaaaaaatccataaaagagataggagaaatttcttctttgtcaagggcatatactttataacattgactttaatatgtatttttgattgctcaaacacatttttccctattctctgttcttcaattatgttcacgtgaggttgccagttaactgtcaaacggcacaaaatcttgacgtaagtatagatattagaaaatagaaattgtaatgaactcataggctcgtctatttctggctcattttttttcttagacttaatgaactgaatttgttgtatttaaacattttaaaatagagctgaaaatatctgtacttgttatgtcctttcctggttttggtattagggtaatgctggcttcatagaatgatttagggaggattccctctttctctatcttttggaatagtttcagtaggattggtaccaattcttctttgaatgtgtgatagaattcagctgtgaatccatctggtcctggacttgttttttgttggcagtttttttttttttaattaccgtttcagcctcaatacttgttattggtctgtccagagtttctgtttcttcctggtttaatctaggagagttgtctatttccaggattttatccatctcccttaggttttctagtttatgcacgcaaaggcgttcatagtagacttgaatgatcttttgtatttctgtggtattggttgtaatatctcccagttcatttctaattgagcttatttagatattctcttttcttggttaatctcgctaatggtcaatcaattttgtttaccttttcaaagaaccagctttttgtttttgttttgttttgtttcaatttcatttggttctgctctgatctttgttatttctttttttctgctgggtttgggtttggttggttcttgtttctctagttccttgagttgtgagcatagattgtctgtgtgctctttcagactttttgatacaggcatttaatgctatgagttaatatatatttaatgtatatttaatgctcttagagctgcttttgctgtatcacagaggttttttgtttgtttgtttttttgagatggagtctcactctgttgtccaggctggagtgcagtggcgcaatctcggcttaccacaacccctgcctccctggttcaagcaattctcctgcctcaacctcccgagtagctgggactacaggcatgcaccaccatgcctggctaatttttgtaattttagtagagatggggtttcactatgttggccaggctggtcttgaactcctgatctcgtgatctgccagcctcagcctcccaaaatgttgggattacaggcgtgagccactgtgcccagccatatcccagaggttttataggttgtgtcactattatcattcagttcaaagaatttttaaatttgtctttattttgttgttgattcaaaattattcaggagcatattatttaatttccatttatttatatagttttgagggttacttttggagttaatttccagttttattccattgtcgtctgagagagtacttgatgtaattttgatttttttaaaatttgttgagccttgttttgtggcctatcatatggtctatcttggagaatgttccatgttttgatgaaaataatgtatattctgcagttgttgggtagaatgttctgtaaatatctgttaaatccatttgttctagggtatagtttaagtccattgtttctttgttgactttctgtcttgatgacctgtctagtgctgtcagtggagtattgaagtcccccactattactgtgttgccatctatctcatttttttggtctagtagtaattgttttgtaaatttgggaactccagtgttaggtgcatatatatctaggatggtaatattttcctgttggactagaccatttattattccataatgtccctctttgtcttttttaagtgtcgttgctttaaagcctgattcgcccaatataagaataactactcctgcttgcttttggtttccatttacatggaatatctttttccactcctttaccttaagtttatgtgagttcttatgtgttagatgaacctcttgaacacagcagatacttggttggtggatttttatccattctgccattctgtatcttttaagggaagcatttaggaccatttacattcaaggttagtactgaaatgtgaggtactgctctattcatcgtgctagttgttgcctgaataatttggttttttttcccccattgtgttactgttttataggccctgtgagatttatgctttaaggagtttctattttggtatattttgaggttttgtttcaagattaagagctcctttcagcattttttgtagtgctggcttggtagtggcaaattgtttcagcatttgtttgtctgaaaaagactttatctctccttcatttatgaagcttggttttgctggatacagaattcttggctgataattgttttgtttaaggaggctaatataggaccccaatgccttctggcttgtagagtttctgctgagaaatctgctgttaatctgataggttttcctttataggttaccttgtgcttttgcctcacagctcctaagattcttctttttctttttttttttttcttgagatggtgtctgactctgtcgcccagactgaagtgcatggtgtgattttggctcactgctacctccacctcctgggttcaagcaattctctggcctcagccttccaagtagctgggattacaggttcctgccaccatgcccggctgatttttatatttttggtagagatggggcttcaccatgttggccagactggtctcaaactccttgcctcaagtggtctgcccaccttggcctcctaaagtgctgggattacaggagtgagccactgcacctgacctttaagattctttcctctgtcttgactttagataatctgatgactgtgtgcctaggtgatgatctttttgtgatgtatttcctgggtgttctttgagcttcttgtgtttggatgtctaaatctctagcaagaccagggaagtttttcttgattattccctcaaataagtttccccaagttttagatttctcttcttcctcaggaataccaattattcttatgtttggtcatttaacataatctaaaatttcttggaggctttgttccaaaaaaggctacagaccagtatccctgatgaacatagatgcaaaaattctcaacaaaatactagctatttgaatctaacaccatatcaaaaagataatacaccatgatcaagtaggtttcataccagggatgtagggttggtttaatatcaagtcaataaatgtgatagaccacaaaaacagcattaaaaacaatatgatcatctcaatagatgcagaaaaggcatttaacaaaatccagcattcctttatgattaaaaccctcagtaaaattggcatagaagggacataccttaaggtaataaaagccatctatgacaaacccagagctaacattatactgaatggggaagagttgaaagcattccccctgaaaactggaacaagacaaggatgttaactttcaccacttctcttcaacgtagtactgcaagtcctatccagagcaatcagacaagagaaagaaagggcatccaaatcggtaaagaggaagtcaaaccgtctctattcactgatgatatgaacgtatacctagaaaacccctaagactcatccaaaaagctcctagatcgataaatgaattcagtaaatgttttagtctgttttcatgctgctgatagtcatagctgagactgggcaacttacaaaaggaagatttaatggacttacagttccacatggttgggaaggcctcacaatcatggtggaggatgaaaggcacgtctcacatggtggcagacaagagaagagagtttgtgtagggaaactcccatttttaaaaccatcagatctcatgagacttattcactatcaccagaaagagctgcccccatgattcagttacctcccaccaggtccctcccacaacgtgggaattcaagatgagatttgggtgaggacacagccaaaccatatcagtaaagttttaggatacaaaattcaggtacacaaatcagtagcactgctatacacaaacagtgatgaagttgagaatgaaatcaagaactcaacttcttttataacagctggaaaaagaattaaaatacttaggaatatacccagccaaggaggtgaaagaactctgcaaggaaaactacaaaacactgctgaaagaaatcatagataacagaaacaaatagaaacacatcccatgctcagggatgggtagaatcagtattgtgaaaatgaccatattgccaaaagcaatatataaattcaatgcaattcccatcaaaataccatcatctttcttcacagaactagaaaaaacaatcctaaaacttacatggaaccaaaaaagagcccccatagccaaagcaagactaagtagaaagaacaaatctggaggcatcacattacccgacttccaactggactacaagcctatagttaccaaaacagcatggtactggtataaaaacataggtcaatggaacagaatagagaacccagaaataaagccaaatacccacagccaactgatctttagcaaaggaaacaaaaacataaagtggggaaaggacaccgtattcagcaaatggtgctgggataattgacaagccacatgtataataatgaaactggatcctcatctctcaccttatacaaaaatcaactcaagtgggatcaaagacttatacctaagacctgaaactattaaaattctaaatgataacatcagaaaaatccttctagacattggcctaggcaaagagtctgtgaccaaaaacccaaaaacaaatgcagcaaaaacaaaaatagatgagatttaattaaactaaaaggcttctgcacagcaaaagaagtaatcagtagagtaaacagacaacccacagagtgggagaaaatacttgcaaactgtgcatctgacaaaggactaatatccagaatccacaaggaactcagacaaagcagtgagaaaagaacaaataatcacatcaaaacatgggctaaagacatgagttagacaattctcaaaagaagatatacaaatggcccagaaacgtatggaaaactgttcaacatcactaattatgaggaaaatgcaaatcaaaccacaatgctataccaccttactcctgcaataatggccataataaaaaaatcaaagaataatagatgttggtgtaaatgtggtgagaagggaacacttttacactgctagtgggaatgtaaactagtacaaccactatggaaaacaatgtggagcttccttaaagaactaaaagtagaactaccatttgatccagcaatcccactactgggtatctactaggaggaaaagaagccactgtatgaaaaagacatttgcacacacatgtttatagtagcacaattcacaattgcaaaaatatggaaccagcctaaatgtccatcaaccaactagtggataagggaaaatgtgacacacacaaacacgcacacaccatggaatactactcaggaatgaaataatggcatttgcagcaacctagatggagttggagaccattattctaagtgaataactcaggaatggaaaatcaaacatcgttatgttctcatttgtaagtgggagctaagctatggggatgcaaaggcatgagaatgatgtaatggactttggggtttccaggggaaggatgggaatggggtgaatgataaaagactacagattgggtacagtgtacactactcacatgataggtgcaccaaaatcttagaaatcaccactaaagaatgtattcatgtaaccaaacaccacctgttccccaaaaattattgtaataaaaataaaattatttactttattatgaatatttctgatctttaaaaacatttttttactgagatgaaattcacataatgtacaactaaccttttttttttttttttttttttttttttgagatcatctcgctctattgcccaggctgaagggcagtggtgtgatcctggctcactgcaacctctgcctcccaggttcaagcgattctcctgcctcagcctccggagtagctgagattacaggtgcacaccaccatgcctagctaagttttttgtatttttagtagaaatggggtttcaccatgttggtcaggctggtcttgaactcctgacctcatgatctgcctgcctcagcctcccaaagtgctgggattatagatgtgagccaccgtgcctggccacaactaaccactttaaagtaaacaactcattggcatttagtacgattacaatactgtctatttctaaaacattttcatcacccccaaaggaaattctgtatcccataggcagtcattctctattcttccctgcccctagcaaccaccaatttactgtctgtctctgtggatttatatattctagtcttgaactcctggcctcaagcaattctcccaccttggccttccagtgccttgggattacaggtatgagccaccacaccttgggatttattcagatgtttcatataaacagaattatacaatatttgaccttttgtcttctggctgcttttgcttagcataatatttttgaatgtcatccacattgtggcatgaaccagtacatcattgtgttttatggctgaatgttcattgtatgtatacaccacaaacttgtttatccattcatctattgatggacatttggcttgtttccaccttttggttattgcagatagtcctgctgtgcatatgcatatacatgtgtttcttgagcacctgtttttcagttcttttgggtatgtacctagaagtggaattgctggatcatatggtgattctatatttagtgttttgaggatccaccaaacttttccacagcagctgaaccattttctgcttctactagcaatgtataagggttccagtttctcctcaccaatgtttacttcctattttttaaattatagccatcctagttggtgtgaagtggtatctcattatggttctgagttgcatttccctaatgactaacaatgttaagcatcttttcatgtgcttgttagccattcatatcttttttcaaaaagtgtgtaagtcctttgcccattttaatattgggttgtttctttctgtatgtaagagtcattttatacgtttcaagtagtagacctttatcagatatataatttgcaaatattttctccttttcttctgttctgtaggttttttttttactttcttcatttattattattattttttgagacagggtcttgctctgttgcccaggttgaagtgcagtggcacaatcatggctcactgcagccttgatctgttggggttaaagtgatccttccacctcagccacttgaatagctgggactacaggtgtgtgccactgtactcagctaattttattttttgtagaggcaaagtttcactatgttgtccacgattgtctcaaacttctgagctcaagcagtcctcctgcctcagcctcccaaaatgttaggtttacagctataagtgaccatgcctagcctgatatggttttttttgcatgtaagttctaaattttgtgcgtgtgtatgtgtgtttttaagagggtcttgctctgtcgcccaggctggaatgcagtggtacaattatagcttactgaagccttggtctcctgggcccaagtgagcctcccactttagcctcttgagtagctgggactacaggtgtgtgccaccacacccagctaactttaaaattttttgtaaagacagggtcttgctttgttgcccaggctggtcttgaactcttggcctcaagtttctcccactttggcctcctaaagtgctaggattacaggcatcagccactgtgcctggcaagttttgtaattttgaaataagtttatctatttttttctttgttgctcatgtttttggtgttatactcaagcatttattcccaaattcaagatcacagagatttaccctaatgttttcttctaaactattttacgggtcgcttcttatatttacttaatttttatatatggtatggagtagggatccaacttcattctttcgtatgtggatcttcagttgccccagcaccatttgctgaagagagtattcttttccccactaactggtcttggcacccttatttaaaatcagttgactgtagatgcataggttcatttctagactctctattctatttgtctatatgtctctccttatgccagtaccacacagtttggattactatactcttgtaataagttttgaaacaaggaagtgtgagtcctccaattttgttattctttttcagtattgttttggctatttggagccccttgcaggcccatgtgaatttgaggattggctttttatctctatgaaaaagcatattgggattgtgataggtattgcatttgaatttgaagattactttgggtagtactgcaccttaacaatattaagtatttcagtctatgaacatgggatatctttctatttatttagattttccttaatttcttttagcactgtttagttgtgttcagtatatgccttttcaccttcttggtcaaatttattcctacatattttgttcttttggatattactgtaaatggaattgttttctttttttgacatgtacattgctggtatatagcagctgatttttgcatgttgatcttgtaccctgcaaacttcactgaatgtattacctcgagtagggcaggggtgtgtgtgtgtgtgtgtgtgtgtgtgtgtgtgtgtgtgtcacggttggggggtggatttggaggattttctttgtctaggattatgtcatctgtacatagatagttttactacttctttccactttaaatgtcttttatttttcttgcctaattgctctggttagaaccttcagtacaatgtcaaatggcagtggtgaacatgggcatccttgtcttgttactgatcttagggggaaagctttcagtctttctccatggagtatgatattagctgtgggtttttcctaaatgctcattgtcatgttaagaagctcttctctattcttctattcctagttttctaggtgttttttatcattaaggatgttggattttgtcaaatgcttttcctgcatcaattgagatgatcatgtgtgttttttttcttttgtcttagtaatatggtataatgattttggggggtatgttttaccacccttgcagtcctgggatgaatcctacttagtcatggtgtataatccttttagtgtgctgttagactcagttttttaatatttgcttaggatttttgcatctatatttacaagggatgtcggtctatagttttcttgtggttatcttttgtctggctttggtattggggtaatgctggcctatagattgagttagaaagtattctctccttttccttgattttcgtgctcactccccaccttgtttgttttttgaatggattttaaattattttggaaagttaattattcagattcttaaggttattattcaagacgagccaaaaaaaaaaatggtcttacccaggaaaaatctttgcctgatgagaatttaatcacaatactttgttgctcaagctccacctacctattttagaaacagatgatattgtagtcataaaatctcatggaatcagatgttgtgacttgattatgtatgtgtagaaattctaagagagcattcaatccaggattataatgttacaataatttagttacccatatgtatataaacatttctagcagcaattttagaaatataatacctccttggaggtatttaacaagatataaatttgatttttggctagctttcactacttcttaagatagaacttgaacattggggcaggtcccaaagcaaatactttaactacaatagttacgcacgagaaagtcatgtaaacaatctatccttgacaagctacaaagtcaatattcagatgtcccaaatcttagactcctttatttaaaagagctaaccaacaaagaatttactaagcccacctttctttttttcttttttttttttttttgagacagtcttgctctgtcgcccaggctggagtgcagtggtacagtggcatgctctcagctcacttccacctcctgggttcaagcaattctcttgtctcagcctcctgagtagctgggattacaggcacccaccatcatacccggctaattttttgtatttttagtagagatggagtttcaccatgttggccaggccagtctcgaactcctgacctcaagtgatccactggcctcagcctcccaaagtgctgggattacaggcacaatccaccacgcccggcctaagcccaccattcttttcagctgtttgtacctttagataaagttctcgctactctcttctatggtctataatttgtgaaaaactaattatgatgcaatttcaacaaatgtatttgttcagttctatttgattttctaattcatgttgcatgagtaatagatgcactgataaagttagcatattttaacagttttcctttcagaatgtgctttttaacagaatgctagcagattgttcagctgttatttttttaaattatattacagtccattcacaaaaggtacaaccacaaattatacaataaaccagaaattttataattctgtttttgtatttggaacagtctacagtccaactgtatttaaaggggaagttaatgtattcaaagggtatttttaagaccttttcattttggttaaaaatgatgacatacagccaggcgtggtggctcacgcctgtaatctcagcactttgggaggccgaggcgggcagatcatgaagtcaggagttcaagaccagcctggccaacatggtgaaaccccgtttctactaaaaaatgcaaaaaaaaaaaaaaaaagttgggcgtggtggcgggtgcctgtaatcctagctacttgggaggctgaggcaggagaagcgcttgaaactggaaggcagaggttgcagtgagctgagatcacaccattgcactctagcctgggcaacaagagtgaaactccgtctcaaaaaaaaaaatgacctgctgttaacttaccaaaacagttttagatcctaaaggattcctaatctggcattatagaccgaatgtggtacattcagtccaaaacttgtgttctaagatggaacagaaaacaaacatagtaacagaaatgtattttgttgtaatcaaatacatgtaggtaattttaaaagtcttttgaggggaggagtcagtaattgattttgttggtggagagaatgggtgaaactaaatgatatttttaaaaatatagtggttttcaggctggcacagtggcacactcctgtaatcccagcactttgggaagctgagacgggaagatcacttgaagccagtttaagatcagcctgggcaacatagtgagaccctctcttgaccaaaaaaaatatatatatatagcctggtgtggtggcatgcacctgttgtctagctacttaggaggttggggcagaaggatcacttgagcctgggagtttgaagttgcagtgagccgtgatcatgtcagtacactcccgcctgagtgatagagtgcaactctctctcaaaaaataaaatataatggttttctaataggaaaatgtacttaggtagttttcccgtatccaatcctcatgacaggattgtgagggagatattactttattttacacttgagaaaaccaaattagattgattgactttaccatttcactcctagtaaataactgttggaaatcaaactcagaactttggacttaagcatcaagctctttctattaaaccagatttttgttttctataagttgcagtttaaaaaaagaaaagaacagtacttgttttctataaatgtatgatacatattctatgcttacagataataagcaattcattttaaaatgtcataacctcagaatataattaacaatgggacttggcctttcagatatattacaatgtgcttggattttcaaaaattttatttgcatgcagcttgtcaaggattttttttttttttaaggcagagtctcactttgttacccaggctggagtgcagtggtgcagtcttagctgactgcagcctctgtctacctcctgggttcaagtgatcagcctgccaagtagatgagactacaggcacacgctaccacatctggctaattttttgtattttttacacagacagtgtttcgccatgttgcccagattggtctcaaactcctgggctcaagaaatcttcccacttcagcttcctaaaatgctggcattccaggtgtgtgccaccacacccagccaaagataaggttttatataactttctcttgcataactttggaggagcagtgtagtgtagtgcaaagttatcaaactttaaaggacccaagaaatacctaggagattaatagctttttagggcccaagaaaccctctaggtacttctggtagaggtagtccagggacaatacctgggggaaacactggctttgaggttttacacagataaaaatacctacttcataaattagtgatggtgatttaatctatggtatctctacagctcttggaatacaacctggcacataggaaatgttcaaaatattccattcttgtgtgatgacttgggtggcaactaagaagcaagagaatattccttctttacattcaacaaaatttattgaattccagcagtattctagggatttgtggatataggggaaaatgggcacattcttcactcttgttgaatttatttgatgaactcattttaaaggtatagttcttaccttgttaaaaaataataaaatgactattgagcacatgtttgcataatcttttcccttgcaaattaaagttttattttttacttgaatgaggattgcaggtcaaagaaatgttctattatttctcagttttcttgttgctttaaatctatactatccaatacagtagccactagatacttgcagctatttaagtcaattaaaattgtataatattaaaaatacagctccttggtggcactaccacatttcaagtactcagtagccacatgtggctagtggctgctttattggacagtgcagatgtagataatttccatcatcacactaagttctgttgggacagtgttattctggagtgtgcaactacaaagcagtgattttccaattgtcttaatctgtagattgattttgaggcaagtattagcagtggcttgaggctgtcatttcagctcataagtgcattaatatcctttcaggttgaccaggcccagggctagtattgatttatcttaacagtttcatttcacagcaagtgagatctaaatgctaagacatctgggcattttctttaaacttctgagtaatacactaacgttattttactgcattagtcatagcttttctcatgcactctgtgtgtgtgtgtgtgtgtgtatgtgtgtgtgtgtagggagagagagaattcaccttcacagcattataattgttttaaatgtgcatgtaatgaaattttggggacaaaggaataaagaagagttggaattgcatctgaatactagaaatggtacttacatgaaataatttcttttatagaaaccaaaactaagagtagtgaaaagttggtttaacactgcttactcagcattctactgggtagaaccccagttatgattatttaaaaatattaattatgaggctgggtgcggtggctcatgcctataatcctagcactttgggaggccgaggtgggcggatcaactgaggtcaggagttcgagaccagcctgaccaacatggtaaaaccctgtccctactaaaaatacaaaaaattagctgggtgtggtggtgcatgctataatcttggctactctggaggctgaggcaggagaatgacttgaacctgggaagcggaggttgcagtgagctgagattgcgccactgcactgtagcctgggcaacagagtgagaatctatctcaaaaaaaaaaaaaaaaaaaaaaaaaaaaaaaaaatatatatatatatatatatatatatatacacacacacacatacacacacacgtgtatgtatatatacacttatacacatatatgtgtatatatacgtatatatacacatatatgtgtgtgtgtgtgcgtatgtgtgtgtgtatatatatatatatatattttttttttttttttttttttttttttttgaggtagattctcactctgttgcccaggctcactctgttgcccagaagaacaacagcaaaaactgaaggaaaaaaaggaggtaagacctatctgtaactagctactcatattcaggaaacagaggcaaaaactcaattgctcttgcatatcatttactgaactctgaaccaaaaaaatacattcacgacctagacactggaatgtagtgggggctactcaattttatatgcagattttaacaacaacaaaaatacagaagaatttatccttggtttttcaattactaaaacactaaatttatcatatatatatacaggtgtatatatacacatacacgtatatatagtatatatacacatatacacatatatataccatatatatagtgtatatacactatatatacacatacacacataaatacacatgtacacatatatatataccattatatatagtgtatatacactagtatatacacacgtgtatatatagtatatatacacatacacacatatatacacatacgcacacatatgtatatatacatatgtgtgtgtatgtgtatatatacatatatatgataaatttagtgttttagtaattgaaaaaccaaggataaattcttctgtatttttgttgttgttaaaatctgcatataaaattgagtagccgccactacattccagtgtctaggtcgtgaatgtatttttttggttcagagttcagtaaatgatatgcaagagcaattgagtttttgcctctgtttcctgaatatgagtagctagttacagataggtcttacctcctttttttccttcagtttttgctgttgttcttctctgagaagaaaggcaataagagactgctgtcatttggtcacaggtcagggattagtgcgactgaagtcattgaaatccttttgtatgttattgcctccttcaatgaccttctgtctttccaggtcacttacttcagcctctggtactacaacaagcaaaatcagcgccggtgggtagatttggaaaaacctttgaagaagcagctggataaatatgcattggaacctaccgtctattttggagtggtgttttatgtgccttcagtttctcagctgcagcaggagattaccaggtgagaaattacatgccgtttgtttttaggaaatagtctagtgagatgtaaaaagtgaaactaaggttgaagtcagaagataagtttgaaactttgccctctcgccccacatttttagccacggtgttacaaagagattctcatatgtggcatgtcagagtgttttactgcatgttgggtaacttatgggttcactaggcacaaaggaataattaaagggaaaaatgatggatttaccctctctgtgaactcttcttgtagtgatgttacctttaatgtttttgttgttttgtttctgatcttttgtaacaaggaaaggagagaagagattttagaaaattagttacaaaatctgtcttcattcctcaaggaaatgtgctgaaaggctcctagaattctctgcctctagctatattctgtagaccggttggggagggagtacagaggagagggagggaagtgtttaagatcaggaaattttggccaataagtgcacttaatagggacaaaagcagaaagggaagatgatattaaggagcagaatagaggaactaagtgttcttattctttttccccctgaagacaatgaaaaaaggaataaaatttgagttcttgagcctgcctttcaaagttctgtgaatcccatcactacctgacctttttaaccctatttaatgttacttttgaacgttaaatatgttcaaaaatgaagtagctgtgctacttcaagggcccgaaacatgctgcacgccctttcatctttgtgtcctagatctttctctcacatgtatttactggaatcctgtttgcctcctgagttgtggttcagaaggtacctcctccatgaagcatctatgaccccaggatagaatgagttttggcttaccacctagaatttgattctacttgtgttaagatggtaattgtcataccctgttattaggattgtccgtgtatctttttcctaggttttagcccatgttttctttagctttacttaatgatatcttacacagtgccttgcagatagtaagaacctggtactgtcccatgtttgtggagtgctgtttgagtctgccagttaatgattaggagagaatggaaagtcaaagcagtaggatccagtggtaggataaacacaaactgactgtaaaagtctgagatagaaatattgaagagaaaagtggaagccagaaggaaaaagcctgaactgatcactttaactcatttaaacatttactgaagatatgctctaagaattgtgttgaatagagtgggaggtgaatatgctttaatcccaccctggaggagctgctcacagtctggtggaattggcagttcatataaatagttacagtatcctatgataataaatgctttaattaaagctgtggattcctaggggtggggcaaggggaacttgaacaggaaaggtagagagactgacttttaaattgactttagaaatgttctagagggaatagtttttgcaaagcagggggaataatcaaaatgattacatgtcttcaggaagtttcaggtattacctaaggaggttttaaaaatagacattagcaataaagtcatggtacaatgaggaagagattttcaaatttaatggaatcattaaatttacatttcacaaagatcacccatcatagaaggtagatcagagatggcaagactataggcaggacaccagtttaggaatacctgtgccataatctaggcataggtttacaatatagaactgaacagaaaggcattagctggattgagagagaatgggcctattagagtcaatcaataggattgctcatcgattaggtataggagcacctgatagagaagttgtatcggtaaggattaagtatagctatatataacaaaaaccctaaatatcattgacttctgtgagagttcagaagtcagccttgcagagcttgtctgacagctccacagagtcttcaaggatgctcgcactttctcttagtgctccagcatcctcagcgcatccttcccatgcactaggttacctcttggtccaagatatccagagttctgtctattacatccatagtcagaaagcagatgagtggtttcctaggaatggggtaggaattggagagaaagattatgaggggtgcaaggaaacttttgcagttggtcagtatgttcctcattttatagtgatggtttcatggatatatatatgtgtctaaattgtacacttgaaatttgaacagcttattcgtatgccaattatacctcaaaaattgtgttctaaaaaaacccactcaaagatattggaagaaaacaaagggggagggccaggcgtggtggctcacacctgtaatcccagcactttgggaggctgagggggccagatcacctaaggtcgggagttcgagatcagcctgatcaacatggagaaacgccgtctctactaaaaatacaaaatatgtcaggtgtggtggcacatgcctgtaatcccaactactcgggaggctgaggcaggacaattgcttgaactcgggaggcggaggttgcagcgagccgagatggcaccgctgcactccagcctgggcaacaagagtgaaactctgtctcaaaaaaaaaaaagaaaaaagaaaacaaagggggagaacaacaatctgaataatacatcttcagaaagtgcagacttaacagaaaaatatgaccataaagcagcagaaaactgccacctgatactacaaaatgaacttaaaaaattaagaaaataacatgatatgaaagaaccatttaaatctgaattagaaaagcttgggaataattcgtctgtgtaacaggtgaatatgaaaatagctgcaaaaacaattagaaattttgaaatgatagaaactataaaagtatagaagacaagataaaaaatagatgtaataggattccctaaaggaaaaagccaaaacattcttctaacagtatgatctaaggcaaaacattggcaaagaacaaattccaaaaactatataacaaattgtatattctagctataacacattctaaaaacttccttgaaaggaaaatgacttgaagctctctattgaaaaggcatactgtgtacctggtatggtcagtccagagcaatcagcgccaacacattctgcaaagtcaccagaaattgggcatccagactaaaactgttataaaattaagaaaataagattggtatcagacttctggaaaaacacttcatgccaacagacaaaaaagtaacatttaacatcctcaaggaaaggaaatatgaggcaatgattatatatctagcaaaaacgacctgcaaatatatcttagcatgggctgccgtaacaaaatattatagactgggtagctgatgtattttctcagtttggagatctgagcatggttgaggtctcatgagggttcccttcctggcttgcagaacttctggctgggtcctcacatggcagagcgagcaaacactttggtgcctggagtttttacttgcaaaagaggacattttgtttcaattgtcgataatcatgcctcagataaacctcactggctatgatactaccactgcacaaagcttggaaattttgaccatcataaagaatacaactgggctgggcacagtggctcacgcctataatcccagcactttgggaggccaaggtgggtggatcacttgaggtcaggagtttgaaaccagcctagccaacatggtgaaaccccgtctctactaaaaatacaaaaatgagccgagtgtggtggcgcacgcctgtaatcccagctgctcaggagactgaggcaggagaatcccttgaacctgggaggcggaggttgcagtgagctgaggtcacgctactgcactccagcctgggcgacggtgagagcccatctcaaacaaaacaaaacaaaaaaaagaatacaactgcatggattaaaacataccaaatatatcttaaaattcatgaattcataatactttaaaaaaaacctcattgctcacctttgaaacttactagagtacaattcattactctgaatggcagtaagtttatcctatcttttctttatagactatataaagaggtaacaatcatcagtattggctaaaacctttgggtaaagggaacaggctggcatcatctgaactcagtgggcaatgtcagcgtcactgtaagtgggacaaccaaataccatttcttctgatgtgatgcatcaggaagtaccaggcaccactgatgaaaatgactaaaatgaacttgtatcaaagcaagcttccagtctgcactgttcagtaaggtagttgttagctacatgtggctaaagttaattaaaattaatacaattaaaaattttcttgcactagctacagttcaggtactgaatagccacatgtggctaatggctactatattgggcagtgcagatatagataatttctatcactgcggaatgttctgttagacagtgctgctctaaatctaatgattagttttcaggaaagatgtgagaacatgtaaacttgccaaatgaccccatgagactacaatcagaaaagtccagaaggcaggaaattctacatgacaaatggctccatttctgttaataacatgaaaataaaaggtaataaaaactttcttttttatagcaagagatatttagaaacatccattaaatgtaatctgtagaccttgtttggattctaatttaagaaaattgtaaaaatgcatttttgaggcaatcatgaaaattgcatatgaatcaggtattgggtattatgaagatgttcattttgttgggtgtgataaaaatgtagttacatttttaaaaaataaagcttaccttttagggatatgtactgaagtacttacaggtggcacgatgtctgggatttgctgtaaaacactggcggtggagggggcaaaggacaggatggatgcagaaaacgtggtaggcataaggttgatgggtgaggcaccatgataaggagatggggtgactatacttaatgtctctacatatgtttcagaatttccaaaataaaacttaaaaaataaaaatgccgatgcctacacattgccttctattactagtctaagaaaaacagatgaagaaaaaaggctgcctcttcatacattatttggaatttctgttgtgcaaaatggggtcacctaatttattatataattattgtcatatattgtatgaaatattttatattggaaagttgatcagtaacttcataaagatttagataaaatatttaatcagcatattttgactttcgggcaagtttatggaatacttgcttttgaatcaaaacgtgcaatttcttttattccttggctgacagttttgaattcaggtctgcatgttacattttattactgctttgtttttttcctgttatttcattcttcttgttgcttggttgccaggctggagtgcagtggcgctatcttggctcactgcaacatccgactcctgggttcaagcaattctgcctcagcctccaaagtagctgggattacaggtgcccacgaccatgcccggctaatttttgtattttttagtggagatggggtttccccatgttggctaggatggtctcgaccttctgacctcgtgatccacctgcctcagcctcccaaagtgctgggattacaggcatgagccaccgcagcaggcctgcaaaaatattgaaataacatatttataagccatcttcagccccaccaatatatagaaattttagcaaaaaggtttttttaatcactttagtagaaagtgataatgtcattgaagtgtaatttcttggccatctgctcctacagtaaatacttctttaagaaaaacgtatttatggctgggtgtggtagctcatgcttgtaatcccagcactttggatggccgaagtgggaggatcgcttgagctcaggagtttgagaccagcccaggcaacatagagagaccctgtttctacaaaaaattaaaaaaaatttagccagctgtggtggtgtacacctgtggtcccaactactcaggaggctgaggctcaaggatcacttgagtccaggaggttgaggctgtagtgagccctgattacgccattgcactccagcctgggctatagagcaagaccctgtctcaaaaaaaaaaaaaaatctatctgtctgtgtatccatccatccatccattcatccatccttagttgcttccattaaagtatttgagggataatacaataacatataataacaaccacttatgttttttactgtatgttagacactgtcccaagtactttattaatttaattctcataacaaatcctgtgatgtaggtgctattatctctattttgtagatgaggaaaccaagacacagaagggttgaacaccttgcccaaggtcacactgctagtatatactggaactgggactcaagcaggctggctcctgggtccttgctctcgaccattgtgttttgtggactgtcatgtaacatactaaatgaataaaaatactagaaatatctataactgtagatttgtcgtggttaagaacaagacctttgggtcattgagacctggggattcaaactccagctcagtctggctctgtgcatttgagcatgttgcttaatctctgagctccagctcttcatcacttaaaggtaactattattaaatagtggagaaagcaattaagagggatagtaatgagtgcgattatgcctggattttagctgtgagcttaatggcagccaaagcaaaagaagaaatacgagttccatcattcattatgtaacacaaagaagcatacctgtttgcaagcatgatacattttcctggtatagcatttaaacagaaactttgaggtgtgattttttatataagacattgaaccagaaatgaataagttagagcaaatatggaagagtcaattctcataacagtataatgtaaggcaaaaatatttttgtggaaggctacattaattgggtccaagtatgttgctttttcatgttttttgttttttgttttgagacagactctctctgtgatgcccaggctggagtgcaatggcaccatcttagctcactgcaacctctgcttcctgggttcaagcgattctcctgcctcagcctcccaagtagctgggactacaggcatgtgccaccacgcctggctaatttttgtatttttagtagagatggggtttcaccatgttggccagtccggtctccaactcctgacctcaagtgatccgcccgccttggcttcccaaaatgctgggattacaggcatgagccgctgcacccagccctttctagtgtttttgatttaaggaaaagtcctagaatatttagaatggaatatgtgaatagcatgttcaatagacagacttccctaaacacgctctccctcagataagcttctgaaaggagctgccatatagaaaatctcaagtttttctctttggtggatcccagaactgccagcatcccattagctatagagggaaatccatgggtttggctgttagcaggtggaaggagaaaagctggatccaaattcttcttacttgaatggatggtgttttggtcaggttctttggtaataaagaacagaggtttacatgtctgtggctgaaataagatgataaagactcatatgaaatgattaaaggggtgggctgtcagaggaattcaaacatgaactgtaactgggttgcacttcacaggcaccagatacggaggacagtttggattccagatggctccatagactgcactggcagagtgtctgtgatttccatttagtacggtatccccagcatctagaataatgcttaacatataatagaccccagtaattacctgttgagaaaataaataaaaggaagtagtaaatcttcactctagagctttatcaaaatggagaagtgagtggcttcaagtacgtgattgataagagctgctgttagccggctatgctcttggtccttcacatatattattatttgagtatgttcagtcctgtgaaggggtgatggtaccctcattttactggtgatagaatttaaattcaccagattatgacttgcccaagttcgtgcagaatactaatttggagagttcaggtctacttgactctaaaccttgttctggtaactgatgccctatatattgaaagtacaaacagggtggtaaacagaagtaaacccacattaccagatattaagaaagcatcttaacagctgttttgagggatttcatcagaaacattttaatatcagcctggtctgaaatatcagaaaccatttttctctggctttactttccagtgctagggaacttctaccaaacaaggtaagcaaactcttatattactaagttactagtcagagtttttaaagtaaagattagccactggctttccatttctccaactaaaaagaaattgtggggactgttttacagggcatgaagcagatgactaattgtcttataggatcgttttaattttgaaataactataatctgggataagtaattcatcacatatactttaatatgtgtaagtgtcatgtggttgaggactttctcatccttgtttgaaactgtctaggggctctgtgtggtggttcatgtccgtagtcccaacattttgaatccaagcactaggattgcctgagcccaggagttagagaacagcctgggcaacatggtgaaactcccatctctgtaaaaaatagaaaaatttgtcaggcatagtggtatgcacctgtagtcccagctactcaggaggctgaggtgggaggatcacctaagcttaggaaggttgacgctacagtgagcagtaatcatgccactgcactcgagcctgggcaacaaagggagaccctatctaaaaaaaaaaaaaaaaacacacacaaccatgtgggattaaggttttatttcactggtttatgcttctctaccaaattatggttaaatgcattgtatctcaatgagataatattgacattgaccttatacaactgacattttttataggtatcagtattatctgcaactgaagaaagatatcttggaaggaagtattccttgtaccttagaacaagcaattcagctagcaggcttagctgttcaaggtaaataagatcaattcataatgaaatggttctatcagattaaaatgtgttacaacaaaatagcaagggatttttaagttatctatctatatacatctttagtagtgtttatatattagtgaaatattctgttatctaaggggcttccttttgggaaaaaatgaacttggaatacctcaatgaaatatgagacttctggaagttaatcatgttataggtcaacagagcaaacagtacaataaatagaagtatgtatatatgtgtgtatacacacacatatgtacaatcatatgccgaatgacattttgttcaacaaaagacctcatataggacagtggtcccataaaattataacactatttttagcgtaccttttctgtgtttagatacacaaataccattgtgttacagttgcctacagtattcagtacagtaacatgctgtataggcttctatgagcaataggttatacaatatagcctaggtgtgtagtaggctatacaatatagcctaggtgtggagtaggctgcaccacctaggtttgtgtaagtatactctgatgtttgcacagtgacaaaatctgatgatgcctttctcaacacattcccatccttgacacatgactatatacatatacatttattaatactatgctatgtattcatctagttcaaagactttgtctgctaataggtcatattttaagaagaaagatatgccagtcagtgagtttgatgaggttatattcgcttacagtttaagtacacttcatatgtttggtttctttttatttatttcaataggtttttggggaacaggtggtgtttgcttacatgaataagttcttcttatttatttagttacttttttttttgagatggagtctcgctctatggaccaggctggagtgcagtggcacgatctcggctcactgcaacctcctccgcctcctgggttcaagcgattctcctgcctcagcctcccgagtacctgggattacagatacctgccaccacacagacccaactaatttttgtatttttagtaaagatggggtttcaccatgttggccaggctggtctcaaactcctgacctcaggtgatccacctgcctcagccttccaaagtgccgggattatagatgtgagccaccgtggctggctatggttacatgaataagttctttagtggtgatttctgagatttggctgtacccatcacctgagcagtgtaccctgtaccccatgtatagacttttatccctcaccccactcccacttgtttggtttcttaaatggttgtcctgaattatgcagtaataacatcaatcataatagataaagatggctgggtgcggtgtctcacgcctctaatcccagcactttgggaggccaatgtgggaggattgcttgagtccaggagttcgagaccagcctgggcaacatagcaagacctcatctttaaaatgtacatatataaataaagattctgcatttcaccagcatttttgaattgtttatttttttcatttttacatgtctgatatacatgtatttacatgtatgtgtgtattttcctttttttggagacagtcttactctgttgcccaggcttgagtgcagtgatgtgatcgtggcgcactgcagccacaacctactgtgctcaagtgatcctcccacctgagcctcccaagtagctgtgactacaggtgtgcgctaccatgcctggctgatttttaaaattttttatagagatagggtcttgctatgttgctaggctggtctcagactctttggctcaagctatcctccctccttggcttactgaagtgctgggattataggtgtgagccactgtgcctggctgggaagatttctgatggggcattatttcaaacaataactggcatttagccttgggagtgaaatttaatcagaataattattaataaaactccttcagctataagaaggcatggagacatgtatcatttttaaacaaatgcctgatgcacatggagccacattccttttcaaggtactttagattttcttaagtatcacttttggctttaagaattactttttcataagcattttgctgaattgtcaattttttaaaaaatattaaaaatttcaacacaaatatatcttgctgtaatatattcaagtggtctaagtctattccccagaggtcatcagtactgttgacaatttggtttctccttgacattttcctgtacataagcaagcatatatgattacagggtaggttttgtttgcattttaactgtaaaatgagatcatattacatagagcttgcaacttgtttttttatttaattcataggcatttttccaagccaagactcatatctgcctaattaacacttttaaaaagatactttaaaaatatactttatatagctataacaaatttgacttctgaaatattagcataccatctagatatactgcgtattgaattttgttgtgcatattttgcaatgaaatttaaatataattaacgtgaatgtttgtcattctatatagcggattttggtgactttgatcagtatgaatcccaggactttcttcagaaatttgccttgtttcctgtggtaagacttcttttgacactgggccttttaaaagaaacagtttattcctatacccttaataatccctgaaatgaaatccgtatgatagacttactgtcaggaataggattataaaaaaaaattccctcttataaacatctcaagtgtgactgctttccctgttgtagtcatcttggtccttgtgaacccacagaaactgaagggtctgtagtcactgcactgtgcctggagacatttgttttctatttgtgagtttaaaaagaaggattcattttcagcttctcaggaagcatgcacaggttttgcttttaactgaaggtttgaaaccttacaaaattatattgaggaatgtcgcttctcatcagcaatttaaaaagtagatgacaaagacactgccttctacttttataaagtcattactgatggaagggacatggaaactgcattgcaacaactaaggaaggtgtggtatgctgttctgagtgtctacacagtgccagagaacgcacaagatgtttttatcttgctgggctcaggactggctaactactgtcaccaacttgacataactcagctgaaactttccctggaattgagaaggtggggcaagttttttttttttggctcttgtgagaagccagttaattccttagaaagatgattacctatgtaaacaaagctcccatatagtaacaatagtcataattttgcctgatagtgacgagagtcattaacagtcaatggccatgattccttctaagaaattggggtgaattgtcacatacttaccactgtgtgttttcttcagggatggttacaagatgaaaaagtattggaagaagcaacccaaaaagtggccttactacatcagaaatacaggtaactctaagaaataagacatggaaatagcatagaaccaatgtctgcttgaatttgaaatattcaattaaatatttaatttacatgattaatatttatttgcccaactaaatttggaacattactgccactactattacaagtagccaacatttatatagcactcactgtgtgtcatgtgctgttctaagtaagcacttacccatattacttatttattgtccatgttttaccagtgaggacactgaggaagttgaaagcagccagtcattgaagggtgcccattttttactgcatgtagtaaaggtttgtttgataacctcaaacaaacctgtataggttaacgtaaaattaggatgatttgttttcttttatgatacagcttagcaagtacagggttacttccctctctatacctatggaagctgtgtctgtcacctggggagctatgctaagagctatggtgcttattactctgaactatgcttctgcatacctttgtatacttgtacatattgacgttctttcatgatgaatctctgtgttgcctgtaagaaaaaatactcttctggataatgctaagtcttattctaaaccaactaccacacagttccacatatagatgctccttgacttgtgatggggttaagtcctgataaacccatagtaagttgaaaatactctttaagtcgagatgtatttaatacaccagtcctgctgaacatcatagcttaccctaacctaccctacgtgttctcagaacacttatgttagcatacggttgggcaaaatcatctaacacaaagcctgtaatatattttataatgttgaatatctcatataatttgttgaatactgtactgaaagtgaaaaacagaatagttgcgtgggtcctcgaagtacagttcctactgaatttgtatcacctttgtaccactgtaaagttgaaagtcattcagttgaaccatcatcgtaagttgaggactgtctgtactctatcattaaattcttataactactcattaagataaacattattatctccatcttaccagatggggaaaccaagctcaaaaagattttgttatctctggctgggagcagtggctcacacctgtaatcccagcacttgggaggctgaggtgggcagatcacgaggtcaggagatcgagaccatcctggcaaacatgttgaaaccctgtctccactaaaatacaaaaaattagccaggtgtggtggcatgcaccggtagtctcagctactcagaaggctgaggcaggggattcgcttgaacctgggaggtggaggttgcagtgagctgagatcgtgccactgcactccagcctggtgacagagcaaaaaaaaaaaaaagaaaaagatttagttacctctacgtgtggtagaggtggaaattgaaagcagatcagtttcattagaacctattgcttatccccttccaaataaaataaacttttgcctctagtctctctccactcaaatccacacagtgactcacaaaagattaatctccctagaatatcagtttcctcttacctctctccttctccttccacgtgctcatgggtattttcatgctttctactagcccaagttcattaccctgggattaaaggcctcctacaagttggttaaatcctgccttcccagctttaccttctgctggacagcagaaccacatgaaccatttcttttctagcttaattggtccctcaggcacacattgtcctgccttttgtcacttccatttattcatttgtgcatttccttaaaagatagcttagtgttcttattctgcattaagcagaggaagagtgctggatgctatgacacaaagataaatagaataatttcttgtcttctaagagtgcattcccagccctgcaatatgagggctggcaggacaacccactatagtaattataatacatataagaagataatgagtgcagttagaggggtatgggcggaatgtgttgggactgcatggagctgcggcattggagaatcccagaaggtgatccagaggaaatgatgcatagacagagtcttgaaggatattagggattggccaggtccacaggtgagtcacaggcacaccaagaagagggattctcatgtgcaaaagcccagaggggctagggaacatattctatctgaagagatgcagagtttgggatggctgcagtgtgggtgccttgaggacagcggggagcatcggaagatgaggctggagatgcaagtctgcatgcacttgggcactcctcctttacccacactgccttcctacccatcctagtagtgttgcactcacctgagcaaaaaggggttttcatgtagcctcctcgtacccttattccctgcgttcgacatttagcacataattctcagtaatgcctcatattttgttgtttttatttttgtttttttttgtttttttgttgcccagactggcatgcagtggagcgatcatagctcactgcatccttgaactcctgggctcaagcagtcttcccacctcagccttccaagctgctgggactatagatgtgcaccaccatgcctggctaatttaaaacatttttttttttgtagtgacagggtctcactatgttgcccaggctggtctcaaactgctggcctcaggtggtcctttgtccttggcttcccaaggtgctgcggttacaggcatgagtcaccatgcccagccctgatatttgggataataagcaattacttggtggtttaagaaaagttcaagatttcaccctaagattttttagggagttgttttatcccccaccttcccactcatctgccttaagtatggagagcaggatctcatgtgataccctcagcattcagcacatactggttttcagtaaatagcaagattgatatagccaattatagatgcttagaaacgtgaaatgtttataatgtcttatgctaaattgacatataggttttaagaaaagctttattttaaaccattttaagcttgctttgtgaacaatcttgcttcttttgggttgcagagggctcacagctcctgatgctgaaatgctgtacatgcaggaggtagagagaatggatggctatggagaagagagctaccctgctaaggtaagtgtggcttggcggctggggctctttaaagttaggcttacaaatttgagaaaatcatggggaaatccaaggatgtccttatgtgcaaaggctgaggacgtgcaaaactctggaaacttaaaagctgaggtcctggtgaccaaagttttgtggtaaaacacattcccattttgtggttcatactttgaaatggtcttgaaatagagttcctaaggagggccaaactttttcaatttttatacttacctataagatcatagatctcattcagacttttgtcttcctgaatagttactctgtaggtcttcggaactttctacatctgggaaaccagtccagggaactctagcagcagttcctctgcatctgcttcctgggtgtttcttcttctgctttctccttgtaggatagccaaggaagtgacatatccattggagcgtgtcttgaaggtatctttgtgaaacacaagaatggaaggcatcctgtggtatttaggtatttttcttacctctttttgtatgttttctatggctcctgttggtgatacattttttagtacttacagcagttaaattgttcacaagtctataccaaggtctcattaaaaaatggaaataattcccttcctaggaaaaaaataccatctgaatgcaacagtccttttcaataagccgctttcttcaaaactctatgtccagagtataatgcctataatgacggcctattataaaatgcttaaaaatgtgtgaccctttttgtgccatatggaggccattctttgctttgatatgaatgtttaatttgagctctggtttccaaggctatttattggttaatttatttattgtgaggcaaggtctcactctgttgcccaggctagagtgcagtggtacagtcaccactcactgcagccttgacctcccaggctgaagtgatcctcccatcccagcttcctgagtggctaggactacaggctaatgccaccatgcctggctaatttttgtattttttgtggagacagtttcaccatgttgcccaggctagtctcaaactcttgggctcaagctatctgcctgcctcccacagtgctgggattccaggtgtgagcccactgtgcccagcctgaagggctctttcctatgaaaaatatagagctttgttttgactctagttttgtaccaaaattcctaaaataccagtatctaagcaaatttcaattattttttataatgttggttttttttgctgatataaaaaaagatactattcatttgtggaaatcttggaatgtgaagcaagttggaaagaatatatagcgatgtgctaatagtaactgactctgaacaatgaaagtacaggtgattttaatttcctttatagtattctgtgttctaatttgtatcttaaagatagtaagttggaccatattgtacaatcccctacctttaattccttaaaatctgttatctggaaaacccaaagttcatgtccaaccaaaagcttatattgtttttataaggcaggaaaacatattctatcacttctgttttttggttcctttgtgtctaccatttgttgagtgcttatcatgagtcagataaactatgctgagcattttttgtgaattttttttagtgtaatcttcataacactgtcagcagtaggtattaccaccactttgcacgtgtgataattgaggcttagaaaagttgtgatttgtccatggtgacccagttattaactggcataactaggactagaacttggatcctccactttatgcgtgggctcttaatcgctgtattaaacagcttttattctctccaccgcctactcactgcccgccccacaacacacacactactcaagctttctaaaccactcctaccatttcttcttgagaactagtttggcctttgaagagctttttctctaaactgacatctcctccctcacttcctttgctttactgcctcttgagccatgaattctccatggtgattatgacctcagagagtacgcatcacttggggagcagaaccccattcctagaatgcactgccctgggctgggtggctcccctttggcagttgctctctcgtccccaagccacttatattaacccttcccaacatgctgagttgggggtcagggagaggagaggaaaatggatccgtggcttcacctgaagagcagggctctgatggtgcccaaagtgtcacatggaaacttgaggcttctacctggcttcctttatcactggataggaattttcacagttgccttaatgtgatgctaataatctttagatttaacaaacaacggaatccgtactaagttgattttattttaatacatttaaaataaataaatctaatggagaaggataaaattttttcttccataattttttctttttataaaattctgtgattaataaaatcaaatattaacatataaaagctaatacgataaaattagaaagtataagattttgaatcctagtgatcacttccagaatagttcactctttgagttcctggcatttcaaatttatcttcaccctgaagcttttcagagcacacctcccccacttttgtgccttattttaatacctgcagcacttaaaagttcttgtttgcttctgtgttctttctcccacctttcccctccaactgtgcgaatttgagggaagcactgtaactcactaatcttagtgtccctaggacctactgcaatttctggcattgttataataggtgtcttttattttgttgaatgaataaatggggcattggcaatcagctaagagagggatcttccatcaagcaaatctgacacatgagaatgatacattttacatcttttaaattctcttttccctcatttattatacatgagtttactttttgaactagctgctgttacttcaattagaacattcatgctagctgattaaaaccactgtttttttttttcttttttctgttttggttttttttgagacagagtctcgttctgttgcccagactggcatgcagtggcacaatcttggttcactgcaacttctgcctcccaggttcagacaattcttctgcctcagcctcccaagtagctgggattacaggtgcctgccacctcgcctggcctagtttttgtaattttttttttttttttagacagagtttcatttttgttgcccacgctggagtgcaatggtgctgtctcagctcactgcaacctccgcctcctgggttcaagcgattctcctgcctcagcctcccaagtagctgggattgcaggtgcccaccaccatgcccagctaattttttttgtattcttagtagagacagggtttcaccatgttggccaggagtctgaaactcgtgacctcaggtgatccacctgcctcggcctcccaaagtgctcggattgcaggcgtgagccaccatgcctgacctagtttttgttttttatttgtttctttgtttgtttgtttgaggcagtgtctcactctgtcgcccaggttggagtgcagtggtgcgatctcggctcactgcaagctctgcctcccgggttcacaccattctcccgcctcagcctcccgagtagctgggcctacaggtacctgctaccacgcctggcgagttttttctttttttttgtatttttagtagagacggggtttcaccatgttagccaggatggtctccatctcctgacctcgtgatccacccaccttggcctcccaaagtgctgagattacaggcgtgagccactgcgcctgggctagtttttgtatttttaatagagacagggtttcaccatgttggccaggctggtctcgtgttttttgttttttgtttttctcaaaaatgttaccaaatgctaacttacacgtcaggcttagggaaaacttgtgtattctatctccttgtttcccccatgggcactcacattgccagttctctatttgctgttctttaggtggcatgacattgccaacatgtcccacaacaagtccttttttgcattagagctggcaaataaagaggagaccattcaatttcaaactgtgagtaaacattaggggtctgcatggaatgtttttcctaaaagttaacaagttctacttctgcgtgcctgtatgtgtttggaggcagggcagcattaaaatgataatattttgtaattgtataaaacatgcagttttatcatatagcattttgcaaaatggcagttagcaaaaaatggctgctcagtaaatgctgagtgaatgagtctttggataactactgtctgatcatgataacctttaaattaaacttcagggattatgtgggggagaaagtaagcactgatatcttaaatttcattgataaatgaatagctctgaagaaatgttatttaacagttacttgcttttgctctcttgacaaaggcaatattgagttactgagtcatatttttgtttaaaaatgtctttgagtatatttggcaagaataaaagttggtatttttatagtttttagattcccaagtcattttgaaactgtttaatatgagaatcacactgttagaacagattgttttgtcttcataaattaaatcctacttgtggtattcataccatgggcacagtgttggaaaatgaaaggcttatagtgttctgaaagtgactttgtcatatgatgtcacccattatgtctttagacaaactctgcattaaacgtatcaagttgtatgtgtgctttcatattgctttatgcctattttgtttgctaggaagacatggaaacagcaaaatacatttggagactctgtgttgcgcgacacaagttttacagactaaaccagtgtaacctgtaagtatgtcctgctcatggaaattatcaaaaataatgaatttagaaattgtaatcttgagtatactgtatcatcaagaaagacattttatcagttgacatcttttcttgatcctatagctgttttcctattttagctttggaccaacttgtaataactacattgtatgcctctaagatttatttcaactagttacaagaaccattgtaattcttgaaaggtaaaaagggaataatatcctttatttgtttaaatcaatcctctggtaagcattttgagtcattaaagattattcagcttttccagctatctgaagaatttttgcccctccttcctggtgtgcatttttcttagcccacatgggtttcttactgtttgccagatcaataaagcacacggtgatattgcacatataaaatattgtccttcatctatactcccctccagcctctgcaccatatctctgctttcctgaatagcaggtttcctcaagagagttgtgtatgcttgtatgtttccttccttccatcccattttccctaagcctccacgttactgatgctgcttgttgtggtcaggtgactttcgtccagtgatcatttcatgagttctctcacttgaccgctccgcagtactgatcctccgacagctccttccatccttctggaatcctgctcttcttcggctgccaggacaccaccccctgctcggcttcctctttctaggctgtttcttctcagtcacctttgctggtttggtcctgaggccttttctccaaatcctttcgtctagggggcttctcctgacctgtcctccccctgagcccccggttcaagtgattctcctgcctcagcctcccgagtagctgggattacaggcatgcgccaccacaccccactaattttgtatttttagtagagacagggtttctccatgttgttcaggctggtcttgaacttccaacctcaggtgatctgcctgccttggcctcccaaagtgctgggattacaggcgtgagccaccgtgcccggccctccttgagctcttgactcctgcatcctaccgcaagcatttagtgtgcttagtcctcaataccactctgaaagttgtggtgaatatatactactgcctgtatattctgaaggtagagctggcagaacttgctgatgaattggatgtggtatgaaacctgaccatttttaccactcgtgttaacagcttagtgctggctgccactacttctcatcagaatactgaggtagccttctgactttcctgtttctgtgccttcgctgcctgtagcttattttccatatgtcagccagaatgatcttagtttaacctgaatcagatcctgacactgacactcttcttttttttttttttttttttttttttggagacagagtctcgctctgtcacccaggctggagtgcagtggcacgatcttggctcactgcaacctccgcctcccgggttcaagtgattctcctgcctcagcctcttgagtagctgggactacaggcacatgccaccacgcccagctaattttttgtatttttagtagagatggggtttcaccatgttggccaggatggtcttgatctcctgacctcgtgatccacctgcctcagcctcccaaagtgctgggattacaggtgtgagccaccgcaccctgcccagatcctttcactcttcttaaccctcctttggcattccacttctttttttaagtaatttttttagtttgtttttgagacagctctgtcacccaggctgagtacagtggcatgatcatggctcacagcagcctctcaacctccctgggctcaggtgatcctcccacctcagcctcctgagtagctggtaccacaggtgtgtacctggttaattttttggtgttttttatagaggcaggatctccttatgttacccacaccggtctcaaacttctggactttaggaatcctcctgccccggcctctcaaagggctggacaggtgtgagccaccaggcctggccccattttacttctaataaaagtacgaggccatacacagtgtggtccttgcctggtttcaaccttatgtcttttatcctcctccctgcttgctctgttccagccacagtggtatcctggctaggctgcagatgtgcctcaccctaggggatgctgtccttgctcttttcccaggtctccacctgccttgctccctcattgcagcctgctgtctggtcagatatgaccctcttcagaggctgtccctgattgtcctatggtaccccccttccactatgatctgtctctttaccctctaactttgttttgttctttatagcacttagcaccatgtgaatttctatatttgtttgtttgtttgtttgcctgtatcccctgccagcaggttagctctagagcagtgcttgaggacagacactcttccctgccttcagtgctatattccccatgccaagcaagggcctggctcactgtcggccttaatgaatttgttcagctaatctatagatacaggtgttaagagctctgattcaagatgtcttggtgctgtaagatcccttaggaaaatggtacgtcacccagaactgccaagataggaaaggctacccagccaagtgacatctaagctgagacccgaaatgttgcactcaattcccacaacctttctttaagctgtcctcttgtccctggtccatgtctggaggcacctcctggagctccctcccacttggccccccacgccctatctcatctgtatgcagtcagtcttctggatagataagcaaaatatgtagcactgctcttgaagttacatgtcaggaacaaatctgagcatgtgcctctcacccgccccgtcctgggtacaggattaagggcagactcctgaggtccttctctggacttagctgccccagcccagttggccttggagtctgactccaggaaggcatctttccttatcatgtgaatgcccccagcccaggcctttgctaaaatgcccttccttcccttctctgacagactcttagtcattcttcaagattgagtttaaaatacagcccccatagacaccaccaaacattcagtttgcttagtccttgacaccactctgaaagttgttttttctacctcttttataacaatgacctgaataattcataacaataatttagtaaatgcttgctctgtgtcaagcattatactgagagcttttattttctttaatccttacagtaaccctgttgggcacaattattactatcccattattgatgaaggtatggagacttacagaagtgaaatgtcttgccctgccacacaactagtaagtggagcagcaagactcgagcctgtgctcttagccgctgtgctagcctgttagagtagttcctgcctgcttttttcatattgacagatatcaactgacagatcattttcatttgatctgtctctcttgtttgatgaagctccatgagggcagggtctcctcttcctcatcttcgtgtcccctgtctggcaaggtgcccggtgcataagggcttagtgaacaatgggagccggagtgtggcagtgatgggagtcacaggggagaagagcacttttgctcctttgtctcttccttttattacagattgtaaatgaggcatggggtggaggcaaagtctaacaagggcattttgtcccttagcaccaggaaggaaggagaaaggctgtggaagtgccttctgtcttgcagggtgtgagagaaactctgggcaggagcagcagtgtaaagataacatgcggggatgcccacccggacggggagctggccagtggtttgcatgtatggcccagtccctgtctcttctctgccttcccctgcaccatgtttgcatccgagtccccatcgctggtctggtgatgggattttcgtaagcactgacagggaggaggaacctgctttctttgtaaatatgggaagcggtttctgctaggggcctgggtgtatttgcatatgaaagtgttccccctggtggtgatattcagtagtgctacttgcctttggggttccctggggctggcctggttatccagccatatgtggcatgatttctatgcagaagtaagttctaagattcaagcagtagataatgcagtctgttggaccacagcattttcattttaaagactttaataagttaagagtgttcataatattgagccattattacctcagtttgtttcttctctggaaaatagtggagagtctacattttgaataaaccataaaacataatccctttccatgaggcatccatattggttggtggttagtgcctgttttttgtttgtttgtttgttttgttttgtgtttttttttttgcaaattaacaacttgtaataagtaaaagagggaagagggaaaagcaacaaatgattgattatggtgaatgagtcttagaaattcagctctagtttttggaatattgctatttattggcaagtgtgaacaaaactacattaatgtcatcagttgcatatgctatacctaaataaggaacacctgaatctttttaaaatggaatagttatgtttaaagggctgttttccaaagtttgctttcaatctctatatatccaatagattgtggcagtcgatttccatgagctattcctatgtaattacttatgattcattctgtagggaactaatatatttcattgtgagcgtttgtttcccacataaagtaaatgaagcttttaatattagcttttaaaattttgcttgataataaaatgaaaagaactttaattgttatggccatgttttaaaggctctcaatatagactgtttagtcatgttccaatattatgattctgaagtattggtagacttgttgtcatgggccagatgggtaaactaaagcgtgataggcatttaacaaaactgcccctggcctggaactggacggtggcttctggacatctgctttgggctggggtgactggtggcccaggagatagactcgacttgcacagaaaggggaactgtaatcccagggtgtcccctttacccccagtcctgatctattgtagtttattgctgcttgggatggccttatgtgactcatctaatcttgacccagataactatattttagtatttatacaatggcataatccaacagccttctccctccaccccctaacaaagtgcattagataacagaatgatcgttatccaaaccttaaaaatgttagatggataacaatctgtcttttaaaattataaagtgaggatattgagacttttatacttaatattcctttatggttgaattgggaattaaatgacataataatgtcaacctgttagatcagaaatctgcttcaaacccactgtctctcactctaagccccagaactggtcatgctgtaagcaccctccctgatttatataaggaaaatgccgagagagttggggagtcatgagaggccccttggtgtaggtggctcccctgctcttttctgtgaggaaaagggaggatggtatccttcaacctgcaaagccaagtgatagagggttcaagagactttctccagaagggaaacttgtatttcagactgcagcaggccactcgctgagcgcagtgagatggctggtgagtgctccctgcagctcaggggtgttggtgaacatagcagccggtgtccaccttggttccggagacttttgtaatcaggagactgactagagtaggccctgcctggaaagggaaagagtttacccatcttcttggcctactgcagggcttgaagagactataggaagtctggaagaagatggagcagcccctatcccattccagtcccctgagccccagaagtgtagagaggacccagtagttcccatggatccatgtgaaggagcagggcaggaagaggtgggaggggagaggaggagcagccacaaggccaaacagtgggacctctgggtatggggacatggacccctggtggagccgaggagaggcagcggctttttctgagtaggttcttatatggataaaggtcagtgtcaccctggaaaaccacacatgtcggccggtcacggtggctcatgcctgtaatcccagcactttgagaggctgaagcaggtggattatctgaggccaggagttcaagactagcctggccaacaaggtgaaaccccgtctctactaaaaatgcaaaacttagcctggcgtggtggcgggcgcctataatcccagctgctcggaaggctgaggcaggagaatcccttgagcctgggaggtggaggttgcagtgagccaggatcgcaccactgcatttcagcctgggcgacagagcaagactccatctccaaaaaaaaaaaaagaaaaccacacatttcatggggctggagtgacactagggcctctccctccatcagtattccttcccagttacctgagatggtctctgctggctttgttcctctcccatcccacaatgccaggaagctacacctaaggcggggtttggtaggggggtgaacagtggaagcaggcatcccagagccaagtcagtgacctgtaagcagcttggatgcagccctggtctacccaagtgtaggctgggaggagagcatttattcttccttacccttactatagtgagctcaaaaggtgtaagtcattgagacaaacatttgctaggtatttccaccatctaacacttttatttatttatttttttaaagagacggggtcttgctctgtcttccaggctggagtgtggtggtgtgatcatagctcactgtaacctcagactcccgggcttaagggatccactggcctcagccctcagcttctgaagtagccaggattataagcgtgtgccaccatgcctggctaatttttttttttagttttttagagatggggtcttgctgtgttgcccaggctggtcttaaacccctggcctcaagtgatcctcacatctcagcctcctaagtacctgggattacaggaaggaatctattccttgaactatctattagtgcatgagctttcaatggcatctttttgtttatcaaaatcttaactcccttacatcgtataagaaaggaaacttacaaagcaaaattcagacgaggcttagaaatacaagctcagctgtaaatgcttagtaataagcatcactttagtcctcacttgttagtcactcatttgctcagcaaaggcaccagggataccacatcttgcctccacggagcttacagattagttggggttggggagcaggttggacacatgattgttagacacatacactcaggaatctgacagacctgctggttcaaatgccggttctactacttgtttgccatgtgaccaggagcaacttactgaacttacgtatcactttccttatctgtaaaatcaggataataactggacctcccttatgggtttggtgttcacattccacgagataatcatgtacagtccttagcacagtttcaataaataatattgattttacttgggctggtagacttttttcttttttttaaagacaccaggtcctagtatcccagtttcccaggtagaatatggtgggaattcgcagatgggatcgtagtgcactacagccatgaactcctggattcaagggatcctcctgcctcagccttccaagtcgctggcactacacgggcatgtgccaccacgcctggctcagcctttttaatttttattttgtcttctttggcacacagattctagtgatttcttctcagttatttagcagcacccatcaacatagtaactgcccaaaaagtttggaaaccacagccaacagttacatggttttctcttgtatgccaagctgaggatagctggtctcagagtaaactgcatttataagaacaatgccaagaagaaagagaaggttagactattagaactgatggcgtggctgcctgggtcaagcactttggcaggtacacgcttttgtagtttgttttcttagtagagccggctactacagtgggcagtgttcgcctccacactgggtgctgcggcaagagcgccaagataagctctcagtgtgggagggccgcccatgtgctgaagctctgcatccttgggttttgtgttttatttttgccccaggctgggcaactgtagacatgttgttggagtttgttgacagagaattctgttggcaatccttgtgaatttgtagtactttaaaagtttcttaagttcagtccatctagacagtgagtctctgctagactgaacacagggttcagaggacccagtttgcctaaacctagtcctgacaatgaagaataaccagagacaaagtaaatttcaaggctgcaaaaatgcagcgtcttcaaattctgggcactattttttttttttttttttttgagatggagtctcactctgtcgcccaggctggagtgcagtggcgtgatctcggctcactgcaacctccgcccccttggctcaagcgattctcctgcctcagcgtcctgagtagctgggattacaggcgcctgccaccgcgcctggctaatttgtgggcactaattttaaggaatatattaatgtgcagttaaggagtattttttattttttattttttattttttaaaacccagacacgccatgcagacttgtgtcaccaaaataaatactggaagaatggaatatcttttggaaaagagacatttatttttcattaacagcctgaatactttccagtaacaaagaaatgaaattatttataaaagctagtaaaagcagttgtaatcacctgatgttaaaactagtatgtactagttttctttttatctcaagagtcttataaaaataagctaatattcagggtttttgaatataagatactagttttcagagtgctaagagtaatattaatttatgagacatgaggcttgatattatggtaaatttgcttaaatggattgaatattcactttgtcatgatggattttctagtaattagtccttagaacactgtaaccaaaggtcacaaaatatttttgtaatcagtgattatgtgttacataagtacatgaaccaggaataggtggtaaaaggtataagaaaaagtgctttgacaaaactacatgtcatcaacaaagccaagaatccagtgtgtttaggttcctagatcttgcagtaaaactgaccacacagaagaaaaaaaaatcttgcctttatttgaaaacaatagttacaaatgggcttttctgtgtctgtttcctttttttaccttattgtttttttaaagatagaacttgctgtgtgagtagttgaaaatctcacattatcacattagtgtttgtcagcactccctaatacgtttaggtacttttttttttttttttttttgaggctagaatctcgctcttgttgcccaggctggagtgcaatggcgcaatctcggctcactgcaacctctgcctcctgggttcaagtgactcccctgcctcagactcccgagtagctgggattataggcacccaccaccatgcccagctagtttttgtattttcagtagagatgaggtttcaccatgttggccaggtggtctcgaactcctgacttcaggtgatccacccgccttggcctctgaaagtttgggattacaggtgtgagccactgcgcctggccttaggtgtttttttaaaaagtatattcaaaacaaatcagaaatttcttgcaaagaaaggtaaatgggtttaccatcggctcactgaaccaagtcttgtgctttgctttcccttggttccttagaggaaatgtagatttaaaaaatacgtaggtttgaaatttttttatatttgagttttttaaaagatggggtctcactatgttgtctaggctggtcttgaactcctgggcccaagatgctcccaagaggcgggtctacaggagcatgcttactgcacttggaaatgtagattcttgtcactaaaatcataaattcatttcttcattatgtttgtagtctgtggttaacagacttttaattaaaggcagttcttactgcttgaggcttctgggttgacagtggatggtcccccgggaggaaggttagtggagggacccagggctcccccagcgcataggagaaacacatttgcatttgcactgaatccagcttctcctgcgacaagtgtgtgggtgatgtagccttgtctctttccccactgcttatggctaatccagaggtttattggatgggcctgggaagtatgctctgatccccttgtgggtccaggcgatgatgctgtgtggggagcctgaaaccacagggcaggttgacgggttggggcagcaggaaagggctgaggccccacgggccgacagagaacctcccttcttttctttgacttcatgacttagatagcttgtctttttttttgcctgagaagatttattattttacattcctatatcttgttttggtagaatttaagagagagtgtgtatgtgctcttctcagagtcatcctattttataggcaaactcagactgtcacagtgaacccaatcaggaggaggtcttcttcaaggatgtctctggtaagaaacaaggaaaatatgattgcttttttattttagtgatgtttttcctgaataaaatatgctttcaatgctgttaattttgagtttgaaccataaaagtgtattgatatttcatcatttttaaccaaagaaatggtaattttttcccataggtccaacctaatatttatattattatattatacatatttgaatattaggtctgaccttaatattaagaacttagactattggccaagagtaatcctaagttggtatatatttaaaatactagatgcctttaataagattgactataatacctataagcttcttatgttgaaatgtttctacaaggaaatgtgtatctattgcttcttgctcttagctttttagatgcagattttctggtggagcctaatgtccttggtatcagtcatagggcttgacattgccatttggggaaacagaaatgctagatatgttaagaactactgtgtcttcatgtttattttccatatataatatatttaattcctttagaagtttttttaacagaaagaatccagtggataataactttacctgtattacataagcaatgtgtttcaaccctgtgtcaaactctccatttcttagcctaaaccccagccctacgtgatgcctcccccaccgcagttgcactataatggacattatacagaaccatatgcttcttcccaaggtaaagtacactgtttctgccatgccttacatagttatgactatggataaatctgtgaatgcttggagatcatgaagcctggacagtttttggctgaagttgcaccccaaattgcatcatgataatagctatcctggattcataaaagaagccaatatattgttttttgtttgtttgtttgtttttttggagacagagtctcaatgtgtcacccaggctagagtgcagtggcgtgtctcagctcactgcaacatccacctcctagattcaagcaattcttgtgcctcagcttcccaagtagctgggactacaggcacgccaccacgcctggctaatttttgtattttttagtagacatggggtttcaccatgttggccagactggtctcaaactcctgacctcagatgatccaggtatatttgggttcttgaatgtatgtaaaaacatgcagtatcaaattttgatgctccactggtctcaaatttggccaatgggaaactatcaagctggttcctgtgtccttttaccaccaccctattagcctttaagtgcttctttgctatctgacaaagaattcccagggttacttttctttccctgccagaggctttcctattgtaaaagttaaacacatgactactgcagttttcacatgagaagtataaggaattgtatttataacaaacccccaagctgaagtttaagcagtcaattaacatttactctatactctctctgtatggggctataccaaatgctaaggaggtttatgcagatgagtatttccacatcttaagaagtttatcttcagcctggaccacagggccagaccctgtctctaccaaaaaaaaaaaaaaaaaatagctgggcgtagtggtatgcacctccagtcccagctactcaggaggctgaggtaggaggattgcttaagcccaaggtgggggtggaggttgcagtgagccaagattttgtgctactgcactccagcctggatgacagagggagactatctcaaaaaaaaaaaaaacaccttagaatctaatagtttaagataagacaagtgcacaaataactttgtctttctcccctgaacccctttttcgtggagaatggggtcttgctatattgctcagggtggtctcaatctcctgggcccaagctatcctcctgcctctgcctttctaagtgctgggattataggcctgagccaccactcctggcacaaataacttgaatatgatagtttttctgagacagcatgtgcaattaccatgctcctcagtggaagagagactcatcacattggggagattgagaagaactttctgtatctgaaaagatgggtggatttcagcaggtagaaaggcaggaacttgactggggttgctgttcctagttttggggatagtgaacgccaggcacagaatgaagcagggtgtgtttggagagtagagtggtccaggtttcctctcgggtaaggaactggtagggagtgatgcatgaagggaccagaaggtgggatgtgactgtattgtttgtgtcggccctggtgtaaaagatgagggttttcatgcagtgaggtgggtagtagagagcagggctttgggtgtagagcctgagagcatccccctcaccatgttcttgtatttcctccctcttgcaccctgcccttgtctggtatttgcaatcccggcccctcccacttccaggacctggctgtcctctgcattgttagtctcactttgccactcattctcttccctctgtctataaacatcttaatattgttcattctcctccctttaagtaatggtttgagtgatctgctttcttttctcactgacttttttttttttttttttggagacggagtctcactctgttgcccaggctggagtgaagtggcgcgatctcggctcactgcaagccctgcctcctgggttcacgccattctcctgcctcagcctcctgagtagctgggactacaggcacccgccaccacgcccggctaattttttgtatttttagtagagacggggtttcaccgtgttagccaggatggtcttgatctcctgacctcgtaatccgcctgccttggccttccaaagtggggattacaggtgtgagccactgtgcccagccctttctcactgacttataagagtactctctgtgtgctgcttctgcttgctggttacccgcccactcctctgtctttgccactctgttaaagcggccctctgggagcctcccagcacccccacatcccctcaccatcacattcaagcctttgtaccttctggaaactctcctggcatgctaggtttttccctcctccttcccatcagtattgtttggtgagctctgcaggtctgtcctgtggctttttccctccctctgtgagcttcccagggatctcatctacatttaacatttcttttcttttcttttcttttcttttgagatggagtttcgcttttgttgtccaggctagagtgcaatggcatgattttagctcactgccacctctgcctcctgggttcaagcctcagcctcccaagtagctgggattacaggcatgcgccaccacgcccagctaattttgtatttttagtagagatggggtctctccgtgttggtcaggctggtctcaaactcccgaccttgggtgatctgcccaccttggcctcccaaagtgctagtgttacaggtgtgagccactgcacacggctgtgtgcaggatcattcttttgcctggtgttcgagactccacacaatattccctgagcctgcccttccaaccttacttcccaagttattttactcctctgtagctatctgacactctagccaccccagcttgcccaggggtgcaccctggctttgccagtgccgctctgcaccctcaggtgcccttaccccatgcacccttccgttcacatgctgccatgcagaccggataggcagggctatgctgtgctgacaaaatactccattccaaactctcagggaagtaataataaaggtcacctgtccgttgcacactgtactagcaggagggctctgccctgtctgagtctgccgtaggggcttgagctggagaggctcttctctctggaatgttgttggtcagtgttgcagttggaagagagcctggaagctggcttttaaccctctgtgcactttcccttgaccattactagtcgcattgttgtgcctgatatcaaggggtgaggaggggtaaccctgcgtgctctgagaggtggagagacctcacttctgatggaagctggacacgcccaccccacccacttacccctcaagtccccttaactgccatatcttgtgaggtggttcttggttctctcttccttgtccccatcaacccaactcaggctggaaatgagcatttcttcctctggactcctgtaacccttcatctcttctcccttccttgaattatggtgatttcatgcatacctttccccttttcttgcctgtattccaaccatcttttcctccttctattcttagtattgccttttccacataacagtctcataaatggctagatggtttgtggggtgcagaagcagggagactaggtgtatatagagctagttcagacaagctggggtaggggcccgagctgtggcagcagtgaggaaagggggattgcagagatggagccatgaccaagctttgcataaatgaggaaagcacagtgacatggaagtgctgtgtgtcagcagaagaataccatggagatttgagtgctatttcctcacagctgcatgtgccaccagaataaagtgtacccactggattgtggtgtattacttaagtatcaccatgatcacataaatcaccatggagctttcgaagcacaaaaagaatgcctttcagaggaaattgttatttgaaggagttggctgctgagtgttagaaatcatctagggttagaaatcatcctcagtaacagagggcaggtgagctacaaattgactagaagaaacatggcccctgtcatccctgggcagggacacatgcatagctattttaagattaggttaaactgattctgttagctgcaggtctggatcttcctgaaacatgggggccagggcagggggcagctgcagctgtttaatgtggctcctcttggcttctggacactttatgggctgtgtggctgctggtgacactgttggaccagagaagttcagatcctgctataccattacccttttacagtcgaagctctcatattcatttgggaagaacaataaaaatttccagttaaggaaatgcttacagacagttggtgcttgaactagctcagcagcagcaaggccacatccctacccagggaagaaaggcagagtccccagcccagtgccttgaatggtatctctgcctcaacttccccagagttccaaaaagtctgctagtctgctgtgggtgtggttcgtttaagacagggtctcactttgtcacccaatgaatgccaccccttaagtaggcagagccatgcccatcctatagatgaggaagccgaagctcccagggtcactcagatagtgtggctaaagctaggtcattctagcggggatttttacaagctgtgttaaaaatgtcatcagaggtaagggccgatctcagtatttggttggagtaattagtccatttaaaaaaatctcattttgaactcattttttctagataacctctttgtgcccaaccagaacggatactactgtcactctcagacaagcttggatagagcccagattgacctcaacggtcggatccgtaatggcagtgtctacagtgcacacagcaccaactccttaaataatcctcagccctacttgcagccctcgccgatgtcgtccaaccctagcatcaccgggagtgacgtcatgaggcctgactacctcccgtcccatcggcacagcgccgtgatacccccgtcctaccgccccaccccagactatgagactgtgatgaagcagctcaacaggggcctggtgcatgcggaacggcagagccactcgctgcgaaacctcaacatcggcagctcgtacgcctacagcaggcccgcggcgctggtctacagccagcccgagatccgcgagcacgcacagctcccctcgccagcggccgcacactgcccgttcagcctgagctacagcttccacagcccgtctccctacccctaccctgccgagcggcggcccgtggtgggcgcggtcagcgtgccggagctgaccaatgcgcagctgcaggcgcaggactacccgtctcccaacatcatgcggacgcaggtgtaccggccacccccaccctacccgccccccaggcccgccaacagcacgccagacctgtcccgccacctttacatcagcagcagcaaccccgacctcatcacgcggcgcgtgcaccactcggtgcaaacgttccaggaggacagcctgcccgtggcgcactcgctgcaggaggtcagcgagcccctcaccgccgcgcgccacgcgcagctgcacaaacggaacagcatcgaggtggccgggctcagccacggcctggagggcctgcggctcaaggagcgcaccctatccgcgtcggcggcagaggtggcgccgcgagccgtctcggtgggctcccagcccagcgttttcaccgagaggacacagcgagaagggccggaggaggcggagggcttgaggtacggccataagaagtccctgtcggacgccaccatgctaatccacagcagcgaggaggaggaggacgaggacttcgaggaggagagcggggcccgggcgcctcctgcacgtgcgcgcgagcctcggcccggcctggcccaggacccacctggctgccctcgcgtcctgctcgccgggcccctgcacatcctggagcccaaggcccacgtcccagacgcggagaagaggatgatggacagcagccccgtccgcacgaccgcagaggcccagcggccctggagagacgggctgctgatgccctccatgtcggagtccgacctcaccacgtcaggccgctaccgagcccggagggactctctgaagaaaaggccggtgtcggaccttctctctgggaagaagaacatcgtggaagggctcccgcctctaggggtaagccacgcggcgagcagtgccgggccaggggaccgcgcgttcgccctggcgcttctttcactcatcacgtcccgtgtttttcagctcctcttgttcttttaacgttcttcattcccccacgtcactctctttttgtctaattctgaacacatttaaatttatggaaatcatggggatccacttgaattttagtggttttactggagataattattatagatgaagtgaaaaggtaaattcacagggttttgtcgaaatggaaaagatgaatgaaatgttttagtaatgcactgttaagggaaagacagttaagatttcattactttagccacgattgctttagccacccattaaaaatactgtgggtgatgtggcaccccaggggtgcatttgtttagtttgctcaagagatatctgaaaaaagcatccaggaaagtgtacccaatcctaatataattctccaggttggagtgtgtgtggatacagcttacatatcttggccgtgattctccagagtgattctggagttgggaaggtggcactttgttaaggcaaatcctgagacgtccaggtttcttaaatttaaaagaaagatgaattcagctgagaatctaaggaaagtccccggtagaagatgcagttctttaatattcagcctaataaataaatatgaattaagcactttttacctactttgaagcaaaatataaaaaagcatagtagcatcatctctagctaccatccttggagcatttgccatgggccaagcatttcctctacttttgtggcctatttacagtaagcctattgttatgcctgttttacagatgaagaaacagacttagatattaactaacttttccaaggtcacatgactagtgagtgactgaactggaattttaaacccatacttagaagcccattctgttatcatctacactgtagatgtatgttctgcattgaagtatactgtatatgttctattaagtcataattgcttgttgaagccttgctagtctttcactgaaacttttaaactcagtccttaacctgggactaagcatctgcggccttgtcatgaagtgtgtccaccgaagtgattttgttgcagtgctcaggcttccagctcttcctggcccacatctccactcctcatgccctgcacttgagccaggctaacttgattagggcctccatcctttctcctgttggcttccagtgtcctggcaactagggttctcctccccccatcgctgctaaactgcaaactccgacaggacggctcatctcaagtgtggttctggcctagtgtatgacatcctttaagatgctgcaaacatcttgctaaacaggaaaaaacgcacactattatagtacttatgaaagagattaatgtacatagacaaaaactacttaacaaaaaaagtaccacagatttaaatttgcttttttttttttttttttttttttagaacagtcttgccctgttgcccaggctggagtgcagtggtgtgatctcagttcactgcaacctctgcctcctgggttcaagcgattcccctgccttgtgatctggctgcctcagcctcccaaagtgctgggattacaggtgtgagccaccacacctggcctaaatttgctttcttttaataagttttgggtttgaattttaagttgatttttaaatttttcacaagtatgcaacataactcacatccctgaacagtaaaggccaatgccttcagtggacacagatttaagagtgtagggagcagtgattcaggataaggtgtgggtagattttccaaagtaactctacctgaatccctgagccagctggacagggtccttttatagttaacacccttcccattgcattaagaacggtctgtttttatgtgtgactcacgtactttccccaaatgctatctgagtacagctcagtactcaggcctattttatccctgtatgttttgaatggggtctggtaggttcagttaaatctgaggactttgatcaatttggttctcttaaaagaacttttctctcccattgacttttaagaccacaatactagtaaaattatgtgattggattatgtttttggtcctttttgcttaaaggattctacttaaggaatgggtatggcagctgtggtcacgaggaaagagcaaaggtcctacaagttaagaacgttggggctgagtctagagcctgccatttgttagttctctgtgaccacggtcaggacccttcatgcgtcagaacctcagcttccacatcagataacctcagatcatgaggacggtcatcccttcgctgcctgcttcgtggcattatgtcccacatgcagttaggcatgaaaaaatgcctcctgaattacatgattcagtgtaactgattttaaccaaagatttgcttttatttgttttgacactgattaccttgtaaaagaggcagccatgtgacctcagacaagctatttaatctgtgactcagtttttacatttgtaaatgagaggaccccagagagttgttggggggataaaaatgaggttctggcacattgaaagagattagtcaatattaacattactgtgaggtggcatcatatatttaacttaatggctttcaagagtggaagaggccaattccctattgtaccctctgacctttcatagtaacatggggttgccattatcttaatcgttacaacaaatttcctaatgtgaattaaggttatggaggtttagtattaaaaacagtgaaataaactgtagacaagtaggaatgattttagaattctccacccatctccacctccagcaacctgattgttatcttaaaggcagactggtttgggtgctcatatatctacataaagattttctttttgttgtaccctttagtgcagtggttctcacataagaaatcactgtgcagggtatgcattaaaatcctgtgcttatattctaagggctaattaaggcatattcaaggctagttttgactacatacaacattcttccaatactggcttttgaactgacctcacagccaatcagctttatccagcgtgtcccagtgtgggatattttgagtcattttcaggcagagaagtgccagagctagttcatattgactagcaagagccgacttaaatgttcaggaaccttgtgagccaattgatgtgacattaacagtttgaaattggctgtgatgggagtatttacaccatggatatgggcaaacaccgatcaaaacttccttccaagagcctgttgttaaatattaccagcacatcactgttttctgcacgttagaatcattaaatttcagcctaagcaggaagtgtttagtctgtatgcctgtgtctggatatatctgtctctttctgtctaggtgaggcttacagaggaaaggtgacttgcctgaaagaagttggtcagttagaggccagatgtgaacccaggcctctgctgtttatagtctagactgcattatgtggggagctcatgatcaaatattaattataaaattaaaaattaatccacttagcttattgagttaggtaccaatcacagtctccaattacagcagcaatcttttaggatttttttcctctctcaccaagttgccttttccctctgttcttgcaccattatcatggggcttcatggcctgttacaggctgagagagctggaataacacggattttgtttacagggcagaaccattattttccagttggggctactcattatattgatatcatccaaggaagtgtagtatatccaacgaaacttagtgttctttttttttttggagacggagtctcactctgcctccaggctggagtgcagtggcacgatctcagctcactgtaatctccacctcccaggttcaagcctttctcctgcctcagcctcccgagtagctgggattacaggcatgtgccaccacgcccagctaatttttgtatttttagtagagacggggtttcaccatattggccaggatggtctcaatctcctgacctcggcctcccaaagtgctaggattacaggcgtgatcccccgcacctggtcaacttagtgttcttatgcttactattctcagagaggaaaatcatgctctaataataattttaggaaacacttgatttcaggagacaagattttgttgatgctttctcttctgtcctatcctcctggtgtcatgatggagattttagccctgttttattttccttgtttaaaaacgtagccgttctgagaggtagcgtgatctaacccgggtcatctaagtctgcactagaatgcagagtagcatatgaggagggggcttaacacacaaagggggctgctgcagaaaccatttaatttttcagaatgacttaaagaatttatatattttaaaaattataaaaagctgtccgggcatggtggcacacgcctgtaatctcaagcactttgggaggccaacactgcttaagttcagttgtttgagaccagcctgggcaacatagtgagaccccatctctacaaaacacacaaagattagttgggcatggtggcatgtgctggtagtcccaggtactcgggaggttcaggtgggattgcttgagactggaggttgaggctgcagtgagctatgatggtgcccctgcattccatccagcctgggtgacagagtgagaccctcaaaaaaaaaatttataaaagcttactatagtcaattgattgcatttaaagcttttgttttttttttttttttttttttttggacttcagctgatttgttacgtctgtcttgttttaaaaggaatgcagtctgcctggagcctcacctttcattacaacagaactttgtaaccaatagtgtttcaaaaccttctatctggaagactttatcagggctttggccttgaaaggaatgtcttcctactaatgtttgttaaacaagtggtgtgtgaaggagtgtaatctttctgggtttattggcaaaggagaacactccctctgtgtgttcctggtcttcagtgcattgaaacttcttttcacaggggttgtatttgtgtatatttcatatatacatataaatccttttacagggaatgaaaaagactcgagtagatgcaaaaaaaattggtcctcttaaactggctgccctaaatggactctccctatctcgagtgcctctgcctgatgaaggaaaggaagtggctaccagagcaacgaatgatgaaagggtatgtatgggacacacagggctttgtgccttctctggaacaaccggtaaatactacgcaaatgccttcatgagattttggtgaattttctaacacaatttaataataaatgagtgttaaggaattttgtaatatgggcctcaaaattggggcaaatgtatagctaatgtcttaatagataatttcaggttcgaatgctgattttttgtttgtttgtttctcagtgttcttttttaccttctcctggccttttggagcagtcttgattttgatggccttaaagtgagaagaaatctacaaaaatacaggagcatacaggggaaaagcagcagacattgacttttattatactgaaagtttatctcgagagtagtttctcaatttttcaaaacttcctttgtgcctgaggtgtattttctatgaggttttattacatcaaaatcagataggcatacatttgctttacaacgggatcctggaggtagtttcgaatatttcctactgctttagtcttttatatatcgtatgacataaaatggaaacatttgttcatagctgttggaactcattatccgtcccctagatttacttactgttccccaggagaattccatctattaggggtcacaaaattgaccacagatctagagaaaatgaattcaacaaatttctttaggccaattttcaactttaaacaaaagtttgcattatatttctcaccaaaatgattgtcttttgttcttttaactcttgttgttgtggctttttaaaattttaacttcattttcacctagaattttgtttctgttttggttttggtttggtttttttgagataggttctcatggttcactgcagcctcaacctcctgggctcaagcaatcctcctgcctcatcctcccaagtagatgggaccacaggcatgcaccaccacacctggctcgttttttaattttttgcagagacggggtctcactgtgtttctcaggctggtcctgaactcctaggctcaagtgatcctccctccttggcctcccaaagtgcagggattacaggcatgagacaccgtgcccaacctagaattttcaatattatacagtgctagatttgaagcagaaaacaagatttcaaatatacagtcaaaaggtagccacgacgtgtggctgtattcatgttattacacatattctgttttatagtgtaaaattctggaacaacgattagaacaaggaatggtattcacagaatatgaaagaattcttaagaaacggctagttgatggggagtgctcaacagcacgactccctgaaaatgcagaaagaaatcgattccaagatgttcttccttatgatgatgtgagagtggagttggtcccaactaaagaaaacaacactggttacatcaacgcatcacatattaaggtgagaggaacgcctcaagtaatcaacagcacatgcagtttcagttaagttacaagaatggtaagaattgtattcatgtctgtttagaattcagatattttaaaatttatttttattgtattgttttagataaacaccctagttttaaacatttgtgacaaactgtactgcaagctgggaaatccacataccagtgctagataaaaagcgtctatcagacagagccaaagtcatgtctactctccatgtgcgaaaccactctgcccccaacactgttaccaggactcagggcgcacttatttgcccggcttttttttttttcttttgccttttttgagatagagtcttgctctgtcgcccagacaggtggagtgcagtggtatgatcatggctccctacagccttgaccttgtgttgcctggctttagaactttgtccttctaaatctgaagacctctttttagctcataaattctgggagccactgaattgctagtttttcctcatcacatactgacatgcatttttatgtaacaaaagtgtctgggctttttgatggtgttcacaaaagctttcaacttaccaaggtgccatctgttctctttacatactctttataataatttttaagtatcattttttttctttgaagaagtgcttttttcctggaaccagtataatgccattaaactggggtaatgtttatggtgagagatagggggtccagttttacttttctgcttatggatatccagtcttcccagtcccatgtatttaagaggctgtccttccctagtgtatgttcttggcaccttatctggggtaatatcactcctatgaaaatggacaaaatgatgattcacaacacatgatggaataaagccagatgttccctcttcctcattgtaccctttgttcatgctggccacattcaattctttattttgggaaggagaaatctcatggtgagtgaatgagtaactgtggacaggtggtggtttttttctttagtttgcaagtattatttgagaagggaacaagctgacaccaaggctttctggagactggcagtctgcctgtgaatgccagtaccccttgatggcttttgggaatctatgcacatactattttgtttttaaatataatatcagcataatttacttaaaaaccgagcatttccttgaaataactcatccagtctctcatgactagatggataagaatgaatgatactgtagttctgtagtgatatttcaaaatcttcagcagccacttgcagaatagaggaaagaatttgatagacctgggtctgacgcctagatctaaaatgaggtgggacctcactttataagctgtgttgtgggacctcatctcacttacatggaaataaataaatgatgacacctaccctgccagcttctcactagtcccctcctcctccctagtgtttattcactgttataacctggtactcatccacagtggcagccactgggtgctcagtgagacgatgtggagcggtgactagggggctggcagccctgagtgagagtgcgtgtggcacaaggcttggcactgggttttacgtttagtgagtgtttggagacagttattgtcgtcactcaatattggtgaagccaagatttaacccaggtctcttaaccacaaatctagtaattactgttgtattagactgctctcaaggaagttaaatctgaagtggaaacttaatattattgtggagagtgaccttgactcagaagttcagaggtgagactatcttaagtaggaaggttttttttaaagaagaggcaccatgtctgcaataacagctacttattgagttatgtgccaggtaccatagatactgactcagtcctcacaatgaccctatgacggtaggcagtatctttattgtataaatgagaactgacattcagcaaggttaaacaggttgcatagatattatgtatattcacagtacctaagtttataaaaatgtcagtaatgcaaattgtattcacaagggaaaagatgaaaagtctttccttattctgctgaataatccagtttactacttttttactttttacttttttaaaaaaacttttttagtactaccatgaatgcatgcatacatacctatgtatattatacccacacatcaatttttttaaccttttctaatcccaggtctctgtcagtggaatcgaatgggattatattgccacacagggaccattacagaatacctgtcaagatttttggcagatggtatgggaacagggaattgcaattatagcaatggtgacagcagaagaggtaggtacttatttctcttaagtgattttctcagcctctgaagaacagttaatgttaatcatctggaatcctgacctgtggagaaaaaggcagggtagggttgtggttctgtttcagatgtgccgtctatgtgagaaaggcatccattgccggatctcgagtcatttaaccatgctcatctttaacaggagggtggaagggagaagagctttaggtactggccacgacttggttccaggcacaacactgtcacctatggaaggtttaagatcacgacccggttccgcacagactctggctgctatgccaccacaggcctgaagatgaagcacctccttactgggcaagagaggaccgtctggcacctccaatacacagactggcctgaacatggctgtccagaagacctcaagggatttttatgtgagtgactttaactttgttccgaggacagctgcctctggaggtgttaaacagagaggaacatttatgtttccgaaatatttcctttatgttatctcatataagcttcggacttgttttaacataaagaatacaagtgttttggggagggttaacgaggtttataaattatgatttggtagtgagtagaatgccacagctgactcagtatctccgtcatttcattttgtagatcagaaagtggacagaggtagtgacttgctcagggtcacactgtccctttgtggttgggtttggttcactggcacccagtgctctttatctgcagtcctcttaatcagtggagagaatatgaagattgagtcaacaatgtgatacgccttgatccttgagtacttttctatttcattgattttccacagcatatcttgaagagatccagtctgttcgacgccatacaaatagcacaagtgatccccaaagccccaaccctccgttgttggtccactgcagtgctggggtaggaaggactggcgtggtgattttgtcggagatcatgatcgcctgcctggaacacaatgaggtgatggcgcttatgatcacctggcctttttgggtggaaatgaggctggggaagagagggacatagtgacttaatagctctttttgcgcacatttccttggactgtggtggcctcaagatgttactaatgttccctgcaaaaggctgtgtcttcttggagagtctcagtaccaattagcatattaaagactaagaagtcatacgataaataaagctgtttaattttgttttacttgcccagggtttttcaaatttgagctcagaattctttttctgtttacatttcaaggatgattcatgctgcccagagcccttgagggaaatagctagatactgatagcacttagcacactatgtttttgtataattttggtatttagtgagacatggtaattatgtccaaccatacaaagtcagtgagctacacctggggaatgttgaagaaatagtctgcatggacattctatttatagctaaaactaatcagaaaatcagaagtaggcaatcatggcttatttctagaagacgctaaggtggaaaagagactgtccatctcccaaccaggtttctgccaggacactcgtgtcctcccatcctttctgtctccccaggggaacacattatcttcattaccgtttctctcaacctaggtgctggacatcccgagagtgctggacatgctgaggcaacagagaatgatgctggtgcagactctctgccagtacacatttgtgtacagagtcctcatccagttcctgaaaagctccaggctcatctaagctcccacaatttcttacggggccagtcatgtgaagcgtttacagcttaaaaaaaaagcgcttgcctaactcatactttcccgttgacacttgatccacgcagcgtggcactgggacgtaagtggcgcagtctgaatggcggcacgctgaaggaaacgtgcgaagcacaggctgaagaggggtttctaacctgggaaaggtgctcaaggaggacttggtttcaagggccttgccctgccccggtctgtccggtttgcagtacttgcacacattttggagattgtattttctagacaattctctattttactgaagctatgctgggcaattctggcaatcattaaagtgcatagatttctatctt

SEQ ID NO: 36758 - DNA, 3895 bp, Homo sapiens
accggtgtatcatgggagcggcccgggctacacgttaaaaacactaaggggagcgcgcgaagctgaacttggcgctcgatgggggccgttagccgccctagagcgcgcggagccgcagaggcgtagctggactacaacgcagtgcatctcgggaggccaactcgactggactgggtgagaggacagaggtggctcgatgggcggcccgaaggccggggatcatggcgggaaggcgggcccagacaggttcagccccgccccgacccgccgctccccaccccccggccggcctcgcgtgccttcccgcagcactgccgtccccgggatgctgagcgcccaccgtctccccgcagccccctcatgcccggctgcgagctgcccgtgggcacctgcccggacatgtgcccggccgccgagcgcgcccagcgcgaaagggagcaccgcctgcaccgcttggaggtggtgccgggttgccgccaggacccgccccgcgcggatccgcagcgcgcggtgaaggagtacagccgacccgccgccggcaagccccggcccccgcccagccagttgcgtccgccctccgtgctgctggccaccgtgcgctacctggccggtgaggtggcggagagcgccgacatcgcccgcgccgaggtggccagcttcgtggcagaccgcttgcgagctgtgctcctggacctggcgctgcagggagcgggcgacgccgaggcagctgtggtgctggaggcggcgctggccacgctgctgaccgtagtggcgcggctcgggcccgacgcggcgcggggacccgcggacccggtgctgctgcaggcccaggtgcaggagggcttcggctcgctgcggcgctgctacgcgcggggcgccgggccgcacccccgccaacccgccttccagggcctctttctgctctataacctgggtgagtcgggatcctggcggctgggcagagcgtggggacaggagcccaccatgacagtggaggtagggaaaggaaggattagctttaacatctcaccattagccccctcccaggacagcacaagatccaccgagccccgacgtgggacctcgggcccatctctgggtcttagttgtctcaggaataaaagtggagggggcaagggtggaaagggagaattggtctaaatagtgattttcaaacttttttttttttgagtctcgctctgtcgcccaggctggagtgcagtggcgcgatctcggctcactgcaacctccgcctccctgggtcaagcgattcttctgcctcagcctcctgagtagctgggatcacaggcgcgcgccaccacacccagctaatttttgtatttagtagagacgggggtttcaccatgttggtcaggctggtctcgaactcctgacctcgtgatccgcccaccttggcctcacaaagtgctgggattacaggcgtgagccaccgcgcccggctgattttcaaactcttttaacctccccgcccagtcagggttaccaagcaaacaagaacacatatgcccacgaatatacctgagacagaagtttaaggcattagagatactttctatgggcgatgcattccaataaactcttattatttgtttctttctttgtttttgagacagagtctagctctgtcgcccaggctggagtgcggtggcatgatcttgcctaactgcaacctccgcctcccgggttcaggctattcgcctgcgtcagcctcccaaagagctgggactacaggcgtgcaccaccacacccggctagtgtttggatatttagtagagacaggccaacaccatgttggccatgctggtctcgaactcctgacctcaaaatgatagctcacctctgcctcccaaagtgctgggattacaggcgtgagtcactgcacccggcctgtttgtgttttttgagacagggtctcactcttgcccaggctggagtacagtggcttaattatagttcactgcagcctcaacctcgtgggctcaagggatccttctgcctcagccttccaagtagctgggaccacagatgtatgcaatcacacccggctaacttaaaaaaattttttttgtagagatgggatctcgcatgttgccactcgaattcctgggctcaagtgatcctcctgccccaccctcccaagtagccgggtgtggccatcatgcccagtgaatggtttatttttgtccacactgttcctctgaagaaggcatggtaattatccctggtctagtgggggaagaaatcgaagcccagggtggtgaggtgacttgcctgttgacacagcactggttaacagtagtagtggcaggaccatgattttcttttcttttaattttttaaaatttatttttatatagggattggagtcttgccatgttgaccaggttgctctcaaactcctgggctaaagtgatcctaccgcgttggcctcccaaagtgctgggattacaggcatgagccactgtgcccaaataagctctgttctggctgggccctctctactaaaaatgcagaaattagctgggtgtggtggtgcatacccgtaatcccagctactcaggaggctgatgcaggggaatcacctgaacctgggaggtagtggagattgcagtgagccaagagccactatacttcagcctgggtgacaaagcaagtctgtctcaaaaaaaaaaaaaaaaaaaaaaaaaaaaggccctgccctatacaattttaacaaaatgctgttgacttcacaacctacttattggtcagaagccccagtttacaaatgagggccaaggttccagtgtctgagactcttccagaagggaagcaagggcagagtctcctgaaggaaggggccttcccaggtggtcaggggaaagtggggcagagttggcttccaaaactgtgggtacagggaagccagggtagtgggaaatccaagtccgaaaacttggactggggtcaggctcaactacatacccgccctaggacactctcaggcgaatcattcaattatctgggccagcttcccaaatccgtaaaccctgcccacttcagtgttgtaagtaaggatctggactgcaggaagtcaagagcctgaggccactcattcaaatataggttggggaaggagccaaaggctggcccttagaggggagagggaagttgggctaggcctagagaaggggcgtggtcgaggagagaggaaggacagggtgttgggaggggagatgagcctgatcctgtaaggaccaggcgtcctcattctggcttcccgctctcacaggctcggtggaagccctgcatgaggttctacagctgcctgctgccctgcgcgcctgcccgcccctccgcaaggccttggcggtagatgctgccttccgagagggcaatgctgcccgcctgttccgtctgctccagaccctgccctacctgccaagttgcgctgtgcagtgccatgtgggccatgcccgccgggaagccctggcccgcttcgctcgtgcctttagcacccccaagggccagaccttgcctctgggcttcatggtcaacctcttggccctggatggactcagggaagcacgggacctgtgccaggcccacgggctgcccttggacggagaggagagagttgtgttcctgaggggtcgctacgtggaggaagggctaccgcctgccagtacgtgcaaggtgttagtggagagcaaacttcgaggacgtaccctggaggaggtggtcatggcagaggaggaagatgagggcacggacagacctgggtccccagcctgaggagggagcgtgagcctcccagagccccaggactgggccagagcacttaggtttctttttccatggtttccaggtaataaaaggaacttgttttgttggt

SEQ ID NO: 36759 - DNA, 2372 bp, Homo sapiens
atctccccctcccaaaatcgctccattacataaatcggggggggtgcaggaggggggtcccttccgatcctccctcctgacgccccccccagcagccccctcccccaccattgaaagccatgaattttgaatttgagagggagattgggtttataaacagccagccgtcgctcgccgagtgtctgacttccttccccgctgtcttggagacatttcaaacttcatcaatcaaggagtcgacattaattcctcctcctcctcctttcgagcaaaccttccccagcctccagcccggcgcctccacccttcagagacccaggagccaaaagcgagccgaagatgggcctgctctgccgccgccaccgccgccgccactccccgctgcccccccggcccccgagttcccttggatgaaagagaagaaatccgccaagaaacccagccaatccgccacgtctccttctccggccgcctccgccgttccggcctccggggtcggatcgcctgcaggtcggtaagcgtggtgggggtggggtgaggggcagctagaagagggggagaaaaagcagtggaaggaggtttaaaaaaaatggtggcgagcctgttggggttccttaccccctccattcctgggatggggaagtagaatatcccactggggttcaggcctggccgctaacagcgtctttttttttttctgtctctctctctctttctctccctatggctgattttggaagctggttggggaaacgcctttttttctgctagaagaaaatgatttgattgaggttttcacccgtatctgtgtaggggaatgagtatgttgttgctgggatagaccctagaagcagaaaagattcggtcctttctgccccaactctaggagaagaggaagaattcagagctagggaggaagaggggtgaagaacaatctttctgaccctcgctccggttgagttggaaagttccgaattgaggggtccactgggagggcttgggagggggatctgaggttccggcgccgaagggagccgctctccgccccctgcgtggcccgtgggcggctctgaatgctttgccctgacccgggccggggctgtagactagagagggagagaagaaaacccaaaagcagtaaagcgagcggctttggggtgggggcgggggtggggtggcgaggaaggggagaggtgatactggttttggaggatggggtagtccgaactgaggttgggctgagtacacggcccgctatgacgccgagcctgttttccctgcagatggcctgggactgccggaggctggtggcggcggggcgcgcaggctgcgcacggcttacaccaacacgcagctgctggaactggagaaggaattccactttaataagtacctgtgccggccacgccgcgtcgagatcgcggccttgctggacctcaccgaaaggcaggtcaaagtctggtttcagaaccggcgcatgaagcacaagcggcagacgcagcaccgagagccgccggatggggagcctgcctgcccgggagccctggaggacatctgcgaccctgccgaggaacccgcggccagcccgggcggcccctccgcctcgcgggcggcgtgggaagcctgctgtcacccgccggaggtggtgccgggggccttaagcgcggacccccggcctttagccgttcgcttagagggcgcaggcgcgtcgagtcccggctgcgcgctgcgcggggccggcgggctggagcccgggccattgccagaagacgtcttctcggggcgccaggattcacctttccttcccgacctcaacttcttcgcggccgactcctgtctccagctatccggaggcctctcccctagcctacagggttctctcgacagcccggtccctttttccgaggaagagctggattttttcaccagtacgctctgtgccatcgacctgcagtttccctaacctgtttcctcctcccggtcctttcgacccccgcgctccttggccgtctactggaaaaatcgagcctctcccaccctcagtcgcatagacttatgtgttttgctaaaattcaggtattactgaattagcgtttaatccactccctttcttcttcttctaaaatattgggcactcggttatcttttaaaattcacacagaaaaattccgtttggtagactccttccaatgaaatctcaggaataattaaactctagggggactttcttaaaaataactagagggacctattttcctcttttttatgttttagactgtagattatttattaaaattctttaataataggaaaaggggaaagtatttattgtacattattttcatagattaaataaatgtctttataatacc

SEQ ID NO: 36760 - DNA, 11438 bp, Homo sapiens
ctcctcccctcccagcctcaggtgcctgcttcagaaaatggtgagtctctctcttataaagccctcctttttcatcctagcattgggaacaatggccccagggtccttatctctagcagatgttttgaaaaagtcatctgttttgctttttttccagaagtagtaagtctgctggcctccgccatcttagtaaagtaacagtcccatgaaacaaagatgcagtcgggcactcactggagagttctgggcctctgcctcttatcaggtgagtaggatggagtggaaagggtggtgtgtctccagaccgctggaaggcttacagccttacctggcactgcctagtggcaccaaggagcctcatttaccagatgtaaggaactgtttgtgctatgttagggtgagggattagagctggggactaaagaaaaagataggccacgggtgcctgggagagcgttcggggagcaggcaaagaagagcagttggggtgatcatagctattgtgagcagagaggtctcgctacctctaagtacgagctcattccaacttacccagccctccagaactaacccaaaagagactggaagagcgaagctccactccttgttttgaagagaccagatacttgcgtccaaactctgcacagggcatatatagcaattcactatctttgagaccataaaacgcctcgtaatttttagtccttttcaagtgaccaacaactttcagtttatttcatttttttgaagcaagatggattatgaattgataaataaccaagagcatttctgtatctcatatgagataaataataccaaaaaaagttgccatttattgtcagatactgtgtaaagaaaaaattatttagacgtgttaactggtttaatcctacttctgcctaggaaggaaggtgttatatcctctttttaaaattctttttaattttgactatataaactgataagtcctctctacttcacagattaagaaattgatactcaaaaaagttaaataacttgttttaaaccacatagtaagtgccgaagccaatctgtgagaccaggactgtttgtactctaaatggctgcaccacatgaggcaaaatggctcgtgatggttttatttcaaagacctagaaaacactatcacagctggtgctcccgtctcagacccacagcaacgatgtctccacttcctgcttcatcttgggtttctcacgtcttgaatgtgcacacaaatcacctggggatcttgttaaaaatgcagcttctgtttcaaaagacccagactggaaatggagattccgcatgtctagtacgctctcaagtttattaatctgctgctggtcctaggaacatattgagtagcgaggggcaggatgtgactcctgtaaggagtggccaggcattttcttagagacctgtgttataaagtatgcttttccttaaaaaaaagaagaaggaggaggaggagaagggccaggtgcagtggcttacgcctgtaagcccagcattttgggggaccaaagtgggaagatcacttgagctcaggagttcaagaccagcctgggcaaagtagtgaaaccccatttctacaaaaaattaaaaattagccaggcaaggtggcacacacctatagttccagctacttgggaggctgaggtggaaggatcacttgagcccaggaggtcgaggctgcagtaagccatgatcaagccactgcactccagcctggagtgtctcaaaatagataaataaataaataaataaataaataaataaataaataaaagagacagtatcaaagacccaatcacctctagacatctggcatcataggaatgtgcccagtctgctctggggataggaaagtggggatcctgtctccccctgtgtagaggtttcagtaaaagaaaggcctaggtgtgcagaaagctttcaggcaatgccagggaaactgatcattgtaatgaatccagggtattgctgagtgagggcatcctggagggcccggtggaaatgtggtcaggctcttcaatgcacaggccctagttgatgagtaatcagggtttcaaatatttccatctctgtctcaagcagaaaacaaatggaaaaactgaaccaccagaaaagcagagccagagatggaacaagaatcccagtgtttgtacccaaccaagagcgtgtttttcttccacagacaccaatgttcaaaatggaggcttgggggcaaaattcttttgctatgtctctagtcgtccaaaaaatggtcctaactttttctgactcctgcttgtcaaaaattgtgggctcatagttaatgctagatgcttccttcctctatttccccccaaatttcctgggaacccctggtcaataccagcagtaagttccactgttctagggtgtagaaatggctgtgacccagcagcaagagggaaggacatcagatgtcatcagtggtcatactgcaacacagccctttttctgtttaggaatgcaggtacccacaacatttactaacactttttttttcttatttattttctagttggcgtttgggggcaagatggtgagatatgctttctttctttcttttttatgaaatcaccccatcattctttgtagttatgaatggagctttctcttaggcctcccacagaacttccacagaggtcaggaaaaggagtttctgccatctacccctttgactttcctcacaagtctggagatatttctagcccagaagagggaagcaacagaggcaggaaataatgagtcttaaccatacaaaagaaaaattgagacttaaatgaagttgaaagcactaacagttttcatttgtttgcatttcatatttgatgtgagattctgcagaggagacgtagccagaatgcatgcacagggttactctggataagctgctggggcaacatttggatgtgtgttcagaatcacatgtctgaatactctgaatatatgtgtgtacatgtgtatttatgcaagtgcacatgcatatgagtgtgcccggcctgaacttactctctcaaccacagcggtagagtcaggagtgttccaacattggaagcccctctattcaatcagctcttccaaactgagtgaaccaatgttgtatttaatggcaaccatggctggacaccatggctcacacctgtaatcccagcactttgggaggccgaggtgggcagatcacttgaggccaggagttcgagaccagcctggccaacatggcgaaaccccgtctctactaaaaataccaaaatcagccagacatggtggtgtacgcctgtagtcctagctactcgagaagctgaggcaggagaatcgcttgaacctgggaggcagaggttgtagtgagccgagatcacaccactgcactctagcctgggtgacacatcgagactgtctcaaaaataaaataaagacaaccattatgccagcctagattccgccatgctgcctaatttgtagtgtccttaggagccatttttgtaaatagtcatcagataagatgtaaggcccataacagctttttctatgcagctgagggaattggaagatccattgtttcctaagagttgagggaagagtcccaacccacgggagcagggtctgatcttcattgccgatagaaacattactaatggcttcttactgtttccttttcaggtaatgaagaaatgggtaagaagatttccactctatctagcaaaagttttcaaatatggaatgaaatgctcatagagtacaatcacagtaacaaaccctgagaactaaaactattaaagggaaaatacaagtatctttcaatgggatccgtatgaaacttgcctgtatttgttgctagctgtcatgtcagattatagctgtgcatatatgtatctctgatcatacacatatggatgtgggttggagctaccatgtgtttttgtataagccatgaaatctttgaaggcagacagagacagtgtctcatttacctagcccagtgtctggcacatagtaggtgctcaatgaatattttttgaatgaataaatgaacaaacatatgaacacattgctaattacctcccctcaagaagctgatggtcttgtgtgagagacaaataattgaaaatatagtgagttgcatgttataatatgggtagatacagagtaaaatgaagtataaagaggggagtggtcaactctactgagtgtcgttgggaaaggttccctgggggaggtggtccttgagctgaattttaaaggataagcttatgttttagggaagaaaaatattttatgcagaagagataaagctgtatagtatgaggataagagtctaactgagctagatcagaatgtttgaatcttggctcaactctctacttgctgggtgtgtttgagtaatttacctaacttttctgtgccacagcatcatcatggtacaatggaaataatagtgctacctaacttgtagggttattatgaggaccaaatgagtaattcatttaaggcacttagaacattatctgacataaaaggcagtaggagggccgggcatggtggctcacacctgtaatcccagcactttgagaagccgaggtgggaggatcacctgaggtcaggagttcgagaccggcctggccaacatggtgaaactccatctctgctaaaaatacaaaaattagccaggcatggtggcaggtgcctgtaatctcagctactcaggaggctgaggtaggagaattgcttgaacctgggaggcggaggttggagtgagctgagattgtgccattgcactccagcctgggcgacagagcaagactctgtctcaaaacaaacaaacaaacaaacagacagtaggtgaattttagctattaatacatggaaagcatgctgactatagatgataagcattaaagtttactgagcatgtatgttttaggcattgctctaaatattttacttgaatttcctcatttaattcttccaacacccctactgtacagttaaggaaacaaagcctcaaataaatacagaaataaacaaaaataagtaaacaatccagtcctggggatataaatgcagatttaggccaagtgccatggttcatgcctataatcccaacactttgggaggccaaggcaggaggctcgcttgagctcagaaggttgaggctgcattgagcaaagattgtgccactgtactcgagcctctgtggcagagaaagaccctgtctctgaaaaaattaataaatagaaatttaaaaataaaaaaattttaatgcagatttatatgataccgaagttcattttctcaaccattatgaaatactgtttctggatatgtataaaatctttgtgagcacacatatctttttttaacttaactttcattttaaattcaggggtacatgtgcaggtttgttatataggtaaacttgtgccatgggggtttgttgtatagattatttcatcacccaggcattaagcctggtacctgttagttatttttcctgatcctctccctcctcccaccctccaccttctgagaggtcccagtgtgtgtcatttccctctgtgttcatgtgttctcatcatttagctcccacttctaaatgagaacatgtggtatttggttttctgtcactgtgttagtttgctaaagataatggcctccagtcccatccatgttcctgcaaaggacgtgatctcattcttttttatggctgcgtagtattccatggtgtatatgcagcacatttttttatccagtctaccactgacaggcatttaggttgattccatgtctttgctattgtgaatagtgcacaatgaacatacgtggagcacatttctgtctaagcacagacatctagacccttgtgtgagcatgagttaagtctaagctctgctactgaatttgtgccaataaaagttgtgagcaattttctttacatttttttcaaacaaacacacccagcagagtataatgtctatgtactttatttatgatttctagttcatttaacatgtctaagaaacatccgtgttgaaaaattatttataaattaaaataatataaactatctactgtccttatactcaactcccaattataagcaggtggaaaaacctggagaatgttttgtttacattctgtgcagtctttgtcagagggctgcctgagcaactgggtcagagtttagttctgctctgggagtagcaggacctcaagaaggaaaggaggaaaggaagtaactttttcttgagcacctgctatgtgtcattcactttcaccttcataatccatttaattttcgcaaaaactttgtgaggttggtgttttatctccatttccctgataaagaagttgaggttcagcaaagttaaatgacttgccctcagtcacacagactagggcagatccaggattcaaactcagggcttctgactcttgagtccagagctctgtccctgacagcagcagcactgcctctcctctcttccagctgttatgtccagactgtagcagaacccagtgttccagccacaagttttccaggaaataataaaggactcctagctccacctcccagggcaaaaatggctgctgtgggaaacacaggctggacctacgaatggcattagtggtttattagttgatttcagttgtccacactaataggcctccctctaacaaaaataattgagagctgattatgctcagatataatgtaaagtgaagccactttttattggaagaagcattccctcaaaacgtgtagagtatttcacattatttaaaggcaaatagagagaaaattatatggaataagaacaaagatgtttcttctctattatgagggactcagttctgagaaaggattttaaattgtaagaaataggtaagtccacgaatcagtgattcagtggtgtggagagctttatttctgagaaggccagtagcgctcccttctgacaagcaaatctaagacctggatgacagatgacttcctgcatttggttggttcttttgtcattcatatctatctgtaatacagttctggctaatttaagaggataagcttgaagacctctggaatttttcggctttaggactttaaggctttctgagcttcagtagatctagatctaggagctcatgctggtatattctgaatccgatgtatctgagttacatctatgagctacttaataaatatatctatgagctaaatctcataggctaagcatgaacctcacctccaagactcggggttcctaaatggatgagaccctctttgggaagtcttgtgggcagtgtctaattccactagaaaagttttacctacaatttaaacttaaaccatgatattttcttactgctgtttccttttttcattttcaggtggtattacacagacacgtgagtttattggtcttttatttatgccctgtctgaggatgcagattggtgggtagatgagaaggaactgattgagagagattaaccccaagaactgatatcttcccagcattgcattctcaactccattttagaaaggttccaaatagggacttctgtgggtttttctttacatccatcttacccttcccaagtccccatgtccctgcgtaaaccctaaagccacctctcaaaaggttctctagttcccttcaaggttctctagttcccttcattccacatatctcctcttccacaccctctagccagtagagctcccttctgacaagcaagtctaagatctagatgacagatgacttcctgcatttgggtggttcttttgtcactaatttgccttttctaaaattgtcctggtttcttctgccaatttcccttctttctccccagcatataaagtctccatctctggaaccacagtaatattgacatgccctcagtatcctggatctgaaatactatggcaacacaatgataaaaacataggcggtgatgaggatgataaaaacataggcagtgatgaggatcacctgtcactgaaggaattttcagaattggagcaaagtggttattatgtctgctaccccagaggaagcaaaccagaagatgcgaacttttatctctacctgagggcaagaggtaatccaggtctccagaacaggtaccaccggctctttagggaggaccattcaaaagggcattctcagtgattttccctaacccagctcacagtgcccaggcgtctttgcgcttcctcccacactcaatcctgggactctctggtaccacacggcatcagtgttttctggaatatagattaaacaccaatatgaggcttctgggtaaccccagtctgtgcgagatctaaaatagcaactccctaagagacaggactgggtcatttgcaccgcatcacacccaggttcatagcacaccaacatgagtttatctaatgcttcctccagagataaatttttcagaaaggtttgcaaaaaacactcaaggccactatagtaaaatggcataagctaaggtataataataaaataataacaatacttaacatttattgagtgcttattaagtctcaagcactgtctgtacccaacacttatcaaggattctttttcatgtaatcctctcaacaactatatgggttaagtatcattttattcccatgagtaaagggatgaggaaacagagggtttgtgagttgaaaacacatttcacgcttctcacagctagtgagtaataaagctgggactcaaacccagggctgtttgactccagtgcctctacccacggccaccactctttgcttgtcaatgttgttctaaacatattgaagggggggctctgaccgtggcaagcgtgtgagtagtaaggggagaatggccttcatgcactccctcctcacctccagcgccttgtgttttccttgcttagtgatttcccctctccccaccccaccccccacagtgtgtgagaactgcatggagatggatgtgatgtcggtggccacaattgtcatagtggacatctgcatcactgggggcttgctgctgctggtttactactggagcaagaatagaaaggccaaggccaagcctgtgacacgaggagcgggtgctggcggcaggcaaaggggtaaggctgtggagtccagtcagaggagattcctgccaagggggacgaccagcctgggccagggtgggtggcaagtccacagctaggtcagaacagcttctctagagcttctatgcacagcttctattactgtgatgacaagatctcaacagacggtttcaaatctcacatcactcccctccttcccatcctagaaaagtgcaaaaaagtttatgaaagtgatgggcttcctcacatacctgtcaatgcctgcagtcatccgattccgcccctaagctgtgggaagagagactttgatatattagctcctgccttttcctttcccttcccctatggagagaaacaatgggaggatcttgagctgaggaaagtcacaaaatgatgagaagagtgtagggtccttagagatgaatgaaagaaaaaaaaagagaaaggacgtctgaacagaaaagggagcggtagaggagagaacaatggggtttgccattctctatctgggtctcactggcacagacagtgctgcaagattggttccctcatgggaatgaaatgtttcccctccttcctccgcaggacaaaacaaggagaggccaccacctgttcccaacccagactatgaggtaacgtgggatagaaatgggccaggacgctggaggggatgtccctccaggggggaaggaaacagatgggatggcccatcttgtctgccagatgcctcaaagcccctcactcagggcttccattacaaccctctatgtgccacctctgcgtccttcatggtaaaacaggactgtctcaaaggctgcatggcttccacaaccatggagaggtggaagcttgcaggagacatactcctctttctctggcttattcattgactgggatacagccatggagaatattatatatgcaaattctaacacaataaattctgggctgatattccaccagcatgcaccagtatagcgagttattgaaatattaaaattatataaatattatataaaagttattgaaatattaaaatactcattgggaaatagccccaaactttgctcaccccaacccacccttacacacacacatacacacacacacacacacacacacacacacacacacacacgtgaccagacatcccagtccctcccctaccgggctgcctcttgagttggggtaacaaagagttaatgcctggcatggcagaggatcaccaggattgttctagttgattggtatgtgtgcactcctagttgttaaatattttcactatcacacctggatatactcaacaaatatttgttgagccaaatactcaacaccagccaaacacgtagtatttactttagcttaagcgaattatttagccctgacagaagccctggaatgtgggtctttaagttcctatttttgagatgggaaagctgaggctcacggaaggaggtgaccagctcaagtctcctaccgtccatgccaaattagaattccagcctgcctcctgacttcaagtccaaagttcttcccacgcactaaagctagctcttcagtgtcctttcttaggaggtacttcctcccgcaccactgaccgccccctctctatttcacccccagcccatccggaaaggccagcgggacctgtattctggcctgaatcagagacgcatctgaccctctggagaacactgcctcccgctggcccaggtctcctctccagtccccctgcgactccctgtttcctgggctagtcttggaccccacgagagagaatcgttcctcagcctcatggtgaactcgcgccctccagcctgatcccccgctccctcctccctgccttctctgctggtacccagtcctaaaatattgctgcttcctcttcctttgaagcatcatcagtagtcacaccctcacagctggcctgccctcttgccaggatatttatttgtgctattcactcccttccctttggatgtaacttctccgttcagttccctccttttcttgcatgtaagttgtcccccatcccaaagtattccatctacttttctatcgccgtccccttttgcagccctctctggggatggactgggtaaatgttgacagaggccctgccccgttcacagatcctggccctgagccagccctgtgctcctccctcccccaacactccctaccaaccccctaatcccctactccctccaccccccctccactgtaggccactggatggtcatttgcatctccgtaaatgtgctctgctcctcagctgagagagaaaaaaataaactgtatttggctgcaag

SEQ ID NO: 36761 - DNA, 5807 bp, Homo sapiens
agggtggagtgcaggcttggaaagcaggagagctcagcctacgtctttaatcctcctgcccaccccttggattctgtctccactgggactcaagaggtgaggagagaccatctccccaaatgcactgaagggaaactggaggagggagggagtgaggggtgatcataccagcggaggcacatttgctgagcccccccgcagtctgctctttccaagtggaccctcctggaagcctgatcccaacctcccctgcaagcaggtctgtcacccccatctctcagatgaagaaactgagccttgcaggggtggagtcccttgtccccacgtcataagggtagtcatagtagtaggaagaggaagcacctaggtttgaggccagggctggctgctgtcagaacctaggccctcccctgccttgctccacacctggtcaggggagagaggggaggaaagccaagggaagggacctaactgaaaacaaacaagctgggagaagcaggaatctgcgctcgggttccgcagatgcagaggttgaggtggctgcgggactggaagtcatcgggcagaggtctcacagcagccagtaagtgaacagctggactcgggctgcctgggcggcagggagaagcgggcaggggaagggtcagcagaggagcgaggccccagaggagccctggggtggagcacagccaagggctctgttccctttcctggactcggcttccacaggccctgacctgcctcccccaccctccggtcctgcccctgtgcctggcagcagccccacctgtgtgacatcccagcacaccccccctctccttgcaaaggagaagggagcggcctaggggaggccaggggcccacctgggctggggctgtggagagggagtggctgggacgggaggaaaaagagagacggagattagatggaagaagagggatttcaagacaaattgccagagatgcagtcagagagactgactgagagacacaaagatagaaggaattagagaaagggccacacagagccagacagagagagaagagtggagatggagacagggacgaggacagagaaaggcagacagacacatagggacagaaagagaaaaatcacacaaagtcagaattactgaatgacagggaatgacacatagaacgagacacagattcagagactcagggcagggaaaggaaggctgcagacagacagacagacagagggaggctgagacacagggagaagaggggcttggagaggtggcacaggcaggcagccagtgcctcagaggcctccggggagggccctcacacacaccccgccccggggcattaaggcagggcttggaggccagtcatcctgggcccgcccagggccgcccccctgccagcccgcctgcctggtgcctggcacctggcgctccaacccagcctacctgctgtagctgccgccactgccgtctccgccgccactgggcccccagagccccagccccagagcctgtgagtccaggaggaaagggaagctgcccctccccgtccaggtgtcagccctccccaaggacacctgtcccactcgggcacccatttctccctctgctctgtccttctctgcttgggtgggggttcctggcctctctctacacctctcacctccgatggctgtccgcagcctcagttacctctaatctccatggcttcagctgctgagctggccctctgctcccacccccgctggccagggcagcggagggcactggccctcccctcgaccagccccgcccagctttgcttggctgtccttcaaaagggcaggggtttggcggacagggcttcagcaagccgggtgatgggggtcccagacattgtctggggctgagccccctactcccctccagcagacctcaaaggctccatatcgctctgctgcgaagacaatgaaaaaggggtggctacggaacggtgtctggttccccttgtccttccaccccaagctgctggggcctggccagctctcaaggcaagaaggaaaacatcctctgacatgtgccggggaggtcccatggctgacttgaacagggccgaaccatggcttgacagctcaaagcccctcccaacgacttccacatggttcttggtatctcggaagcttctagctgtgaccaggccctctccaaggccaccctagacacctaagatatattttaagtgtttggagatctgagtgctgtgagaaacaggggatttccccaaccttgtttctcccaagtggggagcgggagcaggtgagggagagaggagagggcatgagccagcccccccctcccgatttccccgtaaagtgatgcggccccatgtccctccttgttcccagaggaacctggggcccgctcctcccccctccaggccatgaggattctgcagttaatcctgcttgctctggcaacaggtacgcaggggatgggggcagggcaggatcctccctcttgaatctctgggatcccctaaccctctgtgtctggacagtgacagggctgattccaaattacagaacaacccataaggcacctgaactggagcagtggtcatgagggcctggatgcccttctagataatccctttaaatgccaaaggaggagaggtcaagggggtcgtaaagggtcccgtggaggggctgaggaagctggagttgggggagcagtcactcaaagcgcccaggacaggggctactgaccaaccagtatggaagtatttccttttttttttttcccagagacaaagtcttgctctattgtccaggctggagtgccgtggtgccaacacggctcactgcagtcttgacttcccgggcttaagtgatccttaagccatctcagcttccccggtagctgggaccacaggcacctgccaccaagccaggctaattgtttaattgtttgtagagatgggggaggaggtctcactatgtttgcctaggctgatctagaactcctgggctcaagtaatcctcccaccttagcctctcaaagtgctgggattacaggcatgagccactgcatttgaccttatggaagtattttcatcctttaatacccgaccccagcatccagggcaacccagagggacaccagaccagggcccagaccacccactctctttctctcctccccacccccatttctgggagtcctcctggtctaccacctctccttcctgagccccttcttttgctctcaccccctccagggcttgtagggggagagaccaggatcatcaaggggttcgagtgcaagcctcactcccagccctggcaggcagccctgttcgagaagacgcggctactctgtggggcgacgctcatcgcccccagatggctcctgacagcagcccactgcctcaagccgtgggtgcgggggctggggcggtgccggggtggggggctgggaatggggagatggatggagagaagctcagggataggggtgctggtaaggggattagagatggggatgggtagtgtcagcaaggttgatgggctcgagttggtattgaaggtggggggatgaatggggttgggatggggctatggctgggaagggggcttcggtgggagacgtggaagaggttggaagcagagcgatgtttcttcatcctcaaaggtgtcactcacctctcccacccatgtctcccccgacctttcctcctccaactactgtctctcccacctcagccgctacatagttcacctggggcagcacaacctccagaaggaggagggctgtgagcagacccggacagccactgagtccttcccccaccccggcttcaacaacagcctccccaacaaagaccaccgcaatgacatcatgctggtgaagatggcatcgccagtctccatcacctgggctgtgcgacccctcaccctctcctcacgctgtgtcactgctggcaccagctgcctcatttccggctggggcagcacgtccagcccccagtgtaggagcaccagaggggaacctggcagggggtggtgaggagggagtggtcaggattgtggaagggttcagggcatcagagatgcggttcacagtgacgatgtgggataagttgagaggatgtgtggaaaacgtcaggataggggggtggggacaaaagttggggccttggagtcagacggacgggatatgcaatcatacatccataacctcctggttgtaagaccttaggcaagcagcttcacctctctgaatcttgattttcttctctataaaatgagaatgattatacccacctgtcaggattggattagagataatgtatatcaagcaactgacataaatcatttattggatagcaggctgggcaccgtggctcacgcctgtaatcccagcactttgggaggccgaggtgggaagatcacctgaggtcaggactttgataccagcctggccaacgtggtgaaatcccatctctactaaaaatgtgaaaattagttgggcgtggttgtgtgcgcctgtaatcccagctactcgggaggttgaggcaggagaatcgcttaaacttgggagacggaggttgcagtgagccaagatcacgccactgcactccagcctgggcaacagagcaagactctgtctcgaaaaaaaaaaaaaaaaagctggatagcattgctgttgctattgttacaagaagagaggtgagttggctgcgtctaaggacagggattcccccaggggcgggatcacagcaagcactgcattaggggaggtggcagggggctcattcccacagcccctcacgctgtttccacagtacgcctgcctcacaccttgcgatgcgccaacatcaccatcattgagcaccagaagtgtgagaacgcctaccccggcaacatcacagacaccatggtgtgtgccagcgtgcaggaagggggcaaggactcctgccaggtcagtgtggtctccaaccacagccccatccccatccccagcttcaatgacatctttaccgacatccacaatttcatccccaacctcaacccgccgacccctgcaactcccaatccatctcttcccctgttcccgtttctgacctcagcacaaacttcagctccatccccgtttccacaccatttccagctccaaccatccccaaactcgtttttgagcctaaccccatcctttatcccacccataatcccagctttatcgctaaacctatcacctttcccagtgcctacccatcctgtctcggccccactcctaagcaccgtccccacctcctccctggctaacaccatgctcaacgctttctctgaccgacattctctctccccgtgcccagggtgactccgggggccctctggtctgtaaccagtctcttcaaggcattatctcctggggccaggatccgtgtgcgatcacccgaaagcctggtgtctacacgaaagtctgcaaatatgtggactggatccaggagacgatgaagaacaattagactggacccacccaccacagcccatcaccctccatttccacttggtgtttggttcctgttcactctgttaataagaaaccctaagccaagaccctctacgaacattctttgggcctcctggactacaggagatgctgtcacttaataatcaacctggggttcgaaatcagtgagacctggattcaaattctgccttgaaatattgtgactctgggaatgacaacacctggtttgttctctgttgtatccccagccccaaagacagctcctggccatatatcaaggtttcaataaatatttgctaaatgagtg

SEQ ID NO: 36762 - DNA, 11318 bp, Homo sapiens
cttttcttaagggaaaaatcactctgtgttcttttaaaatccctcaggttttatgttttattgctaccagagtctgcctccctgaggttcttgtatagactagttatttccctctgtaaagaagctgttctattcgttctcgcctggtttggaacaaactgaacacttccaaaggaggcagtccttgcagccttgtctccttccactcccctcctccccacagtcctggctggagcagcgagtctgtcgatcccaggccagagacaaggcagacaaaggttcatttgtaaagaagctccttccagcacctcctctcttctccttttgcccaaactcacccagtgagtgtgagcatttaagaagcatcctctgccaagaccaaaaggaaagaagaaaaaggtatgtaattttttctctataaaaaacatcttatgtcagttgttctactccaaagtattactgtagattagagcagaaatgtatgtatgtgttgagtcagaagagaaagacagagatcctctgaggagatgatgcaggcactttgaaaaatatgatgcttcctagtagaaaggcaaataatcagattaaaaaagaacagaaaatgtatatttcttgactaggaaagtcatttcattacaggtttaaaaagaggcagattcttcactatcatttatttaatgcccaaatttactctgaatgttgtcccacacaacaggacttatcccagtcctcagaactatgtgaggatgataaagtatataggattgttttaaatgcagcagctatattacctacactacatgaagttaactgcaacatctaagaaagaaaatgttttttgcttttaaaaatcctgatttctgaaaagaacctggtacaaatgtgtgatacaaagagggaattcattgaattcatccttggtgtccattcttggaacacaacagtgtctgtactgctaatataaagagaacactttttccctctgagacttagaaaaattcctctttaaaattccttaacttaattacacaggctatgaaaagctctcccaaatgctggtccttttctccagtgatgatgatttactgtgtccaggaaaagaaggagaatgatgcaagactgaatattaatatcatcttctggcatgctctaaaagcctgatcacttttagggaggatgtggattttgtttttctatggatgaaggtatcttagatatttaagatgatatgtctgttttaaggatctttaagcagcttattcactttttaatactgcttctgttctttaacacatactttgggaaatttcactttgggactcagtcattctaacaaaaacattttctaaggactcagtcattctaacaaaaacgtcttctaaggcagctaataagaaaaaaagagaactttaaaaaaacagtgattttcatcctccaagagagatgagtggaaaacatcacagactgggcagcaattttaatctctcccaactataattttgatatttcaaatgtcaagttctgggctggagttttcatttgcttttgcagctttgcttctctcttgctgcttttttgaaagcaatccgaaaatggactgtcttttctgtctaattcatcaactctgtttcatgccactgctcttaataccagttcccagaactgacatcagctgcctgtatgagcatttgcaccataaatgtctgaacacttaaactgcatggtcctgttagttttggcaattaaatgggataatttttctttttaagtctccatttagctccagccattcaaaagcttgcttgtgctaaatgccctcagacagaatcaaaatttgcaactccctaccaaaggatggtagcaatgatttattgtttagttggaaatgtcttgctcataatcctgtatcctctgcaatgatctattaaaacttacaacactattaggatataaatggtatcatacaacatttggaacaatgttaattacataaaatcgaattaaaaaaatggataactacctaagcttctcttgctcactccttctaatttttagtaggtaactttgttttcttttgtaatttgggtgtattccaggagggattttaagtacatgtacctcaactgaaaaagaaaaaaaaaagaccaattttcttcaaattggccaaaatcatttcactcttgttggcacttgaacatatatggttttgatggattgccaaggattaagtttggtatcctttaatgaaacaacaaccaatgtatcccaggaacacactgggtcagaaatttttccatttgctaaataatagttaaagctatttatctgtacttaagtaaaggaagaagagaagtctgcatttaagacatgtaatttattttattttattttgttttattttatttcatttttttgagacggagtctggctccatcgcgcaggctggagtgcagtggtgcaatctcggctcactgcaacctctgcctccgcggttcaagtgattctcctgcctcagcctcctgagtagctgggactacagtcacatgacaccactctcagctaatttttgtatttttagtagagatggggtttcaccatgttggccaacatggtctcaatctcttgacctcgtgatctgcccgcctcggcctcccagagtgctgggattacaggtgtgagccactgtgctgggccaaaacatgtaatttataatgcatacacacacacacacacacacacacacacacacacacaaaactaccagtaggtacttgctaggtgtggaactttccattgtagtatgcgacttagactgtggcaaaaaaatgatcttatgctctggcatgaacacagaagaggtatgtggtatggcaatttacttacttattttaccagcaatttatttgttcatttcactgaaggaaattttttcaacacttactgtgagctcagcattgaagcaggcactctgcttcaatacaaaagaagtagaagttacagtccttgctgccttgatgctggcatctcctcttctagtcctctgaatattgaattgccctgggcctcagccctttgcctcatctcttctggatctacctttactgccctgccagacccatagctatagatactatcaataaatatcctgattactctcaaatttgtattttcacccctgatctttagactcacattcaactgcctactcaacatcttcactttaatatctaacaggcatctcaaacctaacttgtctaaaaactcatttctggattccccccaaaattggctccttccaattcttcctcagttcaacaaatgacaacaccattcaagccaaaagcccaagagtcatccttgattctttccctcttgcttcatatatcccatcagttctcaccaaaagcctgttttcttctatttccaatcttgtcccaccacaatacatcttcacaggccagccagggatttttttaaaaaggcataaatcagatcatgctactgttctgtcaaaatcttccaatggcttcttaatatactcaataaaatctaaactctttatcatatcttctaggccctttatgattgttcccaatcttccttcttggctgtaggtaaattcacataataaccaattcactaaataattaatcagctctatgaatttcccactccccatatccaattgtagtcatattctccaaatggttaaccagcttataaaaatgctgacaatgacaaggcattatttactcaaattcacagttcttgtaggccagattatatataagtgctttgggaacatagagcaagggagctatgagagtagtattgtctgaaatcagggaaggattcttagaagatatgagtgtgaggtttgtccttcatggatgctttggtcagaaattaatatcaagggaaggggtgagaaggaacaacaaggcagagacacatacataggattaaagagatgactggcttgactgcccggctagctgaacaggaataaatgataggcatggagacaaagtgaaaggaaggccttaggttagcccaagaagtccatatattcttttagacaacataagacctctataggctcttgcctagaataaaaaatgtgtttttggaaaatcattcattttcaaatatgggccaagcattgtattagccactggtgtatggtagtgaacaaaataaattgttgtcatggagccttcggtctaatgagaatgacagacataaaatgagtaaattcacaaatatatcatttaaattgtgataaatatcattaaggaaaagaaagggcgctatgaaagaacaaagttgaaactaccttagactgaaaggccattgaaggaatgacatttaaactgagacctaaaactcaaaaaactagcccaaaaaagaacattcctggtagagagagcaacatatagaaagaccataatggaagaaaaagatttctttttaattataaggaaatactctatacatctttattgttaaatgcaacaaaatagcataagaaaatatgaaactcattgataaagataagtgtatatacaaatactgactactatattactaaaatggtggtggttgaattccatttgattctagcataaaagttgaaagacaaaagtattaaaataactataatttaaaatatgtttatggatacacaatataaatagatgtaaattgtgacatcaaataacatagtgtggtgagagagaattaaaagtgtagagtttttgtatgtgattgaagttaagttgttattacctcaaaacagacttataattataattttttttttgagacggagtctctctctgtcacccagactcaggtgcagtggcacagatctcggctcactacaatctctgcctcctgggttcaagtgattctcctgcctcatcctcccaagtagctgggactacaggcgctcgccaccacgcccggctaattttttgtatttttagtagagacagggtttcaccgtgttagccaggatggtctcgatctcctgacctcgtgatctgcctgcctcggcctcccaaagtgctgggattacaggtgtgagccactgcgcctggccaattataaaatattttatgtaagcctcatggtaaccacaatggaaatacctatagcagtttacacaaaagagaaaggaatcaaagcatatcggaaaaaaaaagaagaagaagaagaaaaagaaaaacacaaccaacaaaacacaaaggaagacaaggcaggggggaaaagcaccaaagaactaattacaagacaactagaaacaataagctaaacggcaatagtaaattcttccctatcaataattactttacatgtaaatggattaaactctccaatcaaaagacttagggtagcagaaagaaaaaaaaacaatatataactatatgatttctacaaatgacttacttaacatttaaggacacacacaagctgaaagtaaagaaatgaaaaaagatactccatgcatatggtaactaaaagaaagcagagtggactatttcatatctgacaaaatagactataagtagaaaactgtcacaagagacaaagaagaaagtataatgatgaaagggtcaacccaccaggaagctataacaattataaatatatacacactcaatatcagagcacatatatatatataaaacaaatattgacagaactaaaatgagaaatagcaacacaataatagtaggaaactgcaatactccacttttagtaatggttagaataaccagacagaaaatcaacaaagaaagagtggacttcaacaccagtgtagaccaaatggacctaacagacatatacagaatgttcagttaaacagcagaagaatatacattcttctcaagtacatacagaaaattctccatgatagatcacatattaggtcacttaaaccatgacctacaaaaagcccattggaagatatcatttatatatgctggattgtgatgcactgtaacactgcaatgtcttagtccattaaatctgaaaatatataaaatgaggtagatctcattttagtcttttctttcactaatgtttggaggtaggaattaaattggatattgataattctaaggaaatatatagccaaagccaaaaatggctaactcaaattagaatgtgagacaaagaaactctgaaactcttaggagtatgaagaaatactttgtttctaatctaaagggaaaaaagcaataaatgtatttatttaaaaatccattatcttatctaaaatgacttacctttaaaagatacctaatcactaaaaactttataccaaaaatgtccattgcacaatattgctttcttttttttttttttcgagacggagtctcgctctgtcatgcagggtggagtgcagtggcttgatctctgctcactgcaacctctgtctcccaggttcaagccattgtcatgcctcagcctcccaagtagctgggattacaggcgcatgccaccatgcctggctactttttgtatttttagtagagacagggttttgccatgttgggcaggctggtttcaaactcctgacctcaggtgatctgccgggtttggcctcccaaagtgctgggattacaggtgtgagccaccacgtctggctattccacaatattgttttctttccaagtacaatgtcctccatctgttttccctctttccaaggaaggaaagatactttggcacctgttaacaagataaaatctgaatggctctggattctaatcctggttcctccactattttgctattcttcctttactacaatagtctccattttcttcacatctaatgtagaaaccagagaagtctaattagatagatatttaatattctatacttctatgcaaatcctgtacttgaaaaattatctcctggaagagaaattagaattgttggtatgacttcagggttcaaactaggattagtgggtggaagccacagaaaagtattttacaataagggaaatgttagaactgtatcaatgggatatgttgacttagttaataatgagttccccatcatggtaggagttcatggaaggctagatgattataacgcaggaattcaagccttcattttcaactgcagctaagaggaagtagtctatgtgggataaaaatccaagcattgctaaaaatttgcaaccataatgtgtactaaactacttctggaagttaaaaaacaatcaaactataaatatatctatacactatcatctgtcactatcaacataaatgggttttttgtttctgtcaggatgggacccaggtactttgacaatgttgttaggatgtaagataatgtaaggtaaagaaccactgtattcaattatgttatttgttctagaaatttgcctgagtttataccaccttaaaaaacagttgttctctactgaatgttcaaaagatatatagctttgggtacttcttaaatgcagattgcagcccccaccaacacttcctccctgcctacagcctgtgcgtgactgtgtgtgtgtgtgtgtcaaggtctcactctgccacccccagtagagcagtggcacaatcatggttcactgcagcctcaaactcctgggctcaagtggtcctgagtagctgggactacaggcacatgccagcatgcctggctaattttttaattttttgtagatacagggtcttactatgttgcttagactggtctcaaacttctgggttcaagcaatccttgtacataggcctcccatgctgagattacaggcatgagccactgtgcctggcccagaagcctgcgcatttgatttttaacaaatattccaaatggttttttatcatagatggtcataaaactacactttgagaaacacaaacaggattgtagaaaagcccaactcccattctttctatccaagggtttataagcatgctacagaacttcattcagatgaattctatctttaaaaaacaaacattgacacattttggtctttcttctatttcagggccaaaagccaaaatgaaactgatggtacttgttttcaccattgggctaactttgctgctaggagttcaagccatgcctgcaaatcgcctctcttgctacagaaagatactaaaagatcacaactgtcacaaccttccggaaggagtagctgacctgacacagattgatgtcaatgtccaggatcatttctgggatgggaagggatgtgagatgatctgttactgcaacttcagcgaattgctctgctgcccaaagtaaggaaatggtatcacaaagtgtattgcctggaaatgtatgcagaacaacttttagctacatcttcataataggtttgctgaaattaataacccttttagtaaaatcctgttccaatcccagctcttttctagaataatcactattgtgtaaagaactaaatgttttcatttaaatgaaagttcaaatggaatttagctgagtttaataaaagtaaattaaatccagaaaataatacttcaatctattaaattctaaactcaccatctgatttttacccccccaaaaataaaaatctaccagtagcagaagtcaatctcaaggttgaactcttaaaccaacttgaaaaccagtaaaaggttttagataaaagatcccagtgaggctgggcccggtggctcacgcctgtaatcccagcactttgggaggctgagttgggcagatcacctgaggtcaggagttcgagatcaacttggccaacatggtgaaaccccgttctatgcaaaatacaaaatacaaaaaaaatacaaaattagctgggcgtggtggcatgtgcctgtaatcccagctactcaggaagctgaggcaggagaattgcttgaacctgagaggctgaggttgcagtgagccgagatcgcaccattgcactccagcctgggtgacaagagtgaaactccatctcaaaaaaaaaaaaaaaaacgaacaacaacaacaaaaaactcagtgaatggatcaagtaattaactgaacagaaaagtttagtaacggtcaaaaataaatttctagctctatgtataagttaaccagaaatgaactagatagaagttcaagacaatttatctaccattgttttctatttatattttaagcttaaatatttattgatttatctactatcgttttgtacttaaaatacaagtatacgtggtgaaactctgtctctacaaaaatacaaaaaaaattagccaggcatggtggcacatgcctgtaatcccagctacttgggaggctgagacaggagaatcacttgaacccaggaggaggaggttgcagtgagcctagatcgtgccattgcactccagcctgggcgacaaagcaagacttaatctcaaaaaaacaaacaaacaaaaaaaggtataaaatgatggtagataaattcataaatatttttagttcttgattttaaaatcatttccccctggttattgaggaatctttcaaatcccatggtcttggatatttcatattgaaattagctttttcaaattactttcaacagatgtcatcatattttcatccttctaagaaatctgtgaaatagaaaaggtagatataaccatcttaccaaggaaaggtgcagagttgaagtgaccagtactatcccacataactagctaatatcaacactgggattagaacccacgtgttctgattaagaacagatttttcttctaccaagccagctggttctcaaagtgtggttcccagaacagcagcttcagcatcacctgagtttttaaaattgcatatccatccttggactcctccccagacctactgaatcagaaactctggaggtaggacccagcaattatggttgtttgtttgtttgtttgtttgtttgtttgtttgttttgagacggaatcttgctctgttgcccaggctggagtgcagtggcacgatctcgtctcactggaagctcttcctccctggttcacgccattctcctccctcagcctctcgagtagctgggactacaggcgcccgccacctcgcccggctaattctttttgtatttttagtagagaaggggtttcaccgtgttggtcaggatggtctcgatatcctgacctcgtgatctgcccgccttggcctcccaaagtgctgggattacaggcgtgaaccactgcgcccggccgggacccagcaattatgttttaacaaacctgccaggtgattctaatgcatagtaaagtttaagaatcactgtactaaacaatgatgccaagaacttgagttaattaatctcatgaagtgacagtttttcctgtactacataaatgaaatgccaactaatattaaaatgccatgtttgctttttttttgtatgacttgaaaacagtttactgaaatggacttacatttatattatgatataattttgtgattatgtctgttaagggatgagaacagcagtgtgggtatacttgattttgggaaaatcaaagagaaatactgctaagtatatttctaataagccataattataatatcaccttgcatttgtatataattttgtattattccatgcatttttatatattactttatgtgatcttttcaaccagggaaagttaagtagctttgtaacatttctcctttccccataaaacctagaaatttatttaataaacaagaaatgttgaatcttctgtttcctaactgcagatttaaacttcatggcctatcctcatataagagacatgaaattgtatacatgaccataaagttttgaaattacctaatatttctttttcttcgtaaatgacagcatgatatcaatggcaaatgcggggaaagtagacaaatcgattaccttctcggtctttgttgcttctgtggcaagtcctcccactcatctctttacattttagtcacctaaaaagaataatcataactgaaatcctggaaatcactgtctatttttaacctagaatagactaactaatatcttagccttaaggtgaatttaattgatgctctattttctttcagagacgttttctttggaccaaagatctctttcgtgattccttgcaacaatcaatgagaatcttcatgtattctggagaacaccattcctgatttcccacaaactgcactacatcagtataactgcatttctagtttctatatagtgcaatagagcatagattctataaattcttacttgtctaagacaagtaaatctgtgttaaacaagtagtaataaaagttaattcaatctaatttttctctgtgg

SEQ ID NO: 36763 - DNA, 50598 bp, Homo sapiens
tttccgcattgaaggggctgctccgaatggagggggaggggaggtgtttaggagaaagtaggggctgtgggtgtcgggagccggctgacgggtggacaagggggggttagcagctgggctgcgaccgttagggaggggctcaaggtgtgcatgtgtgagggaagagagagagagagaagggcgcctcagaggtgactttcagcctgcgagccttcttcccggggcgccataaacgcccccaatttcccagctgctaaaggaagaggaaggtgggtctcgctggcggcttgaggaggggcggggttgggcttccggcgaccccctggatgagtgtgtttcccgctctcgctggcccgctgtgtggtctcggaggcggaatttgggcttctgaggagcgcagggcaggcggggcgagaatatgtacgggaagggtcggtgccctcccttgggactcccgcgccggtgcacgggtctgcctctagccggtgaccccttagtgtccgctgcgggggaggggcagcgtagccttcggcccctaccgagaaaaagctgcggccgggtttcactgctcgaggcgggaaggcggggagctgaggccccgaccggtcggccagccagagcgtggaattggtagcgcctcctagtcccaggatgtttatggctggtgaaaatggttgcactgcccccgctggccggcctcgcccgcctccccgacccctgcttgggcgggagccgctgttaaccggggttttcgggggaggcgtttggggcctggacggcggcgcggggagggggcagctaggggcgcggcctgccagtgcctcctgcagtacagccctggagggcgtggggacttgggggcggtgaaatagccgctgtaggtccgcctctttcattgaagaaatttaagttcgtgtggttttaccttttccgggagtctccagctggccctcatttgtgtccggagctcaggagttcccaaaccgactcagtcgcaccaagtttccgtcttttggaattggggaaggagtttctttctttcttttcttttttcttgagccagttttaatcgctttgaataaatactcccttaagtagttaaatataggaggagaaagaatacatcggttgttaaagcaggagaggaagagagacctgccctgtagcgtgactcctctagaaaaaaaaaaaaaaagccggagtattttactaagcccctaaaatgtcgagatttgtacaaggtaagaaatgctgctgcttatatcccgagttgcttcaggcaaatttgggtactgacagtggagaggttggtgggtggtttggaagtggaaatgttcatttgagataacatttgcgaaacccttttcgttgaattgtcatctgagctgccttgagctgctgggttgacgttccagacgcgtataatttatgctcctgtaccctgctgggtttagttttgcctccctgaaatcaggttagtagtaccgtcgctttcctggatagtggctgtaagtgataaaacaggatttttggctgctaattaatccttgttctcttttcctggtctgtgtcaaggtacctgtgcgtgcacgcagacgggaagggctggggaagcgggaggactgagaaaagccgggtgggttttgccgggactgttggggaagctttagtgttctccgcttctacttcgtttgtgtgtacgtggtttgcgtctcagattcacttattgcgaaactgggagtagcccgaagaagctggaggtcatttcagctggagaaatgactttgctgcattgctgtgtttattttttccttttttgaactatgaaaagatgattaaggttcctttgaagtttgaaaactgctctctaaattccacatgtgtatttaaaaagggttagggaatgcctcaactgagattatcagtaacgtgtatatgaatgcatgtgtgtacggtgtactcactgaaattggtgctggcataaacctttgacaccagtttgtagcatgagatttgccttctggtatgcaagtaaactctttccttgtagactccagtgtgtgaaagcttcagccatcttgatgaacacacagctagtaaagttcacaaacacttattatgcttcctgataaatgtaggtgtacttttggaaaaaaaaagttgtgtcagtaatggccatcatttgaccctgggaataaaaatgccctactgagttctacatcgctttattaactcttctttaaattttgtgtagtagattaaagtaagagaattcgactgcctgtgttattatcgaaacagatcgaacgctatgcttgcctttagcgctaagctcagaaatgtcacttgttattagactttcaaattcatgttataccttatatgtggtaagagatgcttatgttctgattgagtaaatgtcttattcaagaatagaaaggcagaactgttagaaacgtactggttttgtaataacaatattcagttaccataaaggcggtattttgcaagaatatgctaggtaaaagtggacaagttacttctctttaaaagttagaaatattaataaacccaaggtgttccatgtagagttatgctttagaataggttgcagaattggcaagcattgactgatttcacagcctttgctgtaatgccaacttgtcctcagaagattcaaaatcaagtggtaagagttgctgtgtatgtttgtcattactttgtcatccactttttttaaaaaaactttttatattttggaatacttcaggatttatagaaaagttgcacatttgtcaaaactaagaaattaacataggtacattactgttaactaaaggctttgttcagattacagttcccatgattcactctaagataccagattgcacttagttgccagccactttttttcttttttctttttctttcttctttttttgtcaaggtcttactgtgttgtccacgctggagtacagtgggtattcacaggaacaatcatagtgcactacagcctcaagcccctgggctcaagctgtcctcctgcgttagcctcctgagtagatgggacttaggcatatgccatagcctatagttgtcatacatttttactttaaatggtagttttccttttaagatgggcagttttgcacaagaatatgacacctcctcaaaattttttgacatgaatgtgctcctgtttatcattgtttaaattttgtacagtgtgagccctctatatgtttaactctgctgctgttgtaaatgataaacctaattggcaaatgacacagctgtctccacaaaagagctttcaagtgtaagggttggaaattttggttttgattatttttttaagcaaatcaaattctttgatctttgctgcagaaaatattgatatttccaatcactggcacttagtagttcatgctccttcataggggaaagagttaacaaatgttaggtttctaacttttttttttcatgggttttctcaagctttataagagtcctgagatgtagattttttatcctgcccttacaggtgaggaaagttaagtatcttgtccaaagttcacagcttgtataaagcactgattgattgatagattgattttgaggcagggtctcactttgttgccaggctggagtgcagtggtgcgatcacagctcactgcagccttgatctccttggcttaagcaattttcccacctcagccccctgagtagctgggactacaggtgcacaccaccatgcctggctacttttctccttttttaaagagacaggctttccctatgtttctcaggctggtctcaaactcctggtcttaagcgatcttctagcctcagcctcccagagtactgggattacaggtgtgagctgctagtgcacagcactgaaattcttacatgagtgtgtctaaaaccctagtccttcccgacatcttttgttgcttctaacattaacaactgtggaaatggcctgtttctccagctagactgtcagttcccattgggcaaagataatattatatccttgggagaaatacagtgttttgtaagtggacgatactctaaatgaatttgtcatggatgacaaatgagaagcccacagcttagcattttccatctactatttagtagcttatcttacatttttggttgtagtttttataacacctcttagattatataaatgttgagaaagatggaaaggtacagacttagatttgaataccgttactagcaggtgatcttaggcacatacctttcaaacctcagtttcttcttagataaaaattgggcagtaatgcttatgcctcagggttattgagaggctgaaatgagatgaactatgtggatgtgctaggcacatattaggtagccagtcaattttacttttctttcctgaaatgatggtggcctttcagatagcattgccacccaaaatataaccacatgtcatcaacagaactaaaagaaaaaaggcaggtatgaaagttctttattttcctattccaggtttcatgttcaggcctaggtgttattatgttaaaaaaaaaaaaaaaaagtgccggggtggggcaaggtaacgtttggacaatatgaatttggttgtagtttttataacctctcaacttgagtacaagttggtgacggttttcttctgaatacagtgaacaaaattttttttgagctcttactatgtatgatgtactgtattaggatttctggcatatcccttatggtaggcactgaagttcagcagatctgggcattacacctaagtgttgtgtacacctgttttgaatgtagtaggatggttgctatacttggcttgtatctccttctccaaatcctaggcattgtgccttagaggaaagctgggtatctccatcctcaagcatattgaccgtaaactattaggtggaaatgttcaattaataaaaatattgaggtaggcaggagagttcttagtatatatttcttggtcaaaaaaaaaggttcacgtttctttggtcacatccccaagtctctgtccctcaggcacttaacattccttctcttaggaagacctttctttactggatctgcagcataattcctagctattctgctgttgggtcaccttctgcctacttgtgacattccttctgctcttccttgctccagggattgttccagggcccccagttattctaaatggatgtgagtaccatctcttccctagctgagtgagaaagggggctccctgtcatagtttaaggtaccaggggcgggggtcatcagcagctgtgggtttttgtcaggtttgtcagtgggtgccatttggaattttgcttttaaaaagttctgagagttatggggtaatcactctaaatgttttgaaacttaataaatagtgaagagagtaatgttgtctagccagctaaggctataatggatgctaatgctctaatattagaggcattgtttttttaaaaaaaatgattctaaatgtgccattatctatctaaattatgtaaaaatgtccctgatgttcttaaattgaggtacatacttacatttcagggaaagtcatttaagtacctctgtcacttaaaaaatgcttgaggcctatcagctttcccatttgttaaaattcttttcataacttttttggtgactcctatttgatagatggcagctagccagggaagattactgagctaattataactggaggggtctccgaggaatacagagatgagaagcattctggggcctggttcttctcaaatcctaaaaccaaatttagcctgttgctgattatttagatgatgaggacacttttagcacagggatagtggcatggatttgagtgaggacaagagccatgaaaataatgactagggcatacccctcattttttaaagatctgatttaagatttattatattatttgaagagaagggtttagttaaattcagtcacagttataaatgtaaaaaaaaattctaaagaaatttaaaatgaagagttgagctgatgaaaagtgctgttttccaacatggaccttgtaatctctgtggttaaattgtccgtgttcttgctaactcagcctttcttctaataagatggatgattttcatttgtgaaagtctactgaggaaaaaaaattgataagggacattagagaaattagaaatattaactggtactctttttgggagtgccattttaatattctgaataaattgaaaaatgaccttaaaaggaaattcaggtgttattttagtccataggtattttcttgtaatatgtttcacagagacccttccctttgttggtatgtattatttttcccttcatagatgaattatagcaagtttaattaaaataatgggatacttagattgtgtgaggaacatcagttggcctaataatgaaagtgtttcaaataaaagaaatatactgtagtttcctagttcccaccaagctttttgcagaagtataggctttcatgctcgtccgtgtgaagagaccaccaaataggctttgtgtgagcaacatggctatttcacctgggtgcaggtgggctgagtccgaaaagagagtcagtgaagggagataagggtggggccattttataggatttgggtaggtaaaggaaaattacagtcaaagggggtttgttctctggcgggcaggagtgggggtcacaaggtgctcagttggggtggttttgagccaggatgagccaggaaaaggactttcacaaggtaatgtcatcagttaaggcaaggaccggccatttacacttcttttgtggtggaatgtcatcagttaaggtggggcagggcatattcacttcttttgtgattcttcagttgctttaggccatctgggcgtatacgtgcaagtcacaggggatgcaatggcttggcttgggctcagaggcctgacataggcattatgagttctcagaaagttagcaatattaattactgaaaagttaacataaacagatatttgaaagtcaacctggattatctgtgaaaatgaagaagagtgtgttaactttctgtaatgccattcatcctgatatccagcatttatactgttggagaaaattccagcaatatgaataaattagtagggcaagttctctggcttggggtttaatggatgagaaaatatgattcagttactacctttttggttggatagaatctctttagaagacagagtttttctaaagactgttgccgttttgacatagcctacaatttcttttctaaatatcatattttgaacttggagtaatagtgtttgaaattgtggccatcttggtcttggtaattgaatggattgtcccaggcacaatgactattaactgaaaccatacttcttagatatttatttatttattcattgagacggagtcttgctctgttgcccaggctggaatgcagtggtgcgatcttggctcaccacaacctccgcctcccaggttcaagtgattctcctacctcagcctcctgagtagctggaattataggtgcacgccaccatgcccagctaatttttgtatttttagtagagacagggtttcaccatgttggccaggctggtcttgaactcctgaccatgtgatccgcctgtcttggcctcccaaagtgctgggattacaggtgtgagccactgcgcccagccaattcttagatatttaaaattccactgccaggcacgtgtccttctattaataacaagttctttgaaagttggctttatgaagctatcaaagaaaattaaactttgtgtgttttttgattgggtgacttatgtgtgagaaaaaagataatactctgtttgaaagctgtttcccagttttcttgattggtgatgcaggcatctcctttaatttgttgcacagtaattgtctaagactcaaatactgcctctgccaacagttccgttgtttatttttctcagtcattaacaaatgaaatcgattgtgcccccaatccattttacaattaaggattgtttttgagaaacatggagaaattggctatgttgtctcgttaatatacataaacaataaaatgtttcatttccgtaaacatttttagatatttctgttagttttttctgtgtaaatcaagagaattgtttctttgtgatttcgcttgtgtcctaaaaaacaaacaaaaagccattaattgtcttcatggaccagaaattagttgtattatgcttagtctcctttttacttgctagtcaacatattgtaaaaatactattttaggggatcctttctttgacagtagctcttcttgctccttggccacaatgaaaatgtgattggagtttgtattttcttctatttgctgctctggcagaagctgatgtaatatttcatttgtgttatatgcctgcctagaattttaaaacttccaaagagcacaagaaaacagaacaacatagttatatccactgttttgggttcatttgtgctaatggtaaaatgctttgccttggtaataaaatatttatggaatgcataaaagcattcttcgatttttttcattgcttagacaacacagtgtataaggaagagttgaagagcatgagatgcagtaagaaagtattattctaattgtagttttaacctcacatagcagacatagttgagctgccggttttcattcagatttagtggcaaacacctggaggtggtaaaccatgtaaatacactgtaactgagaaaggagagaccttgctccagaagaatgagaaacagggcgccaggcaacagggtttgagttccagcttggcattgtgtccttaggcaagtcagcatctctgggcccctgtttctttatctccaaaataaggaattggactcactgaccttaaagccgttctaagcataaaagtttctctaaatgcacacatagcaagttacacggcaggactaccggatcattttttggcttttcatcgtgattttatgttatacctctttctcttcttctcaacaaaggagtgtgaggccttttgtgatgactttcttctcatccattaaacataaaacaaagtggtattatttaacaaatctcttctgaatgttctgttttccataagtagtgttttctttttcctttgagattttaagagctactctattgtataagagtagggttaattttaattgttaatcagaagactggtttatatataaattgtagcagtttttttttaagtaaagcaatgcatgattagcaaaaatcttttttagcgagctgctctgcatatttgttgctgcaacagttcttgaaagcctgatatccttttatttttgttatcaaaaagcatttattaaccattcatatgaatgtaaagctgagtcatctaaaaatatatctcagtgtagtcatagttgacagtctaataactttagtatgaaaagatcatataaaattatgtaagatgcaacttaattgaatttacttttcttaatttatcattgaatgacatggaatattttttctatatttttccctaaattaaactaaatgtaaacatataaattgcccaattttgtttaatctctaaagttagtgaaaacattacattggcatttatattggttaataaaattgaaaagaaatttagtagtcatttgtctagactacctatctgtgtgaaacttctttgaccatatccctgatacttgactaataaatcagcctctgcttgagaagccttagggactggggcttcagatacttatgacagtctatacttatcttaactctgcctttctgtgaccagacatcatggctcttgtacagtttcactttgggcttactaggcactacctacactagactagactttgccttctgtatacccagagcatagctggatcataataggctcttactcatttaataaatgttacatgagtatctactatatctcaggctctgtgtttggcagtgggaatacagctgtgaacattacagacatatactttcacagaatttacagtctgttggataagataaacattgaataaatttttaaaattatgatgttataaaggagaggtacaaggatctagcatatgagcatgtaataggtaacttagtttagaaagatttctaggaggataatctcaggtaatatttaaactgaactctgacaaatgaataggagctattcaaactactattatatgagaatttaagtcctgatctacagtttagttacataccattattaggcacctgtactgtgcaaggtgctaaggtaggttttgggaaaacaaagttgcatgacataatgtagttttttccccctcaagagaatatgttctaggattgcagacatttaactaaagaattggggttttgaggggtgtttgatataatacagagacaggagtgattaaaactcccaaatcagttgtggtagaaagaaaggcctcttggaatgttcagaagccactgcttagaacactaggaataccaccatcaaaatgacagaagcaaatcaagtaaaacagtttgagtctttggggattgagagatcagggcggtttcccagagattgggatgattctcattattctggaactcatactgggccattcttatttttctactttttttctcatttctgcctccccttttctgaaagtgttgagtggtatttgaagtgcatggtttcgaacaatcttatagttaggatgcttttaacttcatggagtagaaaaataccaattcatttggctttcaaaaatgagggtctttttatcccataaatcctgaagtaggatatgcagggttggttaattcagtacaaaagcttatcagaccttccttctgctgtgctatctttgacatatctgcctcattcttgggtcagcttctttcaagggcactaatcatggcagaagaaacgtggggtgattggtggacacatactcattatgtgagtagaaaaaatactatcttttctcatgtatgtcttttttcagtgaggaacacctttctccaaagtgctgtgacagattatacccttatggcttactggccagaatcatattacattttatgcttaaaccaatcactaggaaggctttggaccaatctgggcctggtgccatctctgaaacacagggcattggggcagggagttggtgacagaatagcattggagtagcaagaaggatgaagaatatggctgttacaaatatgttaagataaatggagtataatctaccagagctactcaaagccatactggcaatgtttggttattagatatgcatatctttcccaccccaaacctactgaatcagaatctctctgggagcttacccaggaatctgtgttttaaccagcctccaagtgatttgtatgtacattaaagttttagaagaactattctagatgtcccaaatggaataggaaattgcagcctttaggcagtctgctttcatactttcattagctttggctactccaaaagatacttcagcttggcttttgagacatgcctggataaggaatttgtatttatttccataggcaatgagaatttcatcaaacaaggaagagaagtgatatgatgggggttgcagcttaaggagatcaatccatcctccttggcactattagattagagtgatgggcagactagttagaaagctgttgtcatgactaggagagtaaaaatgctaggggaactaaggtagcagtaatggaaatggaaaacagtgaatggaattacagcaatcatttaagaagttttgatattgcattgtccaatgtgaggggaaaggtgggaagagccaactgtgactgtgaggtataaaccttagtttctacggaaatgttaatgccgtggagaacagggtgggcaaaagagtaatttagtttggatgatcagtcatattttggacatgttgagtttgaggtacccagctgggtatccaggtgtcagaagtctttaaggaagtaaagaatgtgatcctggagctcaggaaaaaagtttaggatgagaggcacatgtttgagtgatcagtaaggagagtggcatgagaattgaggagaaaaaatggtctggggacagaattttaggaatctcaggagaggaaaggaggagccagttagggaaactgaggtgtggtcagagaggtaagaaaagatataggatacacttgagtaatggaaccccataaagagcttttctaggaggaatattcacaaataactgggtttaaaggactgtagtgagcccagaagaagctggttagcttgaattggttgtaaatctagccggcatagttcatatttccttgaaataatcaagatagctttatcttgattatttcttgattatgtcttgaaataatcaagatagctttatcttgattatttccagttgccattaaattcttggagttctatggttatttggatcacaagtcatttcccgatttaagattaagtgcgctctccaattctctgactttgagtatctctcattgtgggttttccaggaaggttgggactgatcagacagaggtggcctagggatggctcttcaacttctctgttgctcttggtgccttccctgtggtttttccatggcctgtgcattatgaaactagcttgtgtacttattttgtttgcgccagtgtcagggtgtcagggaagggtattatgtatccctcttacttgctgaaatacatgaaatgagatccatgaattaagaaacaaaaatattcacttgtcagattgactgtagccctctctcttttttggctccagctggataaaaaagcccatgatgttgaaattttagttcctatgaacaggaagaattaggaaactgggggaaaggaggaacttgtgaaaaaaagttattgcctgttctatctgaaattgacttaaagtgtctagtaagtccagttttatgtggtggggaattatcttgtctgttgattgaacataagaagaggttctgatataaatgcttttggaggagagtgtggtatttagggatttttgcgtcaaggttaaagagagccaggccaggaaaaaaacattagcaaggtatttctgcctcactgtggtggaatgggactaaaaaaacatggctttgcttctgggctccaccattggcctgctctgtgaccttggataagtcattcaactattttcaacctgtttcctcgtctgtaaaatgatgagagtaggttaaatgctccctcccatctataaaaatgtttgactaaggtaatgaaatgtttgactcccaatccactctatgtctaaaggcgtggggaatcaattttatattgctaggcaatagggacaaaacacttcatgaggttagaaatcttggattattcagaggattttagttgaccttcctttagaaacacaactgtccttgtcagaagtgtaacctgagaatgttaaatccaagaaagcttctaacatctgtactacttttcctaccagaaatttcagacctttcttaaaaaattcaggatggatgaagaagtcaccactaagggaaatggttccctgctctgtgcctcctggtctgtgcccagatgcttaagatagctacgcttcttgtctaagcactcttccttattctttattcttgaatattttttattcgttacaagcccttcctgattctttaatcactaaaaacagagcttttagaggggtagaagaggtgacaggcttgttgtaatgttcttttgtttaagccgattatatttataaagagggtggaagaaaacaaattattcttcatgtgcattggtgctgtatcaaacaaaagaaagaaacaaaggttagagacatttctcgagtttgatcctgtgtctgggattttttcaagtctgcctctgaaacttagacctgtgttgacagagagcacatgcaatattaaatgtgagtctttcagccagcctttcttagcttgggttgataggatagtgacttgggttctgtgtgttttgaccttaaatcatgtaaattaataagttattgttctgcagagggagcttctaaaatgttttgttttgttttcaaatggttctcatttagacaaatctcaaacagctactttagttacttctaaactttgtagttacatttagttttatcttatatgttgtctttaattctatctgtataaatgtcttttattcaaatataagtgaaagaatttatagtaggtggagtatataaggggaaagagtttttagccttactgaaatgtgattctgctaaattaacaggcatttgtaaaaataactagttatcaaactatttgaatagaaactttacaaatacatttttaaaataagattgaatcaaatactaaggatagaaggggaagggtggacaaataatccagttgtccctattttatgagaagtaaataagatgattactttctagataaagtataaaacagcctgtgttggtatttttctgccaaagtgtttgggtctggggtgtttctttttctgtttttttttttttttttttttctcttttcttttctttttgagacaggatctgcctctgtcacccaggctggagtgcggtggcgcgatctcgcctcactgcagcctctgcctcctcggctcaaggtatcctcctgcttcagccttccaagtagctgggaatacagacaagcgccaccacacctggctaatttttgtattttttgtagagatgaggttttgccgtgttgcccagcctggtctcaaactcctgggctccagggtctacccgcctcagcctcccacagtgttgggattgcaggcatgagctgccattgcccagcctttttctgtagttttctatttttgttgtttgtatttatctaagagggatttccgtcacctttagtgagatccatctgtcacagaagtgcccggctatgccaaaagcattaaaagtctagtctgacacacgtaagcagtggaaagtcttggctgaaattgggaaccagaagatggcaggcagccctatgcccttctccttttaaaatgaaaacgtcgatacagggaagtagaggcaccttggaattgccaatacctctcaaggggttcttgtttagtggagaatatgaaactggagtgaaacgagtcctaactagttgacaccactgaattactgccacaggataaagggaccttgggattgagcccttttcatttgctgaataccagaaatcagttatagcttaccagctgtttgaatggcttcctggagttttcagttggtggttttatgtttttgttttaagatcttagcaaagcaatgtctcaagatggtgcttctcagttccaagaagtcattcggcaagagctagaattatctgtgaagaaggaactagaaaaaatactcaccacagcatcatcacatgaatttgaggtaaggaggtttctacagtgttccacccccccgcccctcccttcatctgtcttcatgctgagttgctgccggtgatgatgataatcatcacctcaaatcagcacaagatgtacgataacatcaaaaacaaaaaaattagaattgcttaacaattaccggcttttaacatttgccctttgtaaatccattatctttttttcatttaagcctaggaagttttcaaagtcattaaaataatcagaaccaaattatactttgttctgtgttttgatgtcattgggtggagaaatgcatacctgtgttcagttgtaattgagagaagttagcttcatatgtcctgcatgccttttccagagagtcacttctgatagaaccatgctactttgacaattgtcatagaagttttccagaactgggaggcatttacttttttacttgtaaatcaataggttagtattttcatttttatatttcaatttatacttaatgttttgaagctagctgtgttttatttctttttgttcttttagtgaagattaattttcattgagaagtagagaaagatattggtaagtaagtgtagcggccaggcgcagtggctcttagctgtaatcccagcactttgggagaccaaggcaggaggattgcttgagctcaggagtttgagactggcctgggcaacatggcgaaaccctgtctctaccaaaaaatacaaaaattagccaggcatggtggtatgcgcctgtggtcccagctactggggaggctgaggtgggagggtagtttaagcctgggaggtgaagtttgtagtgagccgagattgcgccactacactctagcctggacaacagagcaagactctgtctcaaaaaaaaaaaaaaaagtacagagccagttggaattcccattaaacaaatggtgtttgtttgtttgtttttgtttgtttttgagacaggatctcactctgtcacccaggctggagtgcagtggtgcaatctctgctcactgcagcctcaacttcctgggctcaagtgatcctcccacctcagcccccgagtaggtgagactacaggcacacaccaccacatctggctaatttttgtattttttttgtagacaccgggttttgccatattgccgaggctggtctcaaactcctgagctcaaacgatcagctggcctgagcctcccaaagtgctgggattacaggcatgcaccaactacgcccagcctgtattagcttttaggatgtgaaaaagtcttgctccctccatgtcctaatggtgtaagaatttcatttaacgatattttaaatgtgtaacttgtatctgtctttatgtttttattaaatattaagcattctgctggttgtaacaatgacttctattttcacagcacaccaaaaaagacctggatggatttcggaagctatttcatagatttttgcaagaaaaggggccttctgtggattggggaaaaatccagagaccccctgaagattcggtaagttttagataaaatgtaggaaaatgtagggtaatcttgggcactggttttaacttaggacggttgggtagtgtaggggacctataacaatcatgtgagacaagacaggacttgctttgaattctctgacccctcatcctgaaactatggagacagccttcagctcctttcccttcttttagacctctgagtcttgctgaggtcctctaacagtctgatctccctgtggcagtacccagtatccctggatatgaaatgacttttgcaaagcactaaatatcccataagagcttcgtttactttgtttcttccttctctctcccaaaacatttgatttctcattgcccgtagggtcatggatgcttagccagaccttaaagctctcttcttgtattttattggaatacagcttcactcattaatttatatactatttatcatagcttaagctaatgaatctctcttgttttttcctaatgagaaaattatatatatagttcctagttagaggtacgtttatttgcatatgtggaaaatgtctttcagttcttaatgttttaaaaactatacataacattctcactataaaaaaaaaagctaaaaaataaaaatctcacgtaatgttctctctgaggagcctcttatttttgatgttaaagctaaaattcctcttggctgtaatgcttaacagttacaatatgcatttttttttagggtctattttggtctttaatttccttgaccctagtgaatgaattgtgatttatttttctacttttaagtagtagatttaatagtattttcttccaagaaagagttagaattcttctggataggtatgttgtttaagaaaataagtaggtgtaaattcagtcagattcttaaaaatgtttgggaacagcctaaaattataataaatttaggcactatttattcccacacccccccgcccccccgaaacacttataacttttgcttaggaattaccctaatttaagtaacctcacttatataatttatgatggacctgggtgtagaagtgtagtttccttttttcttttttcttttttttttttagacagtctcactctgtcacccaagctggagtacaatggcatgatcaaggctcattgcagcctctatttccctgggcttgtgtcctcccacctcagcctcctggatagctgggaccacaggcatttaccaacatgtctggctaatttttgtattttttttgtagagatggggtttcgccatgttgcccaggctggtctcaaacgtctgggctcgagcaatctacctgccttggcctcccaaaatgctgggattacagacatgaaccactgttcctgacagtggttttggtcttaattcttgcttgcagacctgggaattttttgttttctactgtacaaacttaacttttcggagacagagcctacttgaaggaaggtacgcagatttattatgttcaatatattttagggttcaagaattagtttttttcagtggagaaatctatcttttgtactttgagagatcatgatatatagtagggattcttgaagtgggggtcagagggtggagaaggaaggagaagaggaatcatgggattttttcggttcagtactaccctaccccattcccaggaaagttctgataaattctttcaggaggctatgcccatgtagtgagccatagttactgatagtaatacagaattgatataggacaaaagaatagaaatataaaataaattctagatgtaacatgattttatgccgtctttttctgtttataaaagtgtaagtcttcattaaaagtgtctttattttgaagcataagttttaagcttcttcagaaaatgtatttgcaatcccatatgcccttaatcttgaaaattttggaatgcagaggcaaaaaataagtttgctcttcaactacgtcatgagtttcttgagggcacaaatgtgttttatatacgatatgcatgttaccagcttttgcagatagttctgagaatacaaatcttgagctaatgtttgttcaccttggttcttttggattcctccttctagcctcctcgtcctactcttctctttcccataggtttcctttctcaggtcttagagattattatagagatcaattttcctttcaaaatgtaatttttaaaagtgaacataggtctttttttaaaaaaaatgcaaataatattttatattcctaagtaaaaagaaattactgtggaagaacagccatttagagtaacatttctcatgtcagccttatatcaaaggtgtgacataaacattgtcataccagtggatctatatttttgtgtatgagttgacaattagcagagtcagccacctggtttgtaagtaaagttttattggaacacacccacacattcatttatgtattgtctataactgcttttttgcaacaatggcagagttgaatagttggagtggagacagtatggcttgtaacaaaacctgaaatacttattatctagcctatttactgaccccattttagtgtatgtattttcagaacatctttggtagctttctttatttctttggccctcagaaaactgacctcatatgcctttgtcatttcagatgatcacttttaatttttatctttattttttattttcttttagagatgaggtcttgttctgtcactcaggctggagggtagtggcacagtcatagctcactacagcctcgaactcctgggctcaagggatcctcctgcctcagcctcctgagtaggcaggactacaggcattgtgccaccaggcccagctaattttttttttttttttttttttgtagagacagggtctccctatgttgtctaggctggtcttaaagtcctggcctcaagtgatcctcctgccttaaccactttttagataaaaatagtttttcataaatactagattgaaggacatattttatagataggcattgaaattttatattgtgaggttttactcgttcttaccttttgtgttgaatgctttgttttagctctcagtgagtacatagatgttttgtgagaagtcttttgagttcatgttttatgaattatggctaataagaacccagtttatagcgttatggataatgctctgctccttctttgtaaatgttaactaaatgtaataataagattatcttgatatttaactacataagtaaaaaaatttttatatatatataaaggttaatgttttaaattagagcaagaaaggacaagccagcatatgtagcttatttgaccatttcattgttttccagagaggttatgagagtgtcttggtcttggccaagcttacacgttgggcatggacagggatgggaaatagatcagagttacgaggaagtacggggcctgttcaagaaggtattggagctgacgagttctcttgagcgctaatttaaaacctgttgaagtcacatggctggcactgacccctggtggtgatgtattttcatttctatacaaaatattctctaaagaaggcttttttaccagcacaggcaacatagacctcacctctacaaattttttttttttagttagctgtgcatggtggcatctacctgtagtcccagctacttggaaggctgaggtaggaagatcacttgagcccaggagtttgaggctacagtaagctatgatatcaccactgcactccagcctgggcaacagagtgagatcctgtctcaaaaaaaaaaaaaaaacaaaaaaacgactttttcatttcaatatttaataggatcaaaagagtgaaggtatatttgtgaacagggaggagttatgtagggtcatagggtagagaattggcatgaagagaatagcatgcatcaatgtggtatttagctccaatggattttttgttttgttccataaaattgctgagactttttcttagtctatcaatacaaaaaacattaaaagctattgtttatttataaggaagtctgaggaagttacagtttatgtgtgcagagtacagatacatagcatttttttttctgaaggtgaaccgtagtacactgtgcatttaaagtttgcacattaaaagaaaaaaatcttgaggcaatctggccaagcatctgatatagtatgccatataggatgatttgctttgagcatgtgaagatttcccagctgcaactagccaatgataaagccattagagacttgttttgtgtgtatgtggagatacacacacaaatgagattctaaaaagtattccacaaaaaggaattagtggcatttaaagaaatggctctgaggacatggctgaataccaaagagtctcatcatttctttgacataaagttttaaaacagtaatatatagaaatactgacactaagcagacatactaatttagcaaatattgccaaagcttcaacttttgatttcatgatgaattgaacagtttttgaatttccctcgggattaccttccttcacattccttcgtgtacaggactttcagaaatggggacctgataaaggaactgacaacaagcccatgattattaattccatactggttacatgtctataatttcactttagaaatagcaatagcaaatacatggaactttaatggcagttacatatttgatttgatagactcccggttttattgttggaccagggtctctaactactgcctttgtgtccaaagtagaggacagtccagtcccacagaattgaattcattaggaaaatcagagtgtgggtttaggtggtaatactactatttgaacattgccagtccctccaattccaatttccaccccacagagaaagtatggtgttaaagaaatggtgttaaagtttctgaaacttcttttgcccacaggcaggctaacaagaagggagatacaagatgattttagtaaagagtcctttactaaggactttactggaacagattgtgacgtaagcaggttggtatttggaactccatttctgttagcatacctttccagctccctgagtcatctacctttgtcctttctaatcatactaaagtggagtgttcttttaaaactatcttcttagctgataaggatatgggtcagatgttccacaaggttgactaattttatgacttcagctgacttctataaaaaggtgatgaatatacataactgttggtagtgtttgaatttttttaaaccatctgtgtatcacttttaccttttacacttaaaaaatactcagaagtctttgaacttcttaaaatttctataaaaattctagatacagtaaggtttagggagcagttggtaccttctcttcataggtaccatctactttgtaggatcgtttgccatctgtaaccacagtgttttacttatttcttgtttttttcatctgggttttctgccaattcttttattgtcatctcttctctagttttccaggtttaaagtgcacagttgggagcattataattttacatctctttagcattttggaaattgctacaatttttaatgaaagggcagtagttacatgagtttgagaggcaaatatatcaagaggaagaaataaaatgctgtaagtaggttaacacatgagcattgaataagtgagaagcaacttacaatatgtgttttaaaatcaacttttaattttagaatagtttgatttacaaaaaagttgcaaagatacactatttttaactagaaacattataaagctatccaagctaatttgttactgtatctcatttttaaaattcccactgagtcaaaggaaggacaaggtaataactaagagtactgatggaatttttctttcaaggtcagaagtgaaaatatatgaaagatagctgagaagaaacttggatgtgccaggagaatacctgtgactagactaaatatggaaagaagtagaagtaggccattaaatacagatttctatttatagatgggcttatttaagacaagtgtcttcatcgtacatagtcctaatgccaacagcagattggaaaatattctcttatttcaaaagaacaagaaacaccatttcaaagggttttttggtttttaatgaagcaaagctttaagcatttttccttttttaaaactttgtaaaaagctgtgtatgcaaagctctatattctgtagttaatgattattgccagtgtttgggtactgacatgtcaggctttgtgctgaatcctttatgtttgtgatttcatttaatattcataacagacctggaagataggtactgttatgtcattttacaaaagaggaaactgaagttcagagtaagtcacctaagagaaggggccctgatgaaccaggtgtagatagtcaggccctaagacctggttctttggtatcctgtagtaacaacaaggagtacatccctatgtttatctctagtgcacagaatgtggcatattttatgtgcttatcaacaacagtagtaataacaatagcaacaaacatttattcagcactaataagcattcttctcaactcttctacatgtgttttcttacatgatactcagataactctaggagctcactgttatcctttttttcataatgcaagacacagtgggggctgagagggattgagttatccacacaattttccttagctaataaggcagaatttaggcccaggtctacctgagcccgcattcctaatcactatgatgtattgtagaacacccaccagttaccaccagtgtttgaaagaaacttgaaagtctttaaagtatggcctttccatcagttctccatctttgggtagagtagagcaggctccattccttcctttagagcctaaaataccctcacttctctttgaagttcttcccacgatacatttaacaaatatttattgactagctactgtgtgataggcactgggcactgagatacaagtgaacaagatagtcaagggcctaatactaacagagctctattctagtgggagagataaaacataaattcataaataagtaaaataatttagaagactaatttcccatcactgctcttctggcccaggcttacccccaacagtcacatctccctgtctgaagtacttttttctgatttatctgtagtcactatgtgaggctgtcgaagtctcctttattcattacatttattctacagacctatcaaatacccactgttttattttaattattgggaatgcaaaaataaagacagtcactcccctcaaagaacttaaaatttggaccatacagtgtttcccaaattttcccgtagaaaatgagtagggtaaatgtaagaggccgtttagttgggaaggaggctgtggctgcctccagccctgcccagctgcctagagggctgaaggaatcaataacacaggcatgcaatagcaagccagttcagaacttttggtttagtgaggagatgtttgcacaaaaatatgtttattgtgcaactgagtaatagctatgaatgtggttcaggagatatttcactaacaggcttctacctagagagaatgaataactggtgttctccattctcagaatgcttgggtctatttttttttttttttttttttaaagagacagggtctcactctgttgcccaggctgaagtgcagtggtgtgaccatagctcattgttaccttgaacttgtgaactcaagggatcctcttgcctcgacctcttgagtagcagggactacaggcacgtgtcagcatgcccacctaattttcaaattttttataaagacaaggtctcgctgtgttacccaggctggtaactcctgggctcaagcgattctcctacctaggtctcccaaagtgctgggattgtaggtgtgagtgacctcacctggccttgggtctactttttattatgcatatgttctcccaccaaagtgagtggcttgcttaccgaagtcagttgtgcttgttctcaaatgtgttcatgctagttatcttggttataatgacataatataattaaattttatacaaactagtgaaatgggtttaaaaaagctctttctaagaaaactgaattgaatgctttgggaaacttggataaagagtaatagcaaaaaaaaatgttgaataggtgtgacaactaagaaagactgggaaaatttcataaatctagaatgattcttctgcatgcagattgtttcacaaatgtctaagctcttggtccacttggaagaaactgaaactgaaaatcacagaatgtatattattgatgtggtttatttaagaaagatgacacacagctctgggtcaacagattcgtgctataaataaggaaaagaccctggtgaatgaatgtagacttatttgtaaaaagttaaaacagttaatgtgtctaaaactttttcatgattctatgcttgcacttatttttaaaattaactgactacttgttcagatgttctaaataattaaataagtgggtttctggtatatgtgctcagtgtagcaggagaaggagcagctggtgagttggtgaagtcctaatcaagttaaggataagaggtaatgttagagctgagacttgaagtatgagtaagagtttgcccaaaaaatcaggggtagatactccaggtttaagagaatgtggtatgcagatactccaggtttaagagaatgtggtatgcaaaggcccacaggcatgagagaacagaacgtgctctaagaactataatttttatagtactcctggagaataagaatgcaaataggtgggaaatgagggtaggcaaggtagtgggggccatgctgcaagctcattgtcaattgggggatcattttggctgaaataagatgctggaaaacacaggatggacgatcctatgccttatagcagtctaggcggatgcattttttaggaagcaagtagggagtagctgtgctttaaattcctcagtgtgaaaccccaaattacataggaaatacagatttctcgtggttcttggtcactgttactgaaatggctactttgacatttacctgtttttaaattttttatttttaacaccatttctcagggatagctgagcttgtggtttaatttctgtatatttatgttgtttattgtgtgaatttttatagttttaaaatccctaattttatgatagagagctataatattcttaaccaagtgcacagtcaacaggtatctgagaaattacttcaagctctatgtaaatcactaaaaaatcctaccattacaaagaccacctacatatacattttgaattcattctgccttcagtgtatttaacacttttttttccaatttgttagtaatggcagtgagataaaaaggcttaagagatttgtcctagcctcattactccttaaccatgtaacattgggcaagttatttaactgctttaagtgtcggtttccttactcataaaaagtagaaataataaaagaacctactttataggattttagtgaggattattaacaatattcataaaagcatttactgtgtgccaggcattttggcaaaggctcaaccacagcaaaggatgctatcgttacacattcaacaaatatttatgaagtacctcctctatgtcaggtattatgctgggcacagtaaaaacaatggaattaagagtctagattgtgctttttaaaattctgtgactttcatatttattctttgcctttggttttaaatatatttttatatgtttgttatcagtgtacttaatttgatgtatgtttcatttatgattcatgaataatttaatactttgtttttatttttagcaagatatcctatcaagtagaagaaccatatttacattcttataattttctttatcaaatgtgttgttagtctgcagttttcattgtattaaataactcatctagcctaacaaatttttgttattgcaaagatacactttagctaattctttaaacttcaggattgcaggaggcctctagtctgtcaggtcaatgagaataaacaacattatgaacatgcttaggtgactattttgtttaatgagttttattgaaggatatctagattcacatactgaaagccctaggttatatgtagaattacctttaaccagcaactccaaccatgtttataggttttatgtctaccaaactcaagataaatgtaagaggtaggccttgtcttagaggactattgtagctattaaaataattaagtacccgttttcatattgtatggaggtggagatgtttaaagagttggtgtgtgttcattatgtggtgtttagtgggccaaggaggctttgcacagtgtccttggcattaagttgtcaaaatttgggtgaaattttaggaaggatggttgatggccatcataggatctttgatcatctatcattaagcatggcaaaaccttggaaatgtcttttcttaattttttgatggtggaaaataagacagtggattcagttaatcacttgaaggaaatattgtagttcacggtagtgtgagcatatcagctcctgttacttctggggattctcttatagttgggtaggttggttctgattttttcctgttattaaaaccgtgtaatgaatataaaactttgcatttctgaattttctaagaataaatgttcagaaatggtgttttcttcagaggatatgcactttttaaaggttttgttttgtatttctgattgttttttaaaaagagtatatcaggctgggcgcggtagctcacacctgtaatcccagcacttttaatcccagcactttgggaagctgaggcgggcagatcacctgaggtcaggagttcgagactagccaacatggtgaaaccccatctctactaaaaatacaaaaattagccgggcgtggtggcatgtacctgtaatcccagctacttgggaggctgaggcaggagaatcacttgaacctgggaggcaatgagctgagatcacgccatcgcactctagcctgggcgacaagagtgaaactccatctcaaaaaaaaaaaaagaaagtatatcaatttgcactcccattcatattaatttgttggtccaacagctgttttttgagcaccaactgtatgtatattagtagagaaccataatgataaaaccctccattcatctagtttctagtttacaatctagtaaagaagtggacaataaaaaatatgtaacgtgatttcaagtagcggtaagtgaatgaagaaaaagaaagatgaacagagaatgaaggggtagaggtaatattttagataggctgggtagagaaggcgtctctaagttgacatttgagtagagacctacagtctgttttattgccaatctcactgtatttattaaagcatttaatattatcactttaaaacatatttgccagttgagatgaaaaatatttttaaatttctagatttttctttgatttttatttattagcaggttgatcttttttccattggctgttgtattaactgctgtttgaaacatttaatagagaactaaccttttatttgtagtaattggtcattggattttgaattgctatgatgctttaatataacaaaaaggcacactattcaagtttggcttcctagagaggacagcgcaaaatttaggctgaaaatgagtgacttttatgattctggctcacaaatacgtggtttttgcttagagttttactaaggctgactttagtaactgaagtagcagattatattgaaggatattgagcatgaatgattgtgttagtactggtgtatgtagctgtttggaggacagtgttggtgccaagatttctaactagctctttgaaaagacctctttacttacatgtaaaaatgttacaaatttttgcctttggactgtgaggactcatccatcactggaaaaattgccttcgtgttttcctttccatagtgttagtaacatttattttagagtaattaaaattaattttttttttttttttttgagacagagtctcgctctgtcacccaggctggagtgcagtggcgcaatctcggctcactgcaagctccacctcctaggtttacaccattctcctgcctcagcctcctgagtagctgggactgtaggcgccggccaccatgcctggctaattttttgtatttttaatagagatggggtttcaccatgttagccaggatgatctcgatatcctgaccttgtgattcacctgactctgtctcccaaagtgctgggattaccggtgtgagccaccgtgcccgcccctaaaattaatttttaaaaaccccaaagatttgggagttaatagctgggaaaataaaaatatgtacttgatctgatagtttgctttgcttataatttataagtggtagaagacaaaaaactttcttaggaaatttgcttttccgggcttgtgatatgtgattgttcattctatttgtttattatagggggattgctttgtaattcctgtactaattttatgacctataaaatttcttatgcaaaacaaagttttctatttaggttttctttcatcaaacttgtatataacgtctattgatccagtattttattttttgaattaaagtagtgggtggttgtaatctggtttctaatcagtgatcaaaccacttttattttaaactaaggatttaaaagtaggacaagaaataattttcagagaacagatttcattaattaatagccgtttgttttattcatttattcgcttattcacaaatgtttgagtgctgccaacgctggggagctaacctgttcgtttaaagatgatgaatatggtggggagtatcaggtggaagtttctgcccttatggagtttacagtcttataatagagccagagaacttagcagacagtttggagactgtaagaattgctgtgataggaggcggtagctcccaaagccaagagctgcaccagattcactactagggctgagggtcacaaatggcttctaaaggaagtgatagttttgccatttggttcttgaactccttgatggggcatacatgtgtgactgcacatacacacacaaaatattttttaaattaaattttaaattgtaaaatacacataacataaaatttactatcttaattattttaaaatgtatccttcagtgttgttaagtatatttttattatttggcaaccaatcttcagaactttttcatcttgtaaaactgagactctgtagcattaaagaacagttccccattcccttctaccccctctcccctaatcccctggcaagcaccattctggtttctgtctgtatgaatttgattacttttgatgactcactagtggacaaaagccttttttttttcctccttgctcttactgcccaggctggagtgcagtggtgcaatcttggctcaccgtaacctctgcctcccaggttcaagcaattttcctgcctcagcctcctgagtagctgggattacaggaatgcgccaccatgtctggctaatttttgtacttttagtagagacggggttttgccgtgttggccaggctggtgttgaactcctgacctcaggtgatccgcccgcctcggcctcccagtgtgctgggattacaggcgtgagccactgtgcacggccacaaaaacctttttaaatctcaagttttctttctgttgttttgaaaattgcctgatttctgttaccaattacatattactggttttgctttcctggagaaatttgagaacatacaaaagcctagggggttgtttatatggcagcgttcttgccagtggaagcacgaagccaacatatagccttagttagagagaccctcttttctctggccatcctgaggcgtctcaggcagtatggagctattttaggagaagaagcatggtttgaaaagggagaaatattatcaaagcttgggttttttccagaaggctttcttaaatcaggggttggcaaacgttttctgtaaggggcagatagtaaatattttaggttttataggccatacaatttggggatgattactcaattcagccatggtagcatgaaaatagccgtagactatatgtaaacgaatgagtatggctatgttccaataaaactttatgaaaacaagtggcagctctcacagaccatagtttgttgacctctgtcttaacatcctcaggctacacatgactggagagaaactttggctgaagcccatgtctgggagatcattcagctagttcgtgacttgaaacctagaaattcaatactatatttcatcaaatttgggccattgattataagttacaccttttatgtaccactaataaagaaaagaaatcaaccaattaattgtaagaacctattggttatatggtggatcctgctttcagagatgttaaaatgttgggtacgggtgagggagtgtgtctgaatcagtgaagtagtaataatatcagccaacatttgaatatttactgtggggccaggcactttgctaagcactttatatgcattatctcatttatcttcataacgaattaatgaagtaaatgaaaaagacttagagcagttaaataatttgccatagtaagtggtagattctaagaaacccaggtagcctggcattaaagcctgtgttctctctcacttactatattttactgtctcatttgatttaaaaggaggctttttgtcaaatgatatcattcatgctggaattgatgtagtttattgaatcgggtcacggaggaaacagcaactacataatttccctttagcatgtccttggaatttcagacatttctcactgcagccagctattgcatgccagtgccctcaaaaaaaaaaaaaaaagatttatgaacctcttctgaaagtgttttttaaatgataacatgtctaagccaagcaaaacatgctggacgaggtgttggtgctctgtatgccagtagagtgtctgtgatgctagccagcacttctggtcctgctgcagaggaggagagtgagctccacgtattactgtaattcaccttcttctgcatccgtgagccttacatccaggatggtgcaatcctgtatgaatgatgcagacttctgcaaagatgaccttattgactttcaaagatacaggacacacatgaaccactcagctctcagtcttagagaattctggtgtttgtagcacaggctgcatacaactaacagaacaaaagttgtggaagcttgcttttgagcacattagggttttcagcacttgtgaccatcaaaaagaaaagtcaaaatggaatggcaattaaagatggtatgcacgtaatcatctcaaaccacatcacagcatcagcttcttattcaagccaaacagaagccttctcattgaaacttagtttggagagaggtaaagtttattttttactctatttgcacattaattttcactgggaaatgaatgacttctgttactaagatgaattttatattctgtgaatgacatttccaatgtagtgaagtaaattgtaagcaaacattttgtttttttgggggtggtgaactagtctgaaagaggctccatttttttatcttcgcaagtacccgttggctcataaagcctgtaaatcgccggtcttagctgagatgtggaagagaaagaaaaagtagttggtgaaatgaagttgtatgagaggaaaaagcgcaaggccttacaagcaagagatgtggtatgttagagaacccaatgctccatgttcctggagcagcgtgttagggggagtagaagaaagagtggaaggtaaaaaaggtcaaatcattaaggaccttgcaaaccctatcttccgcttaggattagattcagctacataggatagagaaacccagaataacacagtagatctggagagaggcaatccagagttagtaagacaattatgtggtaatcagaaacttgggcttctctgtctggctgctctgccacccttatctcctcattgtccagatggccaccagaatgaacactattcatcatgcctctagtccaaacagcaggaagaaggaagatggcacagaccctgccctttcacagagacttcctggaaatcttttaattcacttctagttaatcatattgaccagaactttggcacaaatagctgcaagggaggctggaaattgagtcttttattctggatggcagtgtgcccagctgaaagtcagggttctaaagtgaaaggggaaaaaaatgatgttggggtaggcagctaataatctctgccatgccatgccagtgctttattttatgaatgatgcaataaggagggaaacatgctcaaattcttttttaaaagactgccacttgagagatggagggtgggttggaaagaggtaaaggatcatagagaccactgcaataacacaggtcatgagagtgacaggacttggtcattgatcacatatgagcaggcttctgtcttagcagccgagtatgttatattgccatagagacaggagtaattgaagctgactgcgtagaagaggaggtctacttagaatgagattttcaaggagcaggcagaaagaggaggaaaacagagtatggtgtttcataggtcaaggggaatagagcacttcaaggtttagggactggtctgttgtgtcagatgtatctgagagtgcagataagaagtactgatgttattgataggatttagcaacttagcagagtgggaggtgtttgggtcatgggaacggatccctcatgcatggcttggtgctgtccttgtggtaatgaatgagttctcgtttcattagttatagtgagaactgattgtttaaaaaaaaaaaaagcctggtacctccctccctttttttcttgcttcccaccatgtgatctctacaaaccagctcccctctgccttccactatgagtggaagattccggaggtgctcaccagaagcagatgctgacaccatgcttctttcttgtacagcttgcagaactgtgcaccaaataaacctcttttctttataaactgcccagcctcagggattcctttatggcaacacaaccagacaaagacattattctaggtatgacttttctgttataaagtaaatttgtaggatctttcaaatgatccagattttggttattacctttagaaatgtgaaatagacaatacatgaaagtgactagcacagaatttggcacacaaaccctgtgcagtagcagtaagggtttagtgaataagccagtgttcttggaacactttctgtacatatggagtggcattcctaattcgttaactgtttacacagctcattttccttcaggcaaacttgcttttgttgaaaaaaaattctttcagattgcaataatcatacccttgtgaagcatacagggcaggtactgttagcttgctttgggtgtttggcagtgtctccaggaatagcacaaatatgctaccaagaactgggttatcctattactaatgggaacagtgtgtctatgactgtgtgatgaatttggcttttcttctaactggaaactaagttgtgaacaaacttggcaaggtacagatcatggtagatagttttaaaaagatctttttaaaaatctcattccactttctgcagaaaaactagattgacatcctagagggctgaatgttgtttagagcgtgttcttcagtagattgccaattaactttctttcacttatcccccagaggatgttagctatttggccaattcttttccaccagtgagaagagaacatgagtggcctggcctcctctggactttttgccaggagcctcatgcggtttgccccacctcacctatggagtttccctcctgtctgtttagttgcagtagaggtcttagaacactgaattttattcatgttttgggaaagagagaaacagggtgattagaattgaaagcacaaagatcgcactggtgactgactaaagtgattcagtcagagtaacattgaggctgtatccagtagtatgtgatgttccctgtgttgtctctgaacactagccatctttgcttgagtaaatgtctttgtgcattctcctgggggagctaagtagggaaagtggaaggcaggcctaaaacttgtctctgtgactaggtgtgtccagtgtgactttagctgttgctaagcaattttctaacacatatccccttggcttgttgaactaaaccaagctctgtgggactgcttggttaggtgcctggtagagggtgtggacagtgtcaccaagagagaacacctctgctgataatagggtgatttatgtgatggaaagctgtgcttaccaccaaatttaacatgtaataagctttagacagaaagtgtcctggcttcctggaatcaaatgactagtacctttgtgcacacccctgtgtcttttgaggggtggtggtggtaggggctgggtatgtcaggaaacatcagtgaaagacctcccctggaggcttccaacagtaacgttatcttgaccacttgaaatatttctcccgtcttcatacgctgttacttctttttttcctttccacagttattctgagagtcttctgtggttaacaaattcctcggcaggacctacatttaattagctgcttttaagggttagatatagcaagacaagaaggtattattgaaagcactacataaagaaccatggttccttgacattttaagaggtggggcggctttctgcccccttaacttagcatgcaaggttataaatacaacacatcacagagaaatctggcacttacttgaatggtacataagtctctgtattgtgagttgccagggcctgttcccagaagtctttattgacttggtttttgaattcttaatgttgtccgtggatcagctcattttattttataccaaatatttgaacagtattcagaattacattttaaattcaaactcagtttcttaagatgccaaccttggggatattcgagttaaaactagaagtatatttagtataccttttggctgaaggccaaatggcctagtgttaaaatcaatatgaggctgagaatctatatcaccatcatagaataagtttttgggataacaaagaaattgcagttgttacagttctatttagaaatttagtaaccaagctttaaaatgttgatgttacagtgcaagaacaatagttcatcagcatggttatctggtagattgcttttgcagtcaccataatgcacatctataacagtaaatggacttactttggtcaacggaggttgttggaggagcaagatattttccaactatttttgctagtattgaatgtgctgattatgatgtagctgccatgatgtcaagttttccttcctctctaatagtaactgactgaagtgaagctctgtcctctcagtatcctgagcttgtaaatttcattaatttatggcaatgatgccatttccttgaagttatctcacaaactgaagttttgtgcatgtcgacggataatttctgaatactttctcatttatattaccttattttgtgtgcgttttcaaaaatatttcagcatgcacttgttccttcacacagtcacttgagatcttacattttggatctagaaatttggtgatggagtaatggctctcatgacaagtgtgtctctgaacatcagttttcattgcataaacataaatttttacattttctctagaacagaatgagtggaagatcttcacagcttgtcttgtaagaagtctgcatgcggccgggcgcggtggctcacgcctgtaatcccagcacttggggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaagaagtctgcatgcttaggacacataagttggttatttcttagcagttctggcgattgaactgttgttagtaagtcctgctatgttggttttgttacttccaaagcataattttgggactatttttttgtgcaaacagcctatataaaatgtattaagtgctgttccatcttgtatgaacatctcatgtaagcagatgttctctgatagcttgtctttgaagcagaattatgagagtggcccaccctcttagctcatagccagcaggtgaaaagtgtgagtgaaacactgaatgttgatgattcctaaatcgttctctcaccctatttgtcactgataattgcataacacttttgtctttaatatttcttcaatcaggtatgtttttagcattgttgaattgatcattgtattttgctttcacacttaaaaaaggctctgattatgtctccatgactaagtacaggaaagaaaagcagcacatttaatttcattaactaaaatttataataaaactttccagtaacatgtttctacaaggaactttgtacctaggactcagaacgtgggcagatatttgttttcttctacttaaaagggttggcagtctatttgtgtagcctctcaggctcaagcagtcctcccactccagcctcccattgagtacctgggactataggtgtgcaccaccatgctcaggtaattaaaaaaatttttttgtagaggcaaggtctcaccatattgcccaagctgttctcaaactcctgggcttaagtgatcctcctgcctcagactcccaaagtgttgggattacagatgtgagcccttgcatccagccagaactttctattatttatggtgtgtggatcaaagctgatttagcatgaatacatatgattttggagttctgttttcttctggtgaaattttaaggcagcaaggttgacatttggtttttaattcattttcactggaggtaaaaaaaaaaaaaaagttcctgttagtactttttcttgatgacttatgtcctaaatcaaattaaatagctcaaaattaaacatggttcctaaagctcactttgtttaatgctatgaatgttagtataccaaacatttctgtaaagattagaattaaggtgtaatctagagttttctgcctcacgttattatttaaatttgtataaatatttgttccctcaaaaagggaatattttcctaaagatacctatctaatgtactgagttttatgtttattgtcattctgttttccaacttattgaattatttgaaaacattgttatatataaaattaatagctttcagaattattgtagcatttttacttttataataagcatttatactttgataaaatattgatgttacatgaaaattttcactccaagttacatctagataacgtttacctctatttgaaatagaatattcaaataacaacaaactcaatgatatcccttgtttaagttcctgatattgtaatgacaagatgggtcatactttatagtacgattcaatttatttaaaagttttgagacaaataaaatggcatacaatattgttacacacataggtggtaaaactatagaatgaaagtccggatacccgtaggggtagaagaggaatgtgattaggggcagatgcatggcagtgttccttttttaaaaatgttattctttcaactgtatatgtatattttataaacttttatgtatgcgatgtaccacaattaaaaattttaggtaaaattggaagacaggcctgtcctaccatgtggaaaattgctgctgtgtactctttttttaaagtgtagtcaaaacataaataggtaagactgtctctgaactaaaaattttacctaaaatgaatgcatgaactaggagttttcggtgactttcaactgattttcacatccttgtgagacctctgtaaatattaggtccttgctaggaagtgaaaaataactgataaatggaaattcttggcttttacaaaataattggaaaataattggcctggtcccacttgctgactcttgtaaactaataataggctacttacagccattgatcacagtggtctttctttccttcctctcctctcccctctccccttcccccttccccctacccctcccccctcctccctctcctctttctgacaggttctcattctgtggagtacagtggcatgatcacagcttacttgagccttgaccacctgggctcaggtgatcctcccacctcagtctcctgggtagctgggactacaggcatgcaccaccatgcctggctaatttttgtattttttgtagggtcggggtttcaccatgttgcccagactagtctcaaacccctaggctgccttggcttcccaaattgctgggattagaggtgtgagccaccgcatccagcctgtttcttttagtgactggttgctctcagttgctgggctagaaaagattataagctaccctgttatatcagggtgacaaagattctactgtcatctactcttatttttctagcagtgtgacataaattggaagtttttctctcctaagcaatattaccagtttctttgaaatgctgaacaaatgatggtcatggcagtagagtcaaatgaaaacatccttcaaggattgtcaactctgcagggtgctttgtgtgtgtgttggggggtcaagttgttatcacccctgcgttgtcctcacctggaccacatgctgcaggggaagcgatcagtgtggtctgcagccatcggtgtggtctgcgttctttcctgcctccctcctcttccttgtcatttcacatcccaatatttatgtagcaccccctggagtgcccacaggcctgtcccctcctcttatcttttctgtaaccagcccttattttggttcatgaatatgaatggctttagaaagctacttagcagcacttaccaggaagattgacaatcctaccacatgaggaaagaattgatcattagtgatgattggagcaataacaagtagagagccttggagaagagtgcttcatgttcttctgtatttacaccaaacaagaaagtgtattaatttgcacttggcagttaacatagtatattgcagggtagaagaaataagaaccacagactagtttttttgtggaaagctgttaaaaacaagaattttgttatcaggaggcaacatatgatatatgtatgtatgttcatctgaccaagcataaagagatttttgcctccataggcttagatcactggagtgtgagcctgtcaagttctttcccagtcacacctacccattacacacacacacacacacacacacacacacgttcctacggtagcagaacaaataacagctaacatccacaaagcacttaaggggtagttttatttttttcagtccattatgtgttagctgttgtacaccatgatgtaactgaagagtcaatttgaggacctattccattaaagcaaaataacagcaaacatgtcacataaatggatagaaaatacattgtgatctttctgaaaggtttccttcttactgtaagatgtttagacttgcttgtgcctctgctttgaagaaaagaatctgggcctctgctgtaagttgtgtcactgttcctttcctgtaagggagaagttatagattaaggccctctgctcacagaaatagatgaggatgctagggagaagattgagttgggattttcttcagccccacctcttgccctttccctcccttccagggcatttcttagaacagtgacaacacttaattttccagtattggcttttatatggtgacacctgaaagttaaattcttgaggaaggaattctgtccttgtgcatacctagaagtttgacaaaaagtctatgctacgttcctctgaaaggcaaacttatgactgcatagaggagaatggcaaagaacaagtgtgttttggtatttgcctcctgtggtagaaggaataatgtgtaattttatatgtagttctccagaattgaagtagagccacagtacaacagaaatatttagacttgatgattctaaataaatgacttgatcatttgctatgttgatgcaaaatgggaattgagtgtttgaagatactccaagagatctggatgttcttaaccagccagacaatatatagggcctacaactttttcccccttctcgtactccattgtaaagtaaatgagccactgaactactgtgtgcaagggaagttgcctgttaaagtacttgattttgaaccacaagggcctatgacattaaagaaaagttgattaaaactttccacagagaaaccgaaactttatggaagcatggaaataaccctgggattgatatgctttaacgtcccttaaagctgtttaaattactcctataatgttatttttctttcagattcaaccctatgaaaagataaaggccaggggcttgcctgataatatatcttccgtgttgaacaaactagtggtggtgaaactcaatggtggtttgggaaccagcatgggctgcaaaggccctaaaagtctgattggtgtgaggaatgagaatacctttctggatctgactgttcagcaaattgaagtgagtaacatttagcctttctcatgagatactaaaatagtttttagtttttaagttatcataaatgttataaaatgtagcagatgtgaatttgagctaaccaaagagcctgctatctttaatctctttattggtggaaaaaaggtttagtgttcttaagggcaaatccttaaggttatgtaaaggcttttgatcttaaatagcacctgtggttgttgaaatctctgggtctgttgagattctcttttgatctcccactgctctacccactttctttctggtggcagccttcatcaaggctgggatgatcttgctttattaaccccttttgggagggtggtggggaggatgctgtgtatttggctgcaggtcatgcatgctaagaactgttcttggcttctctcttaggacaaagtcattaatcgtacaccataagctcttttggggcagtggccttattttttccatctccttatcctaatgcctagtatggtgctggcaactataatcctaatgcaagttgtagcagtggctaacatgtattcagcacttattgtccaccaagtattattctgagctctttatatgaatttactcatttgttcctctcaacaactctgtgaggtaagtactgttatccccattttaccaatgaggaaaccaaagcacaagaggttggttacttgcccaaggttcccaagatagttagtaagtgcagaattaaaattttaacatagggcagtgtgacttctaagaccctgttttcttcacactctgctgcctcgtagctcttctgaggttgaaaagatttcagctggggtgtgattcaaaatttttgatcattaatgttgagagtagggagccatgtctttgtcacatttatactttcatccctacagagatgttaacatagagtaaatgcgtaatcagcacttgcctacccagtaaggccacagagcactgtggctgtacacaagctccagactcaaactgcctagggtggggaggtgggggtcctgcctctgccattgccagacccaccacctatctgggccttagtttagacatccgtaaaatgcagacagtagtttctatctcagagggtagtgatttaatgagcaagtgcatggtgaattgcttagcaaaatgtctggctcgtgctgagcagttttttgtcaaatctgtatatttggctacgtacagatgatgttttagatattttatgatttaaccattaagaactaattttgcatatttgagcaaaagaaaagtgagtctgggtaatctaattgtcattttcctccctagcatttgaataaaacctacaatacagatgttcctcttgttttaatgaactcttttaacacggatgaagataccaaaaaaatactacagaagtacaatcattgtcgtgtgaaaatctacactttcaatcaaagcaggtacaatgagtaaaaaattaactctgggtatgttactcctgggaaaggacttctttatcttgtttataacagagcagtttcaagatgtacaggtaccaaatattgatgttcacaagtgtttgatgcccataaaagctgagcatttgttgatatgtgattgttataatcactctggttctctaatttccagttcttaaaattcagtctgcttgagactctgttccatgtccagaatatttggggatagtttaagcctttgctttctgagagcatatttggtctccaggtgggtctgtgaaaatctttttatattcctacattattgataacctttcctatggaaaggaatttcttcaacaccttttatgggcttggggtaatttaataaattctggaggaaatctttggggaatagtgagtaaaaagtaaattcagatgatgaattctgattgaaggccaggaaactggagaaataagacttccatttaagggatggacatcagtccacatgaacttgtacagaagggatgttttgaggctgggtgtggtggcttatacctgtaattccaacactttggaaagccaaggcaggaggattgcttgagcctaggagtttgagaccagcctgggcaacataatgagacgtcgtctctacaaaaaaaatttaaaaattagcattggtggtgtgcccttgtagcccagctacttgggaggctgaggtgggagtatcacttgagcccaggaggtcgaggctgtttgtgctactgtactccagcctaggcaacagagcaagaccctatctcaaaaataaaataaaaataaaaataaaaaagaaggacatttctaaagttgtgtcattagtttgtttggttgtttttaagatctatttcccatggttactttttttttttttttttttttttttttttactttgcagatgttttgcctttattttctagtctttagtctgttgcggtgctagctcccgttttcctcttgccccatcaccagctttacctttcttactagtggtgggaagcagacatcttggaatgctaacctggtgcttattttctgggaaagaaagagatccacccctgaatatatccatttgtaagaatgggcagtatttcccagataggttttcagggaaaagaacaatctcacaactacataagtttgagaaaatttacttgatacatcccttcttttggagagtcataaaacatgaatatcttaaaaatatgatgggtcctcccatctgtatgaccatagagacatgtttttgcagcagctatcaccatctggaaaacagattttggacaacacagatactgagagattttcttaaatggattcacctataattaaattacttattgatagactctgaaaagaagtgaaattttatttaactttaatgtattattttatttaaaggcctgaaatgctctacagggtcaatattgaaaaagaacttttttttttttaaaggtacccgaggattaataaagaatctttacttcctgtagcaaaggacgtgtcttactcaggggaaaatacagaagcttggtaccctccaggtcatggtgatatttacgccagtttctacaactctggattgcttgatacctttataggagaaggcaaagagtatatttttgtgtctaacatagataatctgggtgccacagtggatctgtatattcttaatcatctaatgaacccacccaatggaaaacgctgtgaatttgtcatggaagtcacaaataaaacacgtgcagatgtaaaggtaaataccgagaggaagcagtttagggcttcatgttttcacatttcgtaagttatgaagttaaagacttttttatttgaaagtttctatgttaaacaacacatttaatatgttctgtttgacataatagtatgtatcataaatccataataaatagtatcaaaatcatctctatttttttggataagctacatcagtaattttaactaaaataatttcatacatatttatggcaaaaatctgaaacatgtgaaatctttcagtaaagttgtccaaacctttaatactcttctagtttggcatttaaatgttatttcattgtcccttttatgaaaatttactctgtttctacataatgtatttatatattttttgtataatcactatctttgtatttacaaaaaaatgcacttgagactgatgtggaggcactcactattttctgcctttctagggcgggacactcactcaatatgaaggcaaactgagactggtggaaattgctcaagtgccaaaagcacatgtagacgagttcaagtctgtatcaaagttcaaaatatttaatacaaacaacctatggatttctcttgcagcagttaaaagactgcaggagcaaaatgccattgacatggaaatcattgtgaatgcaaaggtaagccaaggttgtggcccattgagcttcctggttcctaaggtcatagtaggctacacacagaccccatcgcccactccctctgtcccatctattccattggtcactcccttttgccttttcagactctagttcctagccctgtcttccagaatctgctgtcacccctctagtgtgccaagttatggtgccctatatttgaccctgggttgtggtagtggcaaaaacactgggcttcaaaagtagagaacctacttcagtcttagttgttgctctgacactcataggtcatttggccatcggtactttgcatgagttttctgaacctatggtttatcatgaaatgatattactgaacagaagagttttaagactgaaaaaagattacatgtttaagagtttggcatatgataggtgcttgataaatgtcagttctcaaaattatttttctggccaggctcagtggcttatacctgtaatcccagcattttgggaggccgaggccggcagatcacttgaggccaggaccaacctggccaacatagtgaaaccccatctctactaaaaatacaaaaaactagctgggtaggtggcacatgcctataattccagctactcgggaagctgaggcataagaattgcttgaacccaggagggcagaggctacagtgagccgagattgcgccactgcactccagcctgggtgacagatcaagactccttctcaaaaaaaaaaaaaaatttttttttttccatcaatggatctctgaaatcacttcccaaatattaactaacctacatggaactaagttgtaggtgcctaaaacctctgttttctattccccacccctaatttcttacagactttggatggaggcctgaatgtcattcaattagaaactgcagtaggggctgccatcaaaagttttgagaattctctaggtattaatgtgccaaggagccgttttctgcctgtcaaaaccacatcagatctcttgctggtgatgtcaaacctctatagtcttaatgcaggatctctgacaatgagtgaaaagcgggaatttcctacagtgcccttggttaaattaggcagttcttttacgaaggtacgtaactataaagatatgtgagttcatatttcttaaatgtgtaattataaagatatgatatacatgtgaattggagactaattacagtctctaccactgacctgttgtattcctctgtctttgataccttttaaagggaattgaccatagaagataaatattttacttcacatttgaaacatgattgccatatggagagtagaaaataatctttaaattttggggcattttatcttctgtctcttccaagaccagtactgctttcatcagtgggaaaaggttaattctggcttaacaaatacttattgaatgcctatcatgtactgggcagtgttctaggttctagggatttagcagtaaacaaaacagactaaatctttgtcttcacggaattgacattctagtggggaaaggatgataagtaagtaaatgtatgatataccaagtggtggaaaatgctatggagaaacaaagcaagggtggagaatagggaatgcctggggaggtggcggggtggtgttgatggtgtaattttacattgagtggccacaggcagcctcattgagttgattgagtctgacaaatcggtatctagtgcaaaaagtgttctagacaggtggaatagcaagtacagtacatcctcagtgtcatcagtatgttcttggaaactgccacagtaagcagaacaatgtgtaacacattttgccataggctaattgatataaacaagagttcagttcctacagtttatttctggtcacaaaaatatcaccaaattttaaaaacaaaacacttctaatattaaactctgaaataaatgtgagctgtacatacattgattaataaaaacaagataattcttgactcacttattccagttcaggttcactggtgaccagagcttatcccggcagctcagggcacaaggcaggagccaaccctgcacaggccgccatcccatctcagggcacactcacacatatccacactcatactgggaccatgtagacacaccagttcacctaacatgcacatctttgggatgtgggaagaaaccagaatagttggagaaaacccacacagatgtggggagaacgtgcaaactccacacagacagtagccctggctggcaatcctttttttcccctcatcagcgttataacaaagtaacattgaacaaaacagcactatctgtggacctgctgtaaaactccaacctagcctgataagtgaaatccaaaaaatttaatcaatgaaatgtgacactgtgagcctttgtggttggcctatggggtcctgctctgccatccaagtctgttttagtccacagcaggtgtggtttggtgccacctgctgtggatgtgtagaatgcagatggggaattagaaactatgaatgcatgtgtcctcagagtcaaatgaagaaaatatttcaagtgggattgatcatgtgtcaaatgctgctgctgattcaagtaagatgagaattagatttatcagtatggaggtttgggagcctcacaggcatggatttaaaagagaatgaaaaacgaggaattggagatatgaatatcgaaaactcaagagttttgccttaaagagaaacagagaaatggggctataggtagaaaggaatataggatttgagtttttgtttttttttaatgggaggatgtttatacattaatgggaatgcagtcaggagggaaaaaagactgaagagggagagttgctgaaacaacacttgataggccataagaagggatctgatgaacaaatggagaggctggctttaagtaggaatagaagcagtccaattccagtactaggaaggcagagtaatgggcaatgggggcaaagtagtggtggtggtggatggaaacaagtggaagttttctaattgctcccattttcccagcaaaataggaaacggggtcacataggacaatctctagtgcttgtaaatctaaggaaataaaaagacaaagatggtgataacataataatttgtgctgttgctcttcctaaaatgtgctctaatttttcagaatccgacctatccactaaagtccagctccagtctagcctgcttcaaagcatgatctctttttttcagttaaattcagattgtgtgaactattcatctggctcttggcatgttgattatctttaaaaaaaaaaagaaaaaaaacccttagatctgctcaactatcttgtaaattgcttggtgtaaaaacaatgtttgtagctcctggtctttcctgcacggcatttagcatataatgagtgcttaataagtaggtgcttcccacagaggacctgagctttgccaaaaaaggtttctacagttcagttaaactttcttgttaatatttttcctgtctttctttgaacccatttgagacaaatttttatgtttctccttttctgtaaggttcaagattatctaagaagatttgaaagtataccagatatgcttgaattggatcacctcacagtttcaggagatgtgacatttggaaaaaatgtttcattaaaggtatgttgttacaatgaaaattatatttcttacagcttacaatataggtctcattttctagtcataaatttacatttactttaaggaatacttgttagtcttagtgccaccttaattactagtgtaattattttactgaaatgagaatctttaaaataggatcactattagcattagcttactaaagatgattgagtaaaagcagaaaaaaaatgacaatttgtactgaatataacctattaaaggaatgttatcactgtaagaatattcatttacattattgtagtactcaggtactcttcagtgtcattccagcctcacgtaagaaataggagggaaacgggggtataaaagtattaaagctcaccaaagatacaatagctttttccaaatcatgtaattttttaaaaaatctcctaactagatttcatatactcctcccattaaagctacttacttaaatgaagatcttgaaaaaacaaatacatatattgaattttattgctgagactgcctaaagacttaagacatgaaaaatcttatcagtaaactgttataaaaacaacaacaaaagccctatatgtaaatgtaaaccaagcaccttttaatttctctatgaaggttagataatgctggtggccttgcaagtaggcctccaaaaggggctggccatgctgtggcaccgggtccacttcccgctcttagttctacctctaacaaggagacagagaatctagaactactgccaggattgttacagaaggacacattacaattttccttaactgttatttgtttttcatgtttaatattgtttataaaaaaagttacttcactgtaaaaaaaaaaaagttgtacataaacttgatcactgtaagataatcaaattgcatttcagttgcaagtacactcttttgttttccctgtcacttagggaacggttatcatcattgcaaatcatggtgacagaattgatatcccacctggagcagtattagagaacaagattgtgtctggaaaccttcgcatcttggaccactgaaatgaaaaatactgtggacacttaaataatgggctagtttcttacaatgaaatgttctctaggattctaaaataggcaggtactttactatgttactgtaccctgcagtgttgatttttaaaatagagttttctgcagtatgcttttagtctaagaaaagcacagatggagcaatactttccttctttgaagagaatcccaaaagttagttcatcttaaagtgcaatattgtttaatcttaaaactgggcaactttggaagaacttttaacagaagcctcaatgatgatcactttgaattgcttgtgatttcaaaaataaagcagtgaagcaat

SEQ ID NO: 36764 - DNA, 26391 bp, Homo sapiens; identical to SEQ ID NO: 36197

SEQ ID NO: 36765 - DNA, 161919 bp, Homo sapiens
ttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctctttgccgccgtctcctcctcttgcccgcgcaggcacccctctggctgctcagtcctgcctcaggtaacgtgaaaagaggacgggggtcacaaacccgggcatcctgcctggcccgcgcgcgctgccgctccacctcctctgccccggagcagaggcgcctgcgtccctccgcacccgacgggacccctcggcttcccagaggtccccctctcagcggcggcggacgctcccttcctggccgctttcccctttccttctcacttccctcaggctccccgccacgtctgctcccccttagaacctgggaacccattagaagttacctcgctcgcattagggatctttcgttttctcggaaaactcttgtttcagagacttccagctccccactgagcgcctccctgctcgcatacccgctcctgcctcagagatctgggttccttcacttgacttccctccgatacactcttccctcgaaaacgttcacctctacccaggaaaacaattccctcccctcagaccctactgccttccccctcttctttcctcgcttgtcatcgtctcccttcctttcccctctctgctttttactcttcgctgtgaagagtggactaagccagtgttcagatttcgctacaagcgaaatccaggtttgcgtaatttaaaagtctttaaattgtatacctctgagaagaacttgctgaggaatttggacttcatgctgcatgcatggggagccgttgaaggttttgtaagcaggagcttggtatgattgcattatctttggtgaaaatatagaggaaggattgaaagtgaagaccgtggaggcggaaaggccaggtaggcagaaaacgagtgtgctcatccaggcgggagggaatggcccgaaattccaagaggtttcaaaataaagttgagaagaatagtagaaagtttctgacttggctgatggtgtgaatcggtagtgttaattgaaatagggaacatagtctctggttataccaccctcaacgctcctgatctcatctgaaatagggagcataaaaaagcaattttgagagaaggtaataaatttggttttgaacaagttaagtttcagggtttgtttgttagtttttgttttttttgacggagtctcattctgtcacccaggctggagtgcagtggcacgatctcagctcactgccacctcctcctcccaggtacaagcgattctcctgcctcagactaccgagtagctgggattacaggcatgcgccaccacgtccggctaatttttgtacttttagtagagacggggtttccccacgttggccaggctggtttcgaacgtctgacctcagtcaatccgcccacctcggcctcccacagtgctgggattacaggcgtgagccactgctcccagccgagtttgaggtgttttgaaatatcactgtgggtatctggaaatttgggtctgaaaattgggagaaagcttggacctggatacataaatttggagggtcaagagaatatatgggggatatttgtgtgccttagtatggaatggtaatactgaaagatgagaagggctgtggaccagaaggagcatcattgtttgaaaggtaatagacactgaaaaagagagattaaaggaacgggacaagaactagaacataacagcattataataggagccaaagaaaggatttcaagaagggagtggggggcggtgactatcaatgtcacgtgctttcgaggtccagctgaatgagagttaagaagcttttttttttttttctttggtgtcagggtctcactctgtcgcccaggctggagtgcagtggtgcagtctcggatcctcccacctcagccttctgagtagctgggatcacaggcaggagccaccacacccagataattttttgtattttttgtagagacgggatttctctgcgttgcccaggctggtctcgaactcctgagctcaaagctatctgccttccccggcctcccaaagagctggggttacaggggtgagccatcatgcctggcctgccctatatttagcaatcaggaggtcacttgtttcctctgaaatgcagttttggtagggtggggatggcaaagaaggtagtagtgagatcatgatggattgaggaataaatgaggagaaatgagtaaaattattctccagagtttggttgtgaaggagagctggttctagtgaaactcatctttattgagaatatactatatgccaggtacataaagatgctttatagatcacaacagccttgtggttaacatgtcagtatccctcttttacagtggagagtactgtggacaaggatttgagcaggtatgtctagttctgaaacctgtgttctttccattatggcacatgtgtgtttttcttttcagtacaggtgaaacagttctgtaagtgaggggaaggttcatctaggaaatatgtcagtcaggcattttgccctttgacaccaaaaggatagtagtgaaaatggataatgatgtggtagaagggaaggaaagtgagggagtttaacagatggccttatcgatgtgattacttatctgtggagaagtcagtttggagactgaagacactatggtgagtttctgacttgagtattatggccatgggaatcttaaatggaaaatgaaagagaataaagatttaacaaaaaaaattgttggccaggtgtagtggctcactttggattttttaatcccagcactttgggaggctgaagtgggaggatcgcttgagcccaggagtttgcgaccagcatgggcaacattgtgagacctcgtctctacagaaaattaaaaaattagctgggtgtggtggtgcatgcctgttgtcccagctactggagaggctgaggtgggaggattgcttgaaccgggaggctgaggttgcagggagtcaagattgtaccactgcactccagcctgggggaaagaaaaaaaaaaaagcaaaaaaaaactcaggagctaaaagattgttgaccacattgagggtcctactagttagaaataatatatttgtaatggggcccaggagcatggattttacactttcttcaacagcctaagaatagtaggacaaaaaagatggttggattgattcaaaatggaaacttgcaggacagaaagataaaatgggaagcaactttacactgctattgatagtgtaggagatatgtttcattccaagggaccaagctgggagttataagaagcaaaatctagagggaggctggtgtacttagagaataaaaagacaatcagaaatgtggttgaagaccagattttgtaagaaatatataattggacagcccagagttcattatttcaaggtaaagacaaaaactggcttaactgtctcaatgctgttgaaggggaatggaggtgtaggttattgaagtagtgggagattagggggctgtgttgaatatgtcatcaatatgaatgtcacagttgtccagcatgatagcaggagattgagcagaggagatagtaagtcctataggtgggcctgctcaccaaggagggacccagagttggattggtggttccttggcacttgttgaaaagtagtaccaaatggtacagatgtttgtatatgaattaatggtgatatcctcagatacttgatgccctggatgtatgatgtgttattctctcttacagatatatgtttgggatagaccctcaaacacaaaaaatcctttgtaagcttgacatatgatgggctttgattctgtttaaaatatatgtgctggctgggtgcggttgctcacacctgtaatcccagcactttgggaggccaaggcgggtggatcacttgaggtcaggagttcgagactagcctgaccaacatggagaaaccctgtctctactgaaaaaaaaaatacaaaaattagctgggcgtggtggtgcatgcatgtaatcccagctacttgggaggctgaggcaggagaatcgcttgaacccgggtggtggaggttgcggttagccgagatcgggccactgcactccagcctgggcaacaagagcgaaagtccgtctcaaaaaaaaaaaatgtatatatgtgtgtgtgtgtgtgtgtgtgtgtgtgtgtgtgtgtatgctgggaggctagggactctccacctcaggatcctcagtaacatttttttatggttttagttaattgtgtgtgtgtgcgtttgtttttttttttaattaatttttttttatggggtcttgctctgtcacccaggctggagtgcagtggcaagatctcggctcactgcaagctccgcttcccaggttcacaccattctcctgcccctcagcctcctgagtagctgggattacaggcgagggccaccatgcagggctaatttttgtatttttagtagagatggggtttcaccatgttggccaggctggtctcaaaaggttttagttaattgtaaaaagaaaattacacatttaaatatgctcatcccggacttattttgaggagaaaactgacttgcttttatgctttcttccctgtatgaaagtatttatacatatattcttagtgtcatacatttcattttgttttgcaaaaagaatgtagtgttggaatttgaaacctatggtaaaggcatttatgggaatttcatctccttctagtagatgaagcccaattattacattgtattgtgtgggtgatggtgaatgttttgacccaacaatggctattatactatttacaaagtcatcatatggagatgacttcagtgtagtctcactagtgttattttccctgaacaatcacaggcagtggctgtttcagagaaaagcctggttgtaataagttttatgtcttccattcctgaaaatttccaaaaggcagtgtgataaaaggaaaagaacattaggaaaaccttagttgtattcaactctgttgttattaactatatgatggttaatataaaggcaaattacttatcttttgtgagctttagtttttttttttaagatacatttaatctttgaatagataatacattcaactggttattaaatgtaaacttttttaatatataaatttagggctgggtgcggtggctcatgcctgtaatcccagcactttgggaggctgaggcaggtggatcacttgaggtcaggagttcgagaccagcctggccaagatggtgaaacccccttctctactaaaaatatgaaacattagctgggtgaggtggcctgcgcctgctatctcagctacttgggaggctgaggcaggagaatcacttctacccaggaagtggaggttgcagtgagccgagatcatgccactgtactgcagtttaggcgacagagtgagactccgtctcaaaaaaaaaaaaataaaataaaaaataaatttatataacagtgaaaagtcggctgggcgcggtggctcatgcctgtaatcccagcactttgggaggccgaggcgggcggatcacgaggtccggagatctagaccatcctgactaacacggtgaaaccccgtctctactaaaaatacaaaaaattagcagggcgtggtggcacatgtatgtcgtcccagctactcaggaggcggaggcaggagaagggcgtgaacccgggaggtggagcttcagtgagccgagatcgcgccactgcactccagcgtgggcgacagagcgagactccatctcaaaaaaaaacaaaaaacaaaaaacaaaacagtgaaaaatcttacttccatctctgttctttattaacctggttccatgccctctcccaaacactttgaatagtctctttatattcttttagactttattttttatttttaatttaatttgatttaattaattaatttatttattttgagacggagtctcgctctgttgcccaggctggagtgcagtggcgcgatctcggctcactgcaagctccgcctcccgggttcacgccattctcctgcctcggcctcccgagtagctgggactacaggcgcccgccaccaggcccggctaattttttgtatttttagtagagacagggtttcactatgttagccaggatggtctcgatctcctgaccttgtgatctacccgcctcggcctcccaaagtgctgggattacagacttgggccaccgcgcccggccctttattttttatttttgagacaagagtctcactctgtcgcccaggctggtgtgcagtggcgcagtctcggctttctgcaacttccgccttccgggttgaagcgattctccagcctcagcctcctgagtagctgagtagccgtgcaccaccacgcccggctaattttttaatttttagtagacacgtggtttcaccgtgttggccaggctagacttgaactcctgacctcaagtgatctgcccgcctcagcctcccaaagtgctgggattacaggcatgagccaccgcgttcggcctcttttagactttctttaggcgaatgcttacaaataagaatatatggctgggcgtggtggctcacgcctgtaactccagcactttgggcggcagaggccggtggatcacctgaggtcaggagtttgagaccagcctggccaacatggtgaaaccccgtctctactaaaaatacaaaaattagccaggcatggtggcaggtgcctgtaatctcagttactcgggaggccgaggtaggagaatcacttgaaccaggaaggcgcaggttgcagtgagccgagatcgcgccgctgtactccagcttaggcgacaagagggagactccatctcaaaaaaaaaaaaaaaaaaaaagaagaattaaaaatgaaatgatacagttggcccttgaacaaaacaggggttgggaagccaacccctgtgcggtagaaaatccaagtataattttttttttttttaagacagaatctcttgctgttgcgcaggttggagtgcagtagcaggatcatggctcgatgtagactcaactttgtagactcaagtgatcctccctttttagcctcctgaatgagtagctgggaccacaggtgcatgccaccatgcctggctaatttttttttttttgtagagacagggcctccctatgttgcctaggctggtctcaaactcctgggcatcaacactcctcccatttcagcctccggaagtgctggaattactggcatgagccactgtgccttggccccaaatataatttttgaccccccctccgccgccccctcgcggcaaaacttaactactgctgttggtgatggtgttgcataacctggcttcattaatttcctttttttttttttcttttttctgagacggagtttcgttcttgttgcccaggctgtagtgcaatggcacagctcactgcaacctctgcctgccgggttcaagcagttctccctcttcagcctcccgagtagctgggtttacaggtgtgcgccaccatgcccaactaatttttttgtatttttagtagagacagggtttcaccatgttggccaggctggtcttgaactcttgacctcaggccatccgcctgcctcggcctcccaaagtgctgggattacaggtgtgagccaccacgcccggctcctcttttttgttgttgttgtttttttttttttgagacgaagtctctctctattgtccaggctggagtgcagtggtgtgatctcagctcattgcaagctccacctcctgggttcacgccattctcctgcctcagcctcctgagtagctgggattacaggtacccgctaccatgcccggctaattttttttgtatttttagtagagatggggtttcgccgtgttagccaggatggtcttgatctcctgaccttgtgatctgcccgcctcagcctcccaaagtgctgagattacaggcgtcagctactgcgcccggacattttttttttttttttgaattggagttttgttcttgtcacccagactggagtgcaatggcgccatctcagctcactgcaacctccacctcctgggttcaagcaattctcctgcctcagcctcccgagtagctgggattacaggggcctgccaccacgcccagctaatttttgtatatttagtagagacagggtttcaccatgttagccaggctggtttcaaattcctgacctcaggtgatccaccccccttggcctcccagggtgcctggattacaggtgtgagcaaccacgcctggccccaggtataatttttgacttcccgcaaaacttaactgctgttgctgttggcattgcatagcctggcttcatgaatttacttttttttttttttttttaatggctgaccactactgctgcagatctcaatctgtggtacatatcaagcaattcaaatttttatttatttatttttttgagacaggggcagttgcccaggctggagtgcagtggtctgatcatagctcactatggcctcgacctcccaggctcaagccatcctcccatctcagtctcctgagtagctgggactacaggtgtgtgccaccactccaggataagtttttatttttttgtagaggcatggtctcactatgttaccgtggctggtctcaaactcctgggctcaagcaatcctcctgccttcagcctcccaaagtcctgagatcacaagtgtgagccaccatgcctggccaactttttcgtataatgtcatgacctttctgtttcttgagagcacttccagcattagtggcacttggtatggatctcatggtgttattcagggtttacagtattgcactaagcatgatgaaaaatatgcacgaaccttgagagatcactttttactgtgacactttttactggaggaaggaactgctcacgtggagacgattagcatcacacagcattttaggggctactcacaacacttgctcactgaaacagcaacaggaggtggctccagaattattacagaagtacagtatatactatagtcaattttatgcagttgtgatttaatactgcacctttccatttgtttactgttgactatgaatggcaccatgtatggtttgtatttgtgtgcataagtttttatacattttaactttttataatagatttgtatatatcttatagtaaataataaaatagactagtatctacatatattttctgcattcatggcatacctaactttttcttaatttttttgatgtttctaggctaggtgttttgtttctgagtttttttcaaaatgttatacatctccaaaaatttaaaaaatatatttgttgaaaaaaatctgtatgtaatacagctttgcctgtagtttcagctactccagaggctgatgtgggaggattactcgaggcctggagtttgaggccatagtgtgctatgatcacacttgtgaataactacagcacatgagtggacctgtacagttcaaacccgtgttgttcaagggtcaattgtatagtcctgtttttcccacttttcatgtacagttgcccatggttccccactgttctgcacttcccacccccaatcttgcttattttttttttgagacggagtgttgctctgtcgcccaggctggagtgcagtggcgcaatcttggctcactgcaaactccgcctcctgggttcacgccattctcctgcctcagcctcccgagtagctgggactacaggcgcctgctaccacgcctggctaattttttgtatttttagtggagatggggtttcaccgtattagccaggatggtctcgatctcctgacctcgtgatccgcccacctcggcctcccaaagtgctgggattacaggcgtgagccaccaggcccggccgcttatttactttatatatcttagagacctttccagatcagtacatagagagcttcctcattctttttttttggttatatatattattatttttttgagacagaatctcacttcatcacccaggctggagtgcagtggtgcgatctcagctcactgcaacctccatttcccgggttcaagtgattctcctgcctcagcctcctgagtagctgggattacaggtgtgcaccaccacacctggctaatttttgtatttttagtaaagacggggtttaaccatgttggtcaggctagtctcgaactcctgacctcaggtgatccacccaccttggcctcccaaagtgctgggattacaagtgtgagccactgtggcctatatatatattatttatttattcatttattattattattattttctttttaatcacctgcatagtattccattgaatggatgtatcataatttatttaactaattccttataatggacatttatgtttccagtgttttgatattataaacaatgctgtaaaaagggcctttgaatgtgtcattttatatgtgtgcaaggatatttgtgggataaattcacagaagtgagatttcttttttttttttttttggagactgagttttgctctgttgcccacactggagtgcagtggcgcaatcttggctcactgcaacctccacctcctaggttcaagcaattcttctgcctcagcctcctgagtagctgggactacaggtgtgtgccaccacgcccagctaatttttatattttaatagagatggggtttcaccctattggccaggctgatctcgaactcctgaccttgtgatccgcccacctcggcctcccaaagtgctgggattacaggtgtgagccaccatgcccggccctcagtcttttcttttatagcttttggatattgagtaaaaaagatagaagagcctgactgggcgtggtggctcacgcctataatcccagcactttttgggaggctgaggcgggtggatcacctgaggtcaggagttcgagaccagctgaccaacatggtgaaatcacgtctctactaaaaatacaaaaattagccgggtgtggtggcatgcgcctgtagttccagctactcgggaggctgagacaggagaatggcttgaaccagggagatggaggttgcagtgagccgagatctatcttgccactgcactctggcctgggcaacagagtgagactccatctcaaaaaaaaaaaaaaaaaaaaaaagaagggccttctgcatttcagtcctttatttttttaatctatccgatgggaacaagaaaacaattattgtgaagatcaaaatgctctgtgaactgtaaactgtaaatcattatacagattaaatatggtgttatttattaatttgtctttggaacaagtgtggaggctattctctcttcctctgaattaaataaaatagaataatataattttttgggggggctgggcgtggtggcgcatgcctgtaacagctgctttggagggtaaggcaggagaattgcttgaacacaggaggcagaggttgcagtgagtcgagattgagccattgcactccaacctgggcaacaagagcaaaaactccgtctccaaaaaaaaaaaattttttttttctttctgcagtatggaaaactagggtggtattgatcttgtggtcagtgttttccttggacaatttcatggaatcttcttcacaatgacttccacaatgatttcactatggaaatcataaagtattttttatacttagtcctattattctttgtattaggtgtaactagaatctgactaaaagttctcaacatttgtttcactttcacattacatagtatttactttgggttttgtattgctactgtttgttaggaatttgtattttggaaggatgttaaaaatttttttggcgattataaaagtaatgcatattcattaaggaagaattggaaaatagagattttaaaggagaagatacacattattcataatttgcccatgattcaaaaagttaaaaacaggctgggtatggttgctcacccctgtaatcccagcactttgggaggctgagacaggcggattatgtgaggtcaggagtttgagaccagcctggccaatacggtgaaaccccgtctctactaaaaatacaaaaattagctgggcatggtggtgtgcatctgtaatcctagctactcaggaggctgaggcaggagaattgcttgaacccaggaggcagaggttgcagtgagctgagattgtgccactgctctccagcctgagcgggccacacagtgagactctgtctcaaaaaaaaaaaaaaaagttaaaaaccattgttaacattttggactgtatcctctcagaattatttgtctgtgtatgtctatattgtcgtcaccatctctccaggatttggcatagtgcctggcccgtaagaggtgctaaataaatatatgttggctgagtgaatgaaagaaggagtatgttttttacattgaaaatgtggaatctcgatgtcctatttattttgctttttctccactgtacattttgactcaatattgtagtattatactttgtattgccatagtttgaaggtaagtttgagtccaagcccttagcttgaactaaaagagctcatagtctggaagctcatagtccagtgaaagagatgataagcaacaattaaaatactatatgatgactataataactaagacttgtgcagggtgatatcaaagcacagaaaatgagattgaggggtcagagaacacctcccacatgagatgattactgagagagtcatgtggaagaatctgggaagaacacaccagggagaaagaatattacatgcatagatattgaagtgtgagcagggctctacaaatatagcaattctctatgtttggagtagattgtgactgcagatagaggaatggacatagatgaggctggagatgtgggtaggggtcaaatgaggcagaacttttgtatgacacatgaatgattctcagaagtttacttagcctggtgaaacagattgaaaaaagtgtgagagtggagctaggaagaccaaaaagacattaattgagtgccaagtaagtagtatagtcagattactacaagagctagaatgacatgaacatcatataagctgaggcagaaagtcaacactacatcagaagggtgcgttaagtgtagggaataatgattagcctaattatagtggagcagagtagggaataatgattagcctaattatagtggagcagagtcttcgaatgccgggctaaagaattttataagcaacagatatcattgaagatttttaactgtcacctgtattgtctgaacagttacaggttgcttccttctggctagtctgaaatttggttaaaatctttctttttttttttgtttttgagatggagtctcgttcagctgcccaggctggagtgcagtggtgtgatctcagctcactgcaaccaccgtctcccaggttcaagtgattctcccgtctcagcctcccgagtagctggaattacaggcacccgccatcatgcccggctaatttttgtattttagtagagacggggtttagccatgttggccaggctggtcttgaattcctgacctcaggtgatccacctgcctgaaatttactttcctgaacttttatcaggaaaaaatattaaaggaagcaaacctctatcagaaagttaaagaaattccatctattatatatcagtatgaattcagtttaatgactatatcttttgtatttgtttttttgattttttttttcttttttgagacagagtctcactctgtcacccaggctggagtgcagtggtgcgatttcagctcaccgcaacctctgccttctgggttcaagcaattctcctgcctcacttaggctcctcagtagctggaattacaggcatgtgccaccgcgcctggctaatttttgtatttttttttttttggtagagacgtggtttcaccacgttggccaggaattcaagaccaatctagtcaacatagtaagaacccacctcttcaaaaaattaaaaaatcggccaggtgcggtggctcctgtctgtaatcctgggctcaagggatcctccccttggcctctcaaagtggtaggattataggcatgagtgactgtgcctggctacctcattctttttttttgagatggagtctcactctatctcccaggctggagtgcagtggcgtgatctcggctcactgcaacctccacctcccatgttcaagcaattctcctgcctcggcttcccaagtagctgggactacaggcgtgtgccaccaggcctgtctaattttttgtgtttttagtagagatggggtttcaccgtgttagccaggatggccttgatctcctgaccttgtgattctcccaccttagcctcccaaagtcctgggattacaggtgtgagccaccgcgcctggctagctacctcattcttttaatgactacataatattaagttgtatggatgcacatggattgattgattggtcttgctctagtgccgaggccggagtgcggtggtgtcatcttgactcattgcaacctccgctcctgggctcaagcgattctcctgcctcagcctcccaagtagctgggactacaggcatgggccaccacgcttagccaatttttgtattttttgtagagacaaagtctcctcatgttgttcaggctggtctcaaactcctaagctcaaatgatccacctgcctcgggcctcccaaagtgctgggattacaggtgtgagccattgtgcctggcctgtactgtaatttatttaatctatctctatttttggatatttggattgtctccatttttctgttactgtattagtcagggttctctagagggacagaactaataggatatatgtatatatgaaagggagtttattaaggaagattggctcacatgatcacaaggtaaagtcccacgataggccgtctgcaagttgaggagcaaggaagccagtgacaaatcagtccaagttctaaaacctcaaaaagtagggaagctgacagtgcagccttcagtctgtggccaaaggcctgagagcccctggcaaatcactggtgtaagtccaagagtccaaaagctgaagaagttggagtctgacattcttgggcaggaagcatccagcatgggagaaagatgaaggccggaagactcagcaagtctgcttttccatcttctgcctgctttattctagctacactggcagctgattagatggtgcccacccagattgagggtgggtcttcctcgtccactccactgactcaaatgttaatctcccttggccgcaccctcacagacacactaggaacaatactttgcatccttcagtccaatcaagttgacactcagtattaaccatcacagttaccaacaatttatactttaatattcttgtacatatatctttgtgtactgatagcaactgtcatttttcatggctataaaaatattctcttggccgggtgtggtgggggctcacgcctgtaatcccagcactttcggaggctgaggcaggtggatcacctgaggtcaagagttcgagaccagtctggctagcatgatgaaaacccgtctccactaaaaatacaaaaattagccaggcgtggtggcacatgcctgtagtcccagctacttgggaggctgaggcaggagaattgcttgaacccaggaggtggaggttgcagtgaaccaagatcgcgtcactgcactccatcctgggcaacagaacgagactcaaaaaaaaaaaaaaaaaaaaaggccaggctaacacaaggaacctaacttcctctttcctcttgattactttctttcccacagtctctgaaattctgaaatagccctctaacatcagaagaaaaggtgagttgcctttcttttcttttctttttttttttttttttttgagatagagtcttgctctgttgccatgctgtgcacccagcccatgagttgcctttctgccccaagtggtccttttcaggccttctcatatttaactaggaaaattgatcaaaggagatattatcctggaaattcataaattcacctagtgctttaccatctcacattatttgcatcgggtccaatattagttttgtgttatttcatattccagcatataaagttatagatacatttagtatacacagaagatcagaaactgcattaaaaaaaaaaaaagagatggaggccaggtgtggtggctcacacctgtaatcccagcactttgggaggccaaggcaggtggccaaggcaggccaaggtcaggagttcgagactagcctgaccaacatggtgaaaccccatttatactaaaaatacaaaaattagcccagcgtggtggtacgcacctgtaatcccagctactcaggagactgaggcaggagaatcgctcgaacccaggaggtggagattgcactgagctgagatcataccattgcacttgagcctgcacgacagagagacattccgtctcaaaaaataaataaatacaataaaaaaaaaagagatggggtcttgctatgttgcccaggctggtctcaaagtcttggcctcaagcagtcctcctgtcttggcctcccaaagtgctgggattacaggagtgagcaactgtgcatggcccagaaaatttttttttgagaccgaatctcactccatcacccaggctagagtgcaatcttggctcactgcaggctccgcctcctgggttcaagtgattctcatgcctcagcctcctgagtagctgggactacaggcatgcaccaccacacctggctaattttttgtgtatttttggtagagatagggtttcataatgttggccaggctggtctcgaactcctgaggtcaggtgatctgcttgcctcagcctcccaaagtgtgagccactgcgcttggccaaaaaatgtcatatatgatcttaatatcattattatacttaactaaattaacagtaattttctactattgtctggtagtcgtgcttattaaaacttccccaattggctgggcatgatggctcatgcctgtaatcctagcactttggggggctgaggcgggaggattgtttgagcctaggcgtttgaggctgcaaatgagctatggttgagccactgcactacaccctgggtgacagagcaagaccttatcttaaaaaaaaaaaaaaaaatccctaattgtcttttatagctggtttgttcaaatcaggatctagccaagtatcatcattgcatttggttattttaactgttaattcttcagagtcagaatttgaacatagtagtgtgtactccaatgcgtttgctttttgttatgtcattggaaagaagaaaagctttttaacaaccagaactttgcaataatagaacagactactgtagtgagctctttgttactggtgttgttttagtaggccaggctgactctgccttctgtagtgtccaatccagtggacagttttcttcataccatatactactttgtggtatttgatatgtgtgttgtttccacttttggtttctgtgacatattaggttggtgcaaaagtaattgtggtttttgtcattactatcaatggcaatatactttcttctggttttattcttgcgtttttcctttttagtctcatttgtatactcttcctttttttgtcctgtatatattgatgttcccttgaccacttacctgctttcacctaagcacaaaaagaaggtgcctgggctttggtgcatggtaggaactcggtattacctagagtcatattctgtactttgggaaattttttagtaagtgctagtgactttttttttttttttttgagacggagtcttactgtcttgccagggagtgcagtggcacgatctcggctcactgcaagctctgcctcccgggttcacaccattctcctgcctcagtctcccgattagctgggactacaggcacccgccaccacacctggctaatttttttgtatttttttttttttttttttttagtagagacagggtttcaccgtattacccaggatgatctcaatctcctgaccttgtgatccgcctgccttggcttcccaaagtgctgggattacaggcgtaagccaccgcgcccggcatgctagtaacttttaagtgtacatcttcagtctagtcctctctcctaagctccagtatggtgtctccaacagcctcctggacattgttaactggtgttccttcaggcaacttaaactcagtaagatctgagaagaatttgcgtctccttacacatcatatcctttaggtgaatggctagccattctcccagttacccaaaccagaaacatgggagggattctagttaaacttggagtcatctgggtacctcttgtacctcatatgtctacttgatcaccttttttttttttttttttgagatggagttttgctcttgtcccccaggctggagtgcaatggcgcaatcttggttcactgcaatttctgcctcctgggttcaagcgattcttctgccttagcctcccaagtagctgggatcacaggtgcctgccaccatgcctggctaatttttgtatttttagtagaggtggggtttccccatgttggccaggctggtctcgaactcttgacctcaggtgatctgcccgccttggcctcccaaagtgctgggattacaggtgtgagccacggtgcccggacttgaacacctttttttttttttttgagatggagtcttgctctgtcgcccaggctggagtacagtggcactatctcggctcactgcaagctccgcctcccaggttcatgccattctcctgcctcagcctcccgagtagctgggactacaggtgccggccaccatacccggctaatttttttgtatttttagtagagacggggtttcaccgtgttagccaggatggtctcgatctcctgacctcatgatccacccgcctcggcctcccaaagtgctgggattacaggcgtgagccactgcgcctggccagaacacctttttaaaaatgtcacttatctctgctcagcatggtagtgctgaggcggctgaggtggctgaggcaaaggggatcccttgagcttaggagttcgaggctgtagtgtgcagtgatcatgcctgtaaagtccagcctgggcaacatagtgagacccccatctctaaaaaaatggtcacttatcttctctcacttctttttcctcactgccagtaccttaattaagccttccctcttatctgtcattaacaattatcttgtttgggtgcagtggctcatgcctgtaatctcagcactttgggaggctgagttgggcagatcaccaggtcaagagattgagaccatcctggccaacatagtgaaaccccatctccactaaaaatacaaaaaaattatctgggcatagtggtgcgtgcctgtagtcccagccactcgggaggtggaggcaggagaatcgcttgaacccgggaggcagaggttgcagtgagccgagatcgcaccactgttctccagcctgggcaacagagcaagactgtctcaaaaaaaaaattatcttattgtactctattatattcattgatttacatgtatctttcaggagactgagttcttggaaaggtggagtcatgttttattccattttgtacatcctcctaccagagaggcaatattaacatagcgattaagagtacagcctctgggtttgaattctggctcctccgcttcttttttttgagacggagtcttgctctgtcgaccaggctggagtgcagtggtgtgatcatagctcactgcaacctctgcctcctgggttcaagtgattcttctgcctcagcctcctgagtagctgggactataggtgcacgtcaccatgcctgactaatttttgtatttttagtagagatgggatttcaccatgttggccaggatggtctcgacctcctgacctcgtgatccacctgcctcagcttcccaaagtgctaggattacaggtgtgagcctctgtgctcagccttctaccacttcttggttgtgagattgggcaagttaattccttaatgccttcgtttacacatttgtaaattgggggtaataatggcatctattttataggactgttatggatattaaatgtaaagcacttggaaaagcatctggattatagtaaatgctcagtaaatactatagcacctgtcctaaagccttgcacctagtggctacccaattaacatttgagtcagctaatagaggggattcctgaattggtctaaagattaaactagttcatctctaactgcctttataactttcaccctaagtttctgttttatgtcatggcttagggcctggtggattgaagttacacagcaaatatgatgcttatttagaagagctaatacacttttaagaactggcttttgatctgtctggtactaatatatgccattgtgtatattcgtggttaattagataagggatgccagtttttatgctagattgcctttggtttgaatggaaactgcaactcattatttcacagcaggaaggtaagctcagcagtattgcttttatttttaattagatagtcatcctgaaacgtgtctgtattagctgtgttggtccatagaaagaataacagctgagcagacttgtcatgtagatttgccatgtgtttggtattgatacacagctaatgtacttgtcagtattcccattctagaaaataagtggccagttttcggggctacatattactcataatgaatccttaatttattctggattaggtggggactttttatgattatagaaagaaaacaatgtgatgaggatattggtatattatgtttgcagtctttttctactctttatatctagggtgtgaaagtccactgaattctcagaaatcttttttgatgactttgtgggataatattaccaactttgtgcacatatgattccatatttggatggacattgacaatttttgattgctggctgacactgccaaatccagctacctgttggtagatagctttctagtgcattgcaggattaaatttgtgtctggactattgtgaagttgtatctactttgttttgctgaaatgaaggggtgagaaacagcagatactgtgcattagaatggaaaatagagaatgattgggatttggcatattttccctgtcagcatggcatccattctttagaaagcctgtttaaatcaatactgatttttctgtctgtagaatgtgattgaatgactgaaggaaggcttttgcctcagagactggtagagccatcatttgtacactttttactcaccctgttgagggaagttggggaatagtagtagctttctacgtagctaacccacaaatcatttttcacagaaatttgatgtatttctgaaggagacatgttataatgggaagtgcttaggtttgaaactactagatttgaatcctgagtctcactagttgtttatatttggagaagtcataatctctcaggattttgatttctttttctttaaattagagatgataatacatgctttgcagagttgtcacaaagattacagataacatacaaaacccttggtagaatgcgtggtctgtagtaaatagtggctgcagttattatttccagaagcatatttcagacaggagtgtggtctgagagtcctaaaaatttccttgatatttctgaaaaatgatttttggaattcttactttggaaagattaaaaaatataatattgaagataggctatttagttcactaacttttttttaattggtagcttttcaaattactttccccaatcaaagcttttagttgtattttctttgtgaaaaacaaatcaactcctatataaatgaaattaatatttgaaaaaacaaacctacctatgtagaaaagaaaaagttttgaacttccaagtttataatatttaagttgagaacatagttactaaaaaattacttgtgtccttataagccacataatttgggcatttttgaaagactgctaaatgctatttcctagtctaagaacaaaaatgattaagcttctctaacacagtgtttctcaaccagggcattattggcatttagggcaggacaattctttgttttgtgcattgtaggacatttagcttccctagcacctgcccactaaaataccagtagtgctcatcccacacccccatcattgtgacaataacgccttatgtttttctggtaatgtgatggtaactgtagttatctctgttccaaaaaaagtatattaatactttgagggacactattagtatcaatagataatactcaatatataagaccaagagaggtaatccagaggcagaaaccatcataaaatgtcatatatttgaaataatgtattttcttattttaaaagtaatcattcccacattttataaaattgggcttggttttagggtttgtacgtgtatatctttgctgccttttattagttattaaaatttgtcagaataaattgacagccatttatagcttggttgatttcatttaaaatatagtcatttagtttgctcgccaagggagcagaaggcatggtttggaagttttctcttgctcagcacttctctaaaatggattaatacagttcttactcccatggagaggactctacttcttaccactcatctcagctatctaatcattagtattactttagcatgtgatagggtctctacactaaatatcagtgtttgttatgagctctctaattttttttttttttttgagacagacgtttgctctattgcccaggctggaatgcagtagcccaaacacggctcactgcagctttgacctcctgggctccagcaatcctcccaccttggcctcctgagtagctaggactacaggtgtgcaccaccatgccgggctaatttttgtattttttgtagagacggggatttcactatgttgcccaggctgatcttgaactcctgggctcaagcagtcatcctgcctgagcctctaaaattgttgggggattacagacgtgagccagtgatcccacccaatattttaagtttgtggacttaaataagttaggccatccaaaaattcacccatgattttgaagttttagcctaagatatatatattcctaggactaaaaactacggtggaaatttagcagaataaaagtttgagagtctagaggcttggcttgcacactggcatgctgtttatttgccaaattgttatcaatgttttggcttaagcatgctacatagctgttgcattagcaatagacttaaaaaaaaaaaaaactgtgaaggccgagcacagtggctcatgcctgtaatctcagaactttgggaggccaaggcgggcggatcatgaggtcaggagtttgagaccagcctgaccaacatggtgaaaccccatttctactaaaaatacaaaaattagccgggtgtggtggcgcgtgcctctagggaggctgaggcaggggaatcccttgaacctgggaggcggaggttgtggtgagccatgatcgcaccactgtactccagtctgggtgacagagcgagactgcatcttaaaaaaaaaacaacaaacctgttaaacttttttgaaattaaaaaaatttaaatgcagaaaagagtacagtataataaataacacccagaattaacaaatattaattaatgaaaaatgataaaattaacagatatatcattttgtgttatttgccacaggtttgtttttcaatagaaggaaacaaaaatattattggcagtccatcaccttaaccacttggccacttcatcacgttaaggaaacaaaattttattagtatagtggatgtctcttttgtttccctttcttgtcatttcactttctttcccctgaggcaaatactattatgaatttagtgtcttcatttttagttcatgcttttagatgttcactataaatatgtaatatctttaataattataataacaaacaggagttgaatgcttattgtttattaggtactatccatttaatcaataactttgtggttattgtaaggattaaatgagttaataaatataaaatgtaggcactgtttttattttcatttttcagatagggaactagagatgtagagaggttaaataacatatctaagttcatataactagaagttacggagcaaggatttgaacccagattgtttggctgtagatgtcatagcattcatgactatgctattctgcttttctgtaatatataatatataatatatattattattattattatttgagatagagtcttgctctgttgcccagactggagtgcagtggtgtggtcatggctcactgcagccttgacctcctgggacccaactaatgcttctgcctcagcctcctgagtagctgggactacaggcgcatgccaccatgcctgggtaatttttgtttttgtttttgttttttttgagacggagtcttgctctgttgcccaggctggagtgcagtggcacgatctcagctcactcaacctctgcctcctgggttcaagcaattctcctgcctcagcctcctgagtagctgggactacaggtgcacaccaccacgcccagatattttttgcatttttagtagatacagggtttcaccatgttggccaggatggtctcgatctcttgaccttgtgatctgcctgcctcggcctcccaaagtgctgggattacaggtgtgagccaccgcgcctggtcaatttttgtattttttgtagagattaggtttaaccatgttgctcagactggcctcgaactcctgggctcaagctatccacctcctcggcctctcaaagtgttgggattatagacgtaaggcaccatgcccgattagtatatattattttgtgtatttttaaaatacatttttataaaaatggtatactgtggggtggttgtgcaattttttttcagtaacttctttgaaaaccttttcttgaattaaattttaataatatcgctaactacaacttgcttttctccccaactctacattactttttaaatacattcacattgctacttataatttgttcatctaagtgctgtatgttttattgagtaatatgccacagtttattatctattactcctacagatgaactttaggttgtttcctttctttccgctgattacacacactggtaaaatgaaatgaatatctttattcaggcctcttgtgtttatgtgcaagagtatctctaagcatataacatttaagaaatacatttacccctcttgaaaagtgctgtgaaccaagatacaaataccaaaatttagtctattgtgctattgtaaaacttctaacaagactcctaccaaagcagctcagttgcaattagcattctttctttctttctttttctctttttctttctttctttgtctctctctttcttcttcctttccttttttccttccttccttccttccttccttccatctcttttctctttctctctctctctctctctctctttcttttttggagtctcactctgtcacccaggctggagtacagtggtgccatctcagctcacttcaacctctgcctcatgggttcaagtgattctcttgccttagcctcctgagtaggtgggactacaggtgcacaccaccatgcctggttaattttcttttctttttcttttttttttgagatggagtcttgctctatctcccaggctggagtgcagtggcgtgatcttggctcattgcaaccttcgcctcctgtgttcaagtgattctcatgcctcagcctcctgagtggctgggattacagatgtgtgtcaccatgctggctaagttttgtatttttagtagagacggggtttcaccatgttggccaggccggtctcgaactcctgacctcaggtgatctacctgccttggcctcccaaagtgctgggattacagatgtgagccaccgtgtctggcctaatttttgtatttttagtagagacaaggttttgccatgttgaccagaccagtctggaactcctgacctcaagtgatccacctgccttggcctcccaaagtgctaggatgacaggagttagccactgtgccctgccacagttagcagtttcttacctcttcctagctagctgagaatgtaaaaccagacccattgagctgcaatgagcaattctgtcttctgtgctgtaatatggaaaactaggatttgccactctcagggaaccctgagggcactgaggaggttagtaaggtattttgttacgaatgaaacatatcttgataacaattcagtaaagttgtaggatacaaaatcagtatacaaaaatcagtagcatttctgtgtgccaacagcaaacaatctgaaaaagaaatcaggaaggtaatcccatttacaacagcttcaaataggataaaatacctaggaacaatcttaaccaaataagtgaaagatctttacaatgaaaactataagactttttttttttttttttatccagtgtcttgctctgtcgccaaggctggagtgcagtgatgtgatcttggctcatcgcaacctctgcctcccggcttcaagcaatttttgtgcctcagcctcctgagtagctgggactacaggtgtgccaccatgcctggctaatttttgtatttttagtagagacggggtttcaccatgttggccaggctataaactataaaatattgatgaaagaaattgaagaggacaccaaaaaatggaaagatatttaatgttcatgaattgaaagaatcgatattgttaaaatgtccatactacctaaaacgatctacagattcagtgcagtctgcatcaaaataccagtgacactcttcacagaaatagaaaaaaaatcctcaaattttagaaccacaaaagacctagaacagccaaaagcctcctgagcaaaaagaacaaaactggaggaatcacattacttgacttcaaattataccacagagctattgtaaccaaaacaacacgagaatactggcataaaaaccgacacataggctgggcatggtggctcatgcctataatcccagcactttaggaggctgaggagggtggatcgcttgagcctaggagtttgagatgatcctgggcaacttggcaaaaccttgtctctacaaaaaaaaagtacaaaaattagctgggtgtggttgtatgcacctgtagtcccagctacttgggaggctaagttgggaggatcacctgagccctaggagatcgaggctgcagtgagctgtgatcacgccactccattccagcctgggcaacagagtgagaccctgtctcaaaacaaaacaaaaacaaaaaaccagacacacagactgatggaacagaatagagaacccagaaataaatccatatacctacagtgaactcattttcaacaaaggtgccaagaccatacactggggaaaggacaatctcttcaatgaatggtgctgggaaaacaggatatccatatgcagaagaaaaacctaatcaaaaatctgatcaaaatggattaaagacttaaatctaagacctcaaactgtgaaagtactacaaggaaacattgggaaaactttccaggacattggtttgggcaaagatttcttgagtaatatccccaaagtacaggtaaccaaagcaaaaatggacacatgtgatcacatgaagttaaaaagcttctgcacagaaaatgaagcagtcaacaaagtgaagagacaactcacagaatgggagaaaatatttcaaactacccgtctgacaaagaattaataaccagaaaatataaggagttcagacaactctataggaaaaaatctaacaatctgattaaaaaatgggcaaaagatctgaacagacatttctcaaaaggaggcatacaaatggcaaacagatctatgtaaagttcctaaacatattgatcatcagagaaatgcacatcaaaactacaatgagttatcatctcacccttaaaatggcttttattcaaaagatgggcaaataatgctaaccaagatgtggagaagagggaaccctcgttcactattgatagaaatgtaaattagtacagccactatggagaacactatggaggtccctcaaaatagtaaaagtagagctacaatgtgatatagcaatcccactgctgaatatatacccaaaagaaaggatatcagtatagcgaagagacgtttgcactcccatgtttattacagcactgtttacaatagccaagatttggaagcaacctaaatgttcaacaaatgaatggataaagaaaatgtggcacctacacaaatggattattcagccataaaaaaatgagatcctctgccgggcgcggtggctcacgcctgtaatctcagcactttgggaggccgaggtgggcggatcacaatgtcaggagatcgagaccatcctggctaacacggtgaaacctcgtctctactaaaaatacaaaaaattagccgggtgtggtgtcaggcgcctgtagtcccagctactcgggaggctgaggcaggagaatggcatgaacctgggaggtggagcttgcagtgagcggagatcacgccactgcactccatcctgggcgacagagcgagaccccatctaaaaaataaaaaaaaaaagagatccctttttttgcaacagcatggatggaacttgaggacatcatgttaagtgaaataagtcaggcacagaaggacaaactttgcatgttcttacgcattgctgaagctaaatattaagacaattgaactcatggagatagagaatagaatgatggttaccagagggtgggaagggtagtgtgttgggggtgttgagtgggaaatgggatggttaataggtacaataatatagttagatagaatgaataagatttagtatttgatagcacaacagaatgactacggtcggcaataattcattgtatattttagaataactgggagagtacgattggaatgtttgtaacacaaagaaatgatgaatgcttgaggtgatggatacctcatttaccctgatgtgattattacacattgtatgcctgtatcaaaatatctcatgtaccctgtaaatatatatacctactatgtacacataaaaattaaagagtttatatctcaaaaatgaaaaagtcagttgatggcaaacatcgaattgttcagtttagcagacaactatgttttatatagtcaacgatgttttatgtactttacatatgttttgtatattacttcaatatcttttatttttctaaagtttcttttttcttttctgtctctgttcaaattataatcagcctagccttcctctgcacttaagtctctgttctttctacagctctcatagtggaaaaatactgagctaagtaataatgaaatggaagaagtttgagctttggtgctggatagaacttggttccagttctggttctactagctctgtatccttagcaagttacttcatcttctgagcctgtatttctttttctgtaaaatggagatcagacctaccttgctgggtttttttgttgttgttgttttgagacggagtcttgctctgtcacccaggttggagtgtagtggtgtgatctgagctcactgcaatctctgcctcttgggttcaagggattctcaaagtgctgggattacaggtgtgagccaccgtgcctggccacgttttgagattaaatgaggaaatgcttttaaaattcctgatgtttaaaaaaaaaaaacagtggccaggggcagttcacacctgtaatcttagcactttgtgaggctaaggtgggaggatcacttgaggccaggagttcaagaccagcctgggcaatacagtgaaaccttgtgtttccaaaaaaaaagctattatgacccatgactctgggttttaaacaagctcctcaggtagtttgaagcacattatcaacagacatactttgagaaatacactacccttggctttttggtttcaagtctagctttgctagtaaataggttatagcattaacttttagcatttgcactttctgggccttatgtttcttcaaatataaaatgaatgactgaagttgatgttttctactggctctaaaattaagaaaatttggtttttaaaattattattatttttttagtgatgaggggtcttgctgtgttgcctagtctggtcttgaactggcaggcatgatggcacatgcttgtagtcccagctacacaggtagctgaggcaggaagattgcctgaacccaggagtttgaggctgcagtgagctgtgatagcaccattgcacttcagcctgggcttggattaaaggaatgagcccctgcacccgaccctattttattttatttttattatttaatttatttactttgagacagaatttcactcttgttgcccaggctggagtacaatggcatgatctcggctcactgcaacctctgcctcccaggttcaagctattctcctgcctcagcttcccgagtagctgggattacaggtgactgccaccacgcccagctaatttttttgtgtttttcgtagagagagggttttgccatgttggccaagctggtctcaaactcatgacctcaggtgatctgcctgccttggcctcccaaagtgctgggatttttcaggcgtgagtcaccatgcctagcctctattttatttttaaaattccatttatattttagattcaggaggtatgtgtgcaggtttgttacaagggtatattgtgtggtgctgaggtttggacttctgttgatcccaccaccgagatagtgaacacagtacccaataggaagtttttcagcccctgcctgtctcccatttgggggcctccagtgtctgttgttcccatctttatgttcatgtgaactcaagatttagctcctagttataagtgagaacatgcgatatttggttttctgtttctgtgttagttcacttagaataatggcttccagctgcatccatgttgctgcaaaggacatgatttcattcttttttgtggctgcaaattttttgtcttataaccctaaatttttttgagacaaggtcttgccctgttgcccaggctggagtgcagtggtgctatcacagctcactgcagcctcaaactcctgggctcaggcaatcctcctgcctcagccacctgtgtagctgggactacaggcgtgtaccatcatgcctggctagtttttacattttttcatacagacgaggtctcactatgttgcccttactggtttcaaactcctgagctcaagtgatcctcttgccttggcctcccaaagtgttaggattataggtatgagctactgtggccagctaaccctaaatttttgttcttgtggatgtaagtatttggtctggtggtgctgatgccactttttggcataggttcaatagaggtacttaaatgttttgttatttgggaactcagagtattcttccttttttgaagactgtggtagaactagattaactagattcaggtagatctcatggaacctcaggatgcagttaggccttaagaattggggattagagcagaatagggaattcaaaaagttcccttcctttttttttctttgaaaattggcctcaatctcttgacttcttctgccttccaggcagtattatagaaaatgcccctggccagcagcttctgagtttacatggcttctattttagaaagccgccatattgagactggactatttaattccaattgcacattgccaggaaagaaactgtggttgtacacactgggtacggtgctgacttctggcaatgggtaaggaggcagactcatgttactaagatggccctgggattcctgccacttttctgagttgcagagctggttagaagtggtggtggtaaactgagtaggtatccacctcctttatgaaagcatttcactaattgaggagtcacaatgttgtattttgcatagaacccttacaattgagtctcatggaaaaaagtagaaagagggagagacaggctaaaagaaaaagtaggcttgtgcttttattcttagttatgtaccagatgggatggagccttctatagttacttctactggactgtgctttttcatcaacagtgaatttttagattgcttttggatatagttttcttttttaaaaattatataatatataattttgaagtctccttgtaatgtttgttttatatatttggaattaatttttgaaataaaatattatatgaggctataaagggtattgattggtagaaagaagcacaggcttttgaatcagacaggctttgcacttcaatttttttttttttttttgagacagtgtctcactctgttgcccaggctggagtgcagtggcacgatctcggctcactgcaacccctgcgtcctgggttcaagtgattctcctacttcagcctcctgagtagctgagattacaggtgcttgccaccacgcctggctaatttttgtatttttagtagagatggggtttcaccatgttggccaggctggtctcaaactcctgacctcaagtgatccgcctgccttggcctcccaaagtgctgggattacaggcgtgagccactgcacccagcttccattttatctctgccttttagtgactgatttcttgatctctctgtgaaatgaacataataatccttatatcatggattatctgagaatcaaacgagatgatgtatgtcaagctcttatactatgtttcctagaaagtaggtgctcaatgaatgatagatattatcattgttattttgttacttagaatgtaattggtgatcttcatgatattctactcatggtaaagactgactatatcttgggctttaaatatatcagtgttatttgagggtaaagacataaaacattttttagatctgaaaaccaggaactagaatgtgaaaggaaatatttttgcattgagcatttattgctttacatgtatttattcattaaagatttcagtggaaatttttttgatctctttagtgtcaaaccagaagagaagtaaaattcaacaaaaatttatgtgtggagttccttcttaaaagaagaaaaaagtgattatttagactatggatcggagcaaacggaattcaattgcaggatttcctccacgtgtggagcgtcttgaagagtttgaaggaggtggtggaggagaaggaaatgtgagccaggtgggaagagtttggccatcttcgtatcgagctcttataagtgccttttccagactgacgcgtttggatgatttcacctgtgaaaaaatagggtctggcttcttttctgaagtgttcaaggtgagtgagtcttcagcttttctcatattgtcttgctgtggtcacatttactgcaggttgatagttgtgtttaattaggatgtaggatttgcctaataaaggtgctgtggatcttgaacactgttctaaattctcctttcaagctatttattaacttatattaagatattttgtttgaatcccaaaaataatatgctggttaaaaattcaaataacataggattctcttccacctcacctctacccccagccacacatgtgtgtatgtatccacacatacattctccagtaataaccactattaacaattcagtatgtatacttctggactctttctgtgcatatacatatattatgcacacaccttaaatacatatattaaaattatatatacacacacccacatatatagtttttgtttgcttatcttcagtaaaattgatagctgggtacaatggcatgcacctgtagcccgagctactcaggaggctcgcttgaggctgtgagtttgagagcagcctgggcaacatagcaaggccctgtctcaaaaaatatgagcccataatgctcctaagcaatcatatttccctgtttcactcactccctcaagagagtattttgtaccttttcttctctcatcaaatcccagtatttcctcactagtcctcattgtcagtaattaatgaattgcttcccaattcactgagaaaattgaagcaagcagaagagaacttctgcagacttccattactacaaatagctatcaacacacatctttacccagttacttggcctttataccttgtactatggatcaactactcatgctcctaagtccattatttctgtttatattgtacattccatttccacttgcctactaataggcattgcctaagaaattctcccctctcttttctacattgtattttcactactaagtattaccattaacatgttaaaaaaattcttttaaggaaaaaaaaaacccaaatattttggctctgttatttcccctttattttattttatttttattttttttgagatggagtctcactctgttgcccaggctggggtgcagtggcataatcttggctcactgcaacctctgcttcccgggttcaagcaattctcctgcctcagcctccctagtagctgggattacaggcgcctgccaccacacctggctaatttttgtatttttagtagagacagagtttcaccatttcggccaggctggtcttgaactcctgacctcaagtgatccacctacctcagcctcccaaagtgctgggattataggcatgagccaccgcgcccaacctattttattctattattttattttattttattttattttttgagacagggtttcgctctgtcacccaggctagagtgcagtgtggtgtgatcatggcttactgcagtcttgacctccctggactcagatgatccccccacctcagcctccagagtaactgggactacaggtgcatgacaccatgcccagctaatttttgtattttttggagagttggggtttcaccttgttgcccaggctgttcttgaactcctgggctcaagtgatcagcctgcctcggcctcccaaagtgttgggattacaggtaagagccaccacacccagcccctattgtttcttttattaataggtatactttcccatgtcttgtttttttttggaccaaaacaactccatagagttgtctctatgtaccatttccagcttctttctttctaatgtgtctttctctaaaatactttttattgcagtaaaatatatataacataaatttaccatcttagccattttttaagtgtacagttcagtgtcattaattacatttacaatgttgtacaaccatctccattatccttttccagaactttctcatcacctaaacagaatctctgtacccatgaaacgttaactcactaattctcccttctgtaactgtaaatgggttcattgcccaatgcacacagcaagtcaataagctgagactccaggttgcagcagagaaaggtctaatcatagggccgccaaatgaggagatggaggaaaacctcaaattcatctcccgtaagagatgggggctaaggttttttaagggttttgaagtgggccgaagtgtggcaattgtttatttgttaaagagtacaggatgaagtcatgggacagggagatgaagaagctgtattctcttgcagatcccgttcctctgtgggggacttcaaactggttgctggaattcaggggtctgaaaaacatattaagcaatccttaaacaaaagccttatgattataatgtcagagatcctgttataggaaagatggggatagaaataaaatcttaaagttttatgaccctaatgtcagaaatcctattctgtaggaacaataggaatgcaaatagtcagtatctagtgctatatgacttttagcaaccaggaagtgggccaaagtgcggcctgattaatgcttaattataactatatttctgtccagaacctggcatgcacttcttgtgaaccctgtgggggcagtttcactcccacccactaatatcttctacttgctgtttttatgaatttgcttattctaggtaccttatataagtgggttaatataatatttatccatttgtgttagagttaattcacttagcatagtgttttcagggttattcatgttgtagcatatattagaatttcattcctttttatggctaatattgcattgtgtatatatgtcatattttatctgtcgatggtggggctgtttccaccttttggctattgtgactaatgctgctatggatattgatatacaggtatctatttggttctttgcttgcaattcttttgggtatttagctgtaaatagaattgctgagtcatatgagtaattctatgtttaagaaaagattatggtaaaatacatacaaaatttaccattttggctgggcattgtggttgacgcctgtaatcccagcactttgagaggccaagacgggagaattgcctgagcccaggagtttgagaccagcctgggcaacatgacgaaactctgtctctgggggaaaaataaaataaaataaaataataaaaaaataaaaaataaatctttttcttactatcttaacagtatttaattatgttaagtacatacttaacacaactgttaagtatgtacacatggttgtgcctccaaactccagaactttttcattttgcaaaactgaaactctgtacccattaaacaactcctcatttctccattccccccaacccctggcaaccactatcctactttatttctaagagtttgactaccctagatatcttatgtaagtgaaaacatacagtatttgtctttttttgactgccttatttcacttagtcaatctatgtttaactttttgaggacccaccagactgttttccgtagtggttgtgccattttacagttctatcagcaatatgtaagggttccagtttctccatgtgctcactgacacttatttttctttttcatggtaatcatcctatttggtgtgaaaagtggtatctcattgtggttttgatttgcatttttctaaacaactagtgatattgagcatcttttcatgtacttgttgaccttttttgtatatcttcttggagaaatgtgtatttgaatcctttgctcatttttgaattgcattgtatttatatattttatatatagggaatatttatcccttaccagatatatgatttgcaaatattttctcacaatttgtagtttgtcttttcactcccatgatggtgtccttttttgcacagaaattttaaattctgattaagtcaaattaattttttcttttgttaccttttgctttttgtgtcaatccaaggaatcatcaccaaatccaatatcatgaagattttccacaatgttttcttctaagagttttatagttttagctcttacatttaggttattgatcattttaagttaatttttcaatatcgtataaagtaagggtccaatttcattcttttgcttgaggataccaaattttacaagcaccatttgttgaaaagactgtcctttccccattgaatggttttggcacccttcatgtcacagtcaattaaccatgttagagagggtttatctctctctctctcttttttttttttttttttttttgagacagggtctcattctgttacctaggctggagtacagtggtgctatctcactgcagccttgacctcccagactcaagtgatcctcccacttcagcctcccgagtagctgggactacagacacacagcatcatacctggctaatttttgtatttttttttgtagagttgtggtttcaccatgttaaggctggtgttgaactcctgggctcaggtgatcagcctgcctctgcctcccaaagtgctgggattacaggtgtgcaccaccatgtccagcctcttttttttcttttcttagagacaggatctcactttgtcatccaggcggcagtgcagtggcgtgatcatagctgactgcatcctcctggactcaagtgactctcccatcccagcctcccaagtagctgggattacaggcatgttactgtcacgtcaggtaattttaaagtgttttgtacagatggagtcttgctctgttgcccaggctgatcttgaatttctggactcaaatgatcctcctgcttcagtctcccaaagtgctggcattataggcatgagccactgcactcagctttttttttttcttctttttttgagacagggtcttgctatgttgcccaggcttgtcttgaactcctgggcctggtcagtcctcctgcacctgcctcccaaagtccaaaatgctgggttataggcgttagccaccgtgcccaggctttttcttaagatggggtccctctctgtgttgcctaggctggtcaaactcctggccgcaagcaatcttcctgcttcaacttcctgacttgttaattcattttaatttttgtactctgattgttagtgaagtccttttgtttattggtcatttataaaacttgttcacttatgttcttacctgccttcttctgttgtgttgattttttttgtagttctttacatatcctgatagtaattcttttttgaagtcattattatgttaatttggcttctagatactttcttattcaagccaccattgcatttcacagtgaaaaacacaaagcctgtccaatgtatttgcatacatttaatgcagaatttgatcccaacactgtaatcaataaacatctaggaagatgtggtgaatattactgataaagtaatgggaagtaactgaagaattttgtgcagcctgagttttaactaagacttaatttttaattaaaagcaaaacttatattttcaaaagagtttgcccctccaaaaaaaaaccagattagatagcttctaaactatattaaattataccaaataaatttttttttttttttgagacggagtcttgttctgtctcccaggctggaatgcagtggtgtgatcttggctcactacaacctctgcctcccggattcaagtgattctcctgcttcagccttctgagtagctgggattacaggcacctgccatcatgcctggctaatttttatatttttgtagagacagggtttcaccatgctggccaggctggtcttgaactcctgacctcaggtgatctgcctgcctcggcctcccaaagtgttgagattacaggtgtgagccaccactcccagccaccaaataaagattttaattattataaaacaaaggttcgtgcttcaaagaaacaccacctccacaaatgtcgagccagtttaggtgctgccaatagaatcctaaagagtgatatctctggttcatgtgaacaatttccacagtccatgcgctttgaggacaattcaggtcctaaggcagaccatgctctacagagctgccccttcaccaccccgggtaccaccctaccttgtgctgggcaggcagcatgtggctaggaatgctgcctccctcaggcttcccaaatcaaatcaagggcacatatggctcagccacacttttgcactcatatttactacatacttctgcttaactttatccctgaaaaatgttagatggtttgctgtcacacatctgctgccccagatgagttacatggatgtagcaatggacacatcctcaaacacagcatgaaaagggcacaggaagactctggtccagcccactcccacttcaaaataatttggccttgggttcttcctctaaaaacacaagtagatataaactctaactataaaatcatgaatctatggaactttagaataattaacagctcccaacactaaagtccagctgtaaggcagtgtttgtccatgctgatgaggcaccatcagcaccaaatcccagactccagtgtgctggggacatctgacgcctgcctgatagtaattctttattatgtatgttgcaagtattttctccttgcccatcttttatcattttagtttttatgtagttaaaccttggtttggcagtggtggcttacacctgtaaccccagcactttgggaagctaagacaggaggattgcttgagtccaagagttcaagaccagcctaggcaacagcacaccaacatggcacatgtatacatatgtaacaaacctgcacgttgtgcacatgtaccctaaaacttaaagtataataataataaaatttaaaaaaaaagaaaaagaaataaataaataaatacaaaataaacatatcagtcttttcatttacaacttgtggattttgcatatagcctaagaggttttgaaaatactgttttcctcatgcttttatgacagatttcgttgaatataagatgccattgattataagatgtacttcttgccaattaaactatgacaattcccattacttagaagtttaattttttatttaagaggcctttatggacttgatgcagcatagttgtgggttttgtgagtctcgttttgttgcccagggtagagtgcagtggtgcgatctcagctcactgcagcctcgacctcccgggtttaagcaattctcctgcctcagcctcccaagtagctgggatttcaggctcatgccaccacgcccaggtaatttttgtacttttagtagagacgggatttcaccatattggtcaggctggtctcgaactcctgacctcaggtgatccacctgccttggcctcccaaagtgctgggattacaggcgtgagccactgtgcccagcctattaattttaaaaaaattaattcttccatattctgctatagaacttttataattttaatatttaaatttttgatccattcggaatttatcctagtgtaaggtataaaacattgatccaattctatttgcttttcagatgactacctagttatgttaacatcttttgactagttcatcttttccttactagtttaagaaaatatctctatcatacactaaattagcatatatatttcagcctacttctggattttctgttttattccattgttctgtctattcaaatgtcaatcacaccagaattcaaggataaaaatgaaatttcaacccactggggggagagtagactaattaaaaaattgtatttagacaattaactatctgaaaaaagataaaattaaatgtttatacctaatttcaaacactgaaataaactcgagatgagttaagcataaaaaactgtctactacatttcatcatttctaacactttcactattttgaaattgagatgtcttaaaattacttccaggcacttgtacgtgtgcatcaaaacttgtaaaatgggtgtcagtggttaaagaaacacctggatataataatgtagcaatctcaagaaattatgcatcaccacactcttgatagcatgaaattaattaattaattaattaatctatcctccatgctttttcatggcttaatagctcattcctgtttagcactgaataatatcccattgtctcaatctaccacagcttatctgctcacctattgaaggacatcttggttgcttcaatatgttgacaattatgaataaagctgctgtcaacacgcatgtgtggggtttttttgtggacataagttttcagttcatttggataaatatcacagagtgcaattggtggactgtatggtaaaaatatgtttagttttataaaaaactgccaaactcttccaaagtggcagtgccattttgcattcctttttttttttcttttttttttttttgagacagagtctcgctctgtcacccaggctcgggtgcagtggtgtgatcttggctcactgcaacctgtgccttccgggttcaagcaataccctccctcagcttcctgagtagctgggattacagatgtccactaccacgcccagctaatttttgtgtttttagtagaggtggggtttcaccatcttggccaggctggtcttgaactcctgaccttgtgatccacctgcctcagccttccaccgtgctaggattgcaggcgtgagccactgcaccctgccccattttgcatttcaaccaggaatgaataaagagttcctgttggtccatatccttgtcagtatttgatgtcagtgttttggattttggccattctaagtggtatatagtagtatctcattgttattttaattttcaaatatctaatggcataagatatagtttggatgtttgttccctccaaatctcatgttgaaatgtgattcccaatgttgaaggtggggcctagtgggaagtgattggatcatggtagtggatccctcatgaatggtttagtaccatcccgtcggtgataagtgagttcttgctcagtttgttcatgtgacatctggctgtttaaaagaatctgggacctccccctcctctctgtctcttgatctcactctccccatgtgacatgctgcccccaccccgtcaccttcctccatggttgtaagcttccagaggccctcaccagaagtagatgctggcactgtgtttcatatacagcttccagaactgtgagccaattaaacctcttttctttataaattacttgatctcaggtatttctttatagcagtgcaagtatggcctaacacaacatatgatgttgagtatttttcaaatacttacttgccatctgtatatcttatttggtgaggtatctgttcaattttttaatcaggttgttttctttttcttttttcttttttttttttttttttgagacagggtctcactctgtctcccaggctggagtgcggtggtgtggtcatggctcacagaagccttgaattaccaagctcaagtgatcctcccacctcagcctcctgagtagctgagagtacaagtgtgcattagcatgcttggctaatttttgtattttttttgtagacacaaggtctctaccaaaaaaaaaaaacaaaatacacacacacacacacacacattgagtcttcctatctgtgaatgtgaaatatctctccattttatttagttcttctttgatgtctttcatcagagttttgtggtttttctcatatagatcctgtatatacagtcataatgacatttcagacaatgatggactgcatataaaatggtggtcctataaggttataatagagatggaaaattcctgtggcctagtgacattgtgtacctgttgtaatatcatagtgcaatgtattacccgtgacggtggtattgcaggtgctaataatcctaccacagtgccaattgtataaagtatagcacatataattatgtacagaatgtaatacttgataaagataataattgactatgttaatggtttatatatatactacattatacttttaattgttattttagagtgtactcctatttattaaaaaaaaaagttaactgcaaaaccatctcaggcaggccctttaggagatattccagaataaggcactgttatcataggatatgatagctccatgtgtgttattgtccctgaagaccttctgttgagacaagatgtggagatgggtgacagtgatattatgatcctgacctctgtaggcctaggctaatgtgtgtgtttgtgtcttagtttttaacataaatgtttaaagagtaaaaaaaaaaaatttaatagaaaaagcttataaagaaagaaaatatttttgtacagcttggtaaatgtgtttgtgttttaagctaagtgttactgtgaaagaagcaattatatttttaaatttcattttttgttgtttttgagatagacctcactcagtcacctagtctggagtgcagtggcactatcttggctcactgcagccttgaactcctgggctcaggagatcttcttgcttcagcctcctgagtatctgggactactagcatattaccgtgcctggctaatttttaaaattatttgtagagttgaggtctcactatgttgcccaggctggtctctaactcctgggcttacatgatccccctaccttggcttcccaaagtactgggattataggtgtgaacaactgtacctggctgaggccccattttaaaaaatcacacttaacacaaatttatgttttctttcaaaggataccccttctttcttttttaaactagctgttgtttactgataaatggaaagcttaaaaaatggattatggaggcaggggtatttggttttgccctgtacctgccttagggaagtttgactttgtatatttgccaagcctgctgatagctttaccctgggcagaacctgacagtcaaataattactctttgattgtactgattacctactgtttgtatgcattttatagttcattgttttctaattctatcttcggttactttcttttgcctactttcttggtcctatttttttgttctttctctaggatctggaatgttattcttatctcagtttttcctaatatttcatattttctaatatatgcatttaagctttaatgtttcctcttttttatttttatttaaaatttttttagagacgacagggtctctttctgttgcccaggctggagtgcagtagtacgatcatagctccctggtgcttccagctccttggctcaagggatcctcctgcctcagcctcctgagtagctaggcctacagatgtgcaacaatatacccagctaatttttttgacttttttgtagagatggagtctcactatgttgcccatgctggttcaaactcctggcctcaagtgatccgcctaccttggatatcttgagctatcctgggcagaatagtgagaccctgtctaaaaaaaaaaaaaaggaagttttttttcttctatgctttgaaacagcttaagtggtattaaaatgatttatttcttaaatatttggtagaattccactgtgaaattctgtgccaagtacttggaaaacttttcctattcttctaggataattggtctacttaagtttttgtttctcctgaggacaatttttgtaaattatattttactagaaaattataatttcttacaacttttctaatatacttgcaaagagctgagtaaaatttgacctttaaaattttttttgttatatacttttcagattagttgcaactcttagagtgtagatcataagtcctgctattaattgtgtttactggtacttcttcatggtttatttatttcttggagacagggtcttgctctgtcacctagtttgcagtgtggtgatgtgatcatggcttagtgtggccttgacttcctgggctcaggtgaccttcctgcctcagcctcccaagtatctgggatcacaggtgcatgctgccatgcccactgattttttttttttttttttttttggtagagacagggtctcattatgttgcccaggctggtcttgaattcctggcctcaagtgatcctcccacctcagcctcccaaagtgttgggattacaagtgtgagccactgcacctggtcgtggctttttgtttctactttgagttttaattttttattgaaagcccatcttcaagggtagatgtttttgtaattgtccaactggttcttcttacccatttcccagaaaagccaataaattgagaacagcaggagttgcagcagagaaataatttaataatcacagagcaagccaagcaatgagaatgagagctatttctcaagtctatctccccaagaatttagaggctagggtttttcgaggatagtttggcaggcagggggctagggattggggagtgctgattggttgggtcaaggttgagatcatagtgggttgaaactgccttctttcactgagttagttactagatggtggtggttgggggtgtcacaagaccagtcaagctggtttctcgttataggttgccaatccaggtggtgccatctgatgcatcagaatgcaaggtccgaaaaatactcaaacaccagtcttaggttttgcaatagtgatgttatctgtaggagcaattggggaagttacaaatcttgtgacctctggctgcatgacccctgaaccataattctaactgtgtggccagtctgttagttttataaaggcagtttcatccccaagcaagcagggggttagtttcctgaagggactgttatcatctttgttttaaagttaaaccatgagctaaattcctcccatagttagcttggcttatgcccggatatggacagggacagtttagcttatgtggttagaagcaagatggagtcagcgatgttagatttctcttactgttacaattttgcaaaagcggtttcattttccctgggagttattttattctaggttgtggatatgttccaatatggtgaactaacttttgcctctgctggggtcaaatagattctggatgtgaacctaaatgctttatttttatttattggctcagtctttctgtacagtgtgtgtggttcaaatctgaatcctaaacctgaatctcatagttggctgttattcctcatttgaggcaatagggatagcattatcccactatgaatgcctattacaaaatagaagaaagctagttaaatgtattttgtggtattttagaaagtaattgtttaattttatggtgaaaacattatcaatgggaaaggggggaataggtctgtttatttttggttgcatataatatagtctgatacagtatttggtaaactacagcccttggaccaaagttttagaaataaagttttattggaacacatctgtactcatcgagtactttgtaacagagaccatatggccctcaaagccttttttttttttttttaatagagtctcattttgtcacacaggctggagtgcagtagcatgatcataactcactgtaactttgaactcctgagctcaagggatcctcccatcttagcttcacaagtagataggactgcaggcatgtgccaccacacccggctaatttttaaatttttttgtagagatagtgtatcgctatgttgcctaggctggtgtcaaactcctgcctcaagcaatcctcccaccttggcctctcaaagcattgagattacgggcatgagccactgtacctggccttcaaagcctaagatatttactgttttaccctttacagaaaaaattgccgactcctgatctaatagctgtagtgcaccggtaggtgatgtttagttttatctttgattacaaagtacagatgattatcgagctttaaaggtcaggttaaataaaaagtatatcagtggtgataaaaggaaatatttgacttctagtgcaggtaacttaaggacttttagttgtcctagatagcaaaataaagattggttgatggattactttacaattagagtgtggatttatgtagtttatttgtatgcctttttttttttttttttttttttttttgcgatggatctcgctctgccacccaggctggagtacagtggcgtgatcttaactcactgcaaactccaccttccgggttcaagcgattatcctgcctcagcctctcgagtagctgggaccacaggcatgcaccacatgttcggctaattttttttttgtattttttagtagagatggggttttgccatgttggccaggctggtctcaaactcttgacctcaagcgatcctcctgccttggtctcccaaagtgttgggattacaggcatgaaccaccatgcccggccagtttatttgtcttcctttaaaataatttagttttggaatttaggatcatctggtcatccttaaaaatagaccttagttggccgggcacagtggttcacgccaggtctcaagtgatccccccaccttggccacacaaagtgctgagattacagaaaatctcctcttttaagtgtgtttagcttcttagaaataatgaaagtaggccggatatgttggcttactcctgtaatcccagaactttgccaagaaaggcagatcacctgcgctcaggagttcaagaccagcctggccaacatactgaaaccccgtcattactaaaaatactaaaattagccaggtgcgatggcacatgcctgtagtcccagctacttgggaggctgaggcaggagaattgcttgaacccaggaggtggaggttgcagtaagccgagatcacgccactgcactccagcctgggtgatagagagagactgtctcaaaaagaaaaaagaaaattggaacgatttggatgttagtgaaatttatttagggaagaactgaagtatgtggaagtggaagtggcacatgtgtgtgcagttgtgaaaataaaagcaaatggaataattgtgccagcttctaccctctagtaagtggaaaagcttttcagctgcagcgtagcagtggccgacaacctgtttaatgtttcaaattaagagtgcttctgttgaggatgtcaaaaagaaaaaagagtggttctgttgggatacagtaaaaggctcttgctttctttttataatagtcctagttttgtttgggagtataattggaaacttcctagaaagtctccttccttgaaatcttgtaagaaaatgattgttctagtctcatgagataattcaagtacacgtcattacccatgatgtaagtctgttggtatgtattgtgaaaactataaaacctggaatcccatcccacagcaaagtatcaatgtaaatttaaaaaaaaaaaagctttagtgagaaataattcacataccataaaagtctctctttaaaaatgaacaattttggccaggcgaggtggctcacgcctataatcctagcactttgggaggctgaggtgggtggatcacctgaggttgggagtttgagaccagcctgaccaacatggagaaacctcatctctactaaaaatacagaattagccaggcatggtggtgcatgcgtgtaatcccagctactcgggagggtggggcaggagaatcatttgaacctgggaggtggaggttgcggtgagccgagatagcaccattgcaatccagcttgggcaacaagagcagaaccttgtctcaaaaacaaaacaaaacaaaacaaaaacaattttgctgggcacagtggcttatgcctgtaatcccagcacagcactttgggaggccagtgcaggtggatcacttgaggtcacgagttcgagagcagcgtggccaacatggtgaaaccccgtctctactaaaaatacaaaaattagctgggcgtggtggcacgtacctgtaatctcactactcggaggctgaggcaggagaatcacttgaacctgagaggcggaggctgcaatgagctgagatcgcaccactgtactccagcctgggcaacagagtgagactctgtctcaaaaaaaaaaaaaaaaaaagaataattttggctgggtgcagtggttcatgcttgtaatctcagcactttgggacgctgaggcagaaggattgcttgaggccaggagttcaagaccagcctaggcaacatagcaagagtctgtctctattaaaaaacaacaggctgggtgcggtggctcacgcctgtaatctcagcacactgggaggacgaggcaggcggatcacctgaggtcaggagttcgagaccagtctgaccaacatggcgaatggcaaaaccccatctctattaaaaatacaaaattagctgggcgtgatggtaggcacctgtaatcccagctactcaggatgctgaggcaggagaattgcttgaacccgggaggcagaggttgcagtgagccaagatcatgccattgcactccagcctgggcgatgtagcgagactctgtctcaaaaaacaaacaaacaaaaaaacaaaattacaacaacaaagcaatattaccacaaatgtagtgatttaaaagagcatatatttattatatctttttctgtagtttaagagtccaagtctgactcaactggattactggattgccttcttcaaggtctctgaaagctacagtgaaggtgtcagtcagagctgctctcttatgtgaagttcagctggggaaggatctgctactaactttatgtggttgttggaagcattcagttccttgcaggtcactgaactgagggcctcaagttcttgctgaaggctgccttcagttccttgccattgtggccttttctctatgacagcacacagtgtggctgcctgattcattaaagtcagcaaacgagagtgtcaggatctcactctgtcacctgcagtggtacaaatatatatatattttgtttgtttgtttgtttgttttttttttttgagaccgagtcttgctctgtcacccaggctggagtacagtagtgcgatcttggctcactgcagcctctgcctccccggtttaagtgattcttctgcctcagcctcctgggtagctgggaatacaagcacacaccaccatgcccagctaatttttttatatttttagtagaggcggggttttgccatgttggccaggctggtcttgaactcctggcctcaagtgatccacctgccttgacctcccaaagtgctgggattacgggcatgagccaccgcgcccagcccctggccccactattttttaggtgtgattttatttttgatgattatgtgaaatgagatgccttgttttcttaccattatcatagttttcatagcatgattgatcattccctcctttgtccgttctgtatgttttatacaggcttttattggagcaatgatacctttttttgggggggccttggcaaagtgtggtggctcacaccttaatcccagcactttgggaggcagaggcggacagatcacatgaggccaagagtctgagatcagcctggtcaacttggtgaatccccgtctctacaaaaagtacaaaagttagccaggtgtactggtgcatgtctgtaattccagctactccggaggttgaggaatgggaatcgcttgaggcagagattgcagtgagccaagatcatgccactgcactccagcccaggtgacctagcgatactctgtctcaaaaaaaaaaaaagtggcagtgggggggcgcttgctttgttgcccaggctggagtgcagtggcacaactttagctcactgtaacctggaactgctgggctcaagtgatcctcctgcctcagcctcttgaatggctaggactacaggcatgtaccaccagcatgcctggctaatttttaaatttttttgagagatggggtcttgctatgctgcccagccttgtcttgaactcccgggctcaagcaattctcctgtctcagcttcctgcgtagctgggactacaggtgtttgctaccatgcctagctgggtttgagtcttggctgtaccacttacaaactttctgaccttgacttctgtgcctccgtttcctcatctgcaaaatgaggattgtaataatatctacctttagagttgttgagaaaatataatgaactattatgcgtaaagcattagaataatgttataaataattcaccctatttaagggctagttattatttctgttatataggtagctgatatctatggagctatttctttgagctaggtactgtattaagaacatgtatatattttattgcatagtatctataacaatcttgtaagtagttacactttcatttcataaatgagaaaactgagcttcaaagatgtagaaactaaaagagctagtatctgccatctgcttgatactgaaaaattgattcattcgcattcatggttatacatttattatttagtgcatatgcagtttgtcatgcaaactgtaaatttcttgcagtgttgtaacagttgtggtttaaggaaagtaagaggaacattttagtaagtgaatgttatgttattttgggatattttatttttgtgcttgaataggtaaaggtttttatattttctgtttgggagctttgtctgaaaacttagatactggatctcaaaatgctggtgcttctacggtggcctcagtgtcacaactgtactaaaaactgactaattttttaactttccaaacagtaacttatgaaattgtctagagagtgaatcttttctcttttaaatgttgattattgttgtagtctgaatctaaaatacttaaggtttttcctcagattatcagtatcttatttcatggttgtgtttatttctctgtatgcctttctgagatctcactgtaaaagttttcatcaaaccaaatactgcatattctcacttataagtgggggctaaatggtgagaacacatggacacatagaggggaagaacacacaatggggcctatcatagagtggagggagaggatcagggaaaataactaatgggtactaggcttaatacctaggtgatgaaataatctgaacaacaaaccctcatgatacaagtttacctatgtaacaaatctgcatgtgtactcctgaacttaaaacttttattaaaagttaaaaacttaaaaaagtgtcttcatcagtggtatgtgatattattttaacagagtcttactctgtcgctgaggctggagtacagtggcaccgtgtcagctcactgcaacctccatctcctgggttcaagcaattctgctgtctcagcctcccaagtagctgggattacaggtgcctaccaccatgcctggctagtttttatatttttagtagagatggggtttcaccatgttggccaggttggtctcgaactcctgacctcaggtgatccacctgcctcagcctcccaaagtgctgggattacaggcgtgagccaccgtgcccagccagtgcttctatgttttaataactactctatcagaaaagagtttagctctatagtcatggaattatatgaagtaacttttgttaagatggctaagaactgggcagtaaggatgatgtgagatagtagatgttctacttaaaggtaaaagttaggagaaagcctattaggtatttctgacataccagttttcagagtcattgggtgactgagatgtcagtatataccaatactgtttggggaacaaaaattaaatgctcccaaaaagactacttggaagtattcagaaccatccccaaaccccaacatctatgagcaacacttatgtgtgtctgtaaccaagaagctttgcttgtctgtctcatatcaaaccagccatttcagaatttaactgttccaggtagtcagagttaaggtaaccttcaaaatctagaaaaagtattttataaaattcaacatccctttatgataaaaactctcaacaaactagtcatagacagaacatacctcaacataataaaggccatatatgacaaacccacacctaatagcatactgatagggaaaagctgtgaaagccttttctctgaaaactggaacaaggatgctcactttcaccactcctattcagcatagtactggaagtcctagctgcaacagtgaggtaagagaaagaaagaaaaggcatccaaattggaaaagaggaagtcaaattgttcctctttggagataaaatgatcttatatctagaaaaacctaaagattccaccaaaatcttttagatctgataaattcagtaaagttacaggattcaaaaatcaatgcacaaaaatcagcatttctatacaccactaattagctgaaaaaaatctagaaggcaatcccaattacagtacagctacaaaaattataataaaatacctatgaataaatgtaaccaagaaagtgaaagaccctacaagaagaactgcaaaacgctaatgaaagaaattgaagaggacacaaaaaaatagaaagatatcttatgctcatggattggaagaattaatattgttaaaacgaccatgctacccaaaaacaatctacagattcagtgaaatccctatcaagataccaatgttgggtcaggcgcagcggctcactcctgtaatcccagcactttgggaggccaaggtgggtggattgaggccaggagttgaagaccagccttgccaacaatggtgaaaccctatctctactaaaaatacaaatattagccaggcatgatggcacatgcctgtagttccaagtacttgggaagctgaggcgggaggatcgcttgagcctgggaggcagaggttgcagtgagccgagattgtgccactgcactccagcctgggtgacagagtgagactctgtctaaaaaaaaaaaaaaaaagatactaatgttggctgggcacagtggctcatgcctgtaatcccagcactttgggaggccaaggcaggaggatcacctgaggtcaggagttcgagaccagcctgcccaacatggagaaaacctgtctctactaaaaatacaaaattagctgtgtgtggtggcacatgcctgtaatcccagctactcgggaggggaggtaggagaatcgcttgaacccggaaggtggaggttgcggtgagccaagatcgggccattgcactccagcctgggcaacaagagtgaaactccgtctcaaaaaaaaaaaaaaaaaaaaaaaaaaaaggccaggcacggtggctcatgatcccagcactttgggaggccgaagtaggcggatcttctgaggtcaggagtttgcgaccagcctggccaacatggtgaaaccccatctctactaaaaatacaaaaattatccaggtgtggtggtgtgtgcctgtaatcccagctactcaggaggctgaggcaggagaatcgcttgagcctgggaggtggaggttgcagtgaaccgagatcacgccactgcactccagcctgggtgacagagtgagtctccatctcaaaaaaaaaaaaaaaaaaaaagaagataccaatgtcatttttcacagaaatagaaaaagcagtcctaaaattttgtatggaaacaaaaaagagaccaaatagccaaagcagtcctgagcaaaaagaacaaagctggaggcatcatactacctgacttcaatatatattacaaggctatactgagcacaacagcatgatatttgtataaatcagacacatagaccaatggaacagaataaatccacgtgtttacagccaactgattttcaacaaaggtaccaagaacgtacactggggacaagacactttcttgaataaatggtgctgagaacatggtatattatatatgcagaagaatgaaactggatctccatctcttactatatacaaaagtcaaatccagtcacaccagtacactccagcctgggcaaaagagtgagactctgtctcaaataataaaataaaataaaataaagataatttaaagacttaaatgtaaaaccccaaactacaaaactactagaagaaaacataggggtttcagcatgttattctgggtcttaaaaaaaaaaaaaaaaagaatactgagcaacatagtgagaccttgtctctacaaaaaaaaaaaaaaaaaaaaaaaaaattagaccacagtggcttacacctataatcccagtactttgggaggctaaggcaggaggatcacatgagcccaggagttcgagatgagtctgggtaatatagtgagaccctgtctttagaaaaaaaaaaaaaaatggctgggtgcagtagcccatgcctgtaatcccagcactttgggaggccaagccaggcagattgcctgagctcaagagcttgaaactagcctggccaacgtggtgaaaccctgtctctgcaaacaatacaaaaaaattagctgggtgtggtggcgtgtgcctgtagtcccaactacctgggagactgaggtgagaggattggttgagcctaggaagttgaggctgcagtgagctgtgatcacaccactgcactccagcctgggtaacagagtgataccctgactcaaaaaaataaaaaattagccagccatggtggtgcacacctgtagtcccagctacttgggaggctgaagtgggaggatttcttgagcctaggagttcaagattgcagtgaattatgatcaagccactgcactccagccttggtaagagagagagaccttgtctcaaaaaaagaaaaaaaaaaaaaagaaagaaaagtaaacagaggaaacacttcaagacattggtctaggcaaagattttatggcaaagacctcaaaagtataggcagcaaaaccaaaaatcgacaaatgggactatattagactaaaaatcttctgcacagcaaaggaaacaatagagtgaagagacaaccttttgaatgggaggaaatactcgtaaactatttatccaaaaaggggctaatatttggaatatacaaggaactcaaacaactcaacagtaaaaaataaaaaaccatctctccctaccccgaaaatcccatttaaaaatgggcaaaggacatgaacagaaatttcttgaaagaaaacataggaatggtcaacaggtatacgaaaaatgctcaacatcataaaaaatttgctaatcagggaaatgcaaatcaatacaatgaggtattatcttatctcatttagaatggctaccatcaaaaagacaaaaagaccccatctctacaaaaaaaaaaaaaaatagctggatgtagtggtgcacacctgtagtttaagctactcgagaggcttaggtgggaggatcgcttgagcccagattgacactagagtgagctgtgatcatgccactgcaccccagcctggcaatagagcaggaccctgtcttagacaaacaaacaaaaacaggccaggcacggtggccagtgcctgtgatctcaacactttggaagatggaggcaggtgcgattgcttgagctccggagttcgagaccagcctgggcagcatggtgaaacctcgtctctaccaaaaatacaaaaattaactgggtgtgctggcacatgcctgtagtcccagctattcaggaggctgaggcaggaggatccctagagccaggaggttgaggctgcagtaagctatgatcatgccactgcactccagcctgggagacagagtgagatcccatctcaaaaacaacaacaataacaacaacaacaaaccccaaaaccccaaaaatgaacaaacaaaaaacaaaccagatctgatgaagatacagcgtaaagggaactcttatattcttggggggaatgtaaattagtatggtcactatggaaaacagtatggagatgtctcaaaaaagtaaaaaatagaactaccatatgatccagcaatctcattagtgggtatttatccaaaggaagggaaatcaatataccaaagggatacttgcatctccatgtttattgcagcactattcacagtagcaaatatatggaaccaacctaagcattcattgatggataagtggaaaaagaaaatgtggtatatataaaaaatggatcactatttggacataaaaatgtatgaaatcctgtcattttcagcaacgcagatggaactggaagtcattatgttaagtgaaataagccaagcacagagagactaatattgcaagttctcacttatatgtgagagctgaaatagttgatctcatagaggtaaagagtagaatgatagttaccagaggctgggaagggtgcgtgggatagagaaagttggttaataggtacaaacatatagttggatagaaagtgtaagttataggctgggcatagtgtctcatgcctgtaatctcagcactttgggaggccaaggagggcagatcacttgaggccaggagttcaagaccagcctggccaacatggcaaaaccctgtctctactgaaattacaaaaaaaattagctgggcatggtgggtacgtgcctgtagtcccagctacttgggaggctgaggtacaagaatcgcttgaacccaggaggtggaggttgcagtgagccgagattgcaccactgcaaccagcctgagtgacagagtgagactcggtctcaaaaaaaaaaaaaaaaaaaaaaaaaaaagcggctgggcgcggtggctcatgcttgtaatcctagcactttgggaggccaaggtgggcagattgcccaagctcaggagtttgagaccagcctgggcaacacagtgaaactccatctctactaaaatacaaaaaattagctgggtgtggcggcatgtgcctgttgtcccagctactcaggatgctgaggcagaagaattgcttgaacctgggaggcggagattgcagtgaggcgagatcatgccactgcactccagcctgggtgacagagcgaaactccatctccaaaaaaaaaaaaaaaaaaaaaagttataatattcaataggagagtatggtgactatcattaataatgtattgtatatatcttttttttttgagacggagtctggctcttttgcccaggctggagtgcagtggcttgatctcggctcactgcaagctccgcctccccagttcacgccattctcctgcctcagcctcccgagtagctgggactacaggcgcctgccaccatgcccggctaattttttgtatttttagtagagatggggtttcaccgtgttagccaggatggtcttgatctcctgaccttgtgatctgcccgcctcggcctccaaaagtgctgggattacaggcgtgagccaccgtgcctggacaatgtattgtatatttctaagtaggtagaagagcggacttgaaatgttcccaatacatataaatgataaatactcggcctagtgtagtggctcacacctgtaatcctagcactttggaaggccgaggcaggaggatcccttaatgccaggtgttcaagacctacttcctaagtagctgggaccactatgcctgactatttttatttctgtagagacagggtattgctttgttgcccaggctcaagtgatcctcccatctcagcctcccaagtatctgggaccacagacatgcaccaccatgcctgggtaacgttttttgtattttttgtagagatggggtttcaccatgtttcccaggctggccttgaactcttgggtttaagtgatcctcctgtctcagcctcccagagtgctgggattacaggcatgagctactgtgccttgccctaaaaattttttattttctggttcttgctttccatgctaggctcatcacaagcttgcaattccttaacatgtacccaccaggccttgagccaaacccagtttctcaccattccttagaatatcccatgctcttattcctctgagactctgcacatgcttttacacctgctcagtatgccctttccttgcttgttctatttgacaagctctttcttattcttgaagaaaactgaaggatgacttcctctgggaatccttctctgaccccttcaagcaaggtttttactggtggccagtaaaaggttgagtatcccttatccacaagctgggaaccagaggtgttttggattttggaaaatttttttgaatatttgcattatacttactggttgagcatccctaataactactctttatgtgcgcatcatgtctttgttccaggctataataagggggaagtaaaaagtacaatttcatcaagaaagcaatagcatccccagaaattccatgcagcaatttccacttgcatctttttttttttcttttagataggttctcgctctattgcccaggctggagtgcagtggcacaatcttggctcactgcaacctccgtctcccgggttcaagcgattcttctgcctcagcctcctgagtagctgggactacaggcacgtgccaacatgcccggccaattttttgtatttttagtagagacagagtttcaccatattagccaggatggtctcgatctcctgacctcgtgatccgccgacctcggcctcccaaagtgctgggattgcaggcgtgagccactgtgcccggcctcttgcatcttcttactagcactgtgtaacatagactctcctagttgcaaggaagattgccaggttgggtttctttcagtcacaaaaaagaagaaaattggtgttgagtaaataattcgtattgtttaatctgcttacttttcagtagatgggttctaggccataagctcaatttttgtccaggaagtgtaagtcactggaggattatctccagaattttttgggtgattctgccttataaaactgtagctctttacgctaactacaaatataacgcaacctctatttctgtccgtccatatattagtagcaagtgaggtgtaacccacatttctgtccagccatattcttgggggcttggctcaagacttttatagaaccacacatgaaatgtcgccaaagaggaagcaaaaagatgcaacccttgccagtgacttgtcagccaccacaaacccaaaagtcatgtgccatgctacagtacaaactaaccctagctgtctcatcatcaagtgctctctcacaacacaaactaacccttggtatcccaaaaggcaaagagatcagagagatcaaaggcaaaagagcagagctcagacctgagagaggtttactcacgactctattttttctgtttgtttgtttgttttagatagggtctcactgtgttgcccaggctggagtgcaatgtcttgatcatggctcactgtagccttgatctcctgggctcaagcgatcctcccacctcagcctcctgagtagctgggaccacaggtgcacaccaccacaaccagctaatttttgtatttttttttgtagagatgtgttttaccatgttgcccaggctatctcgaactcctgggctcaagcagcctacctgcctcagccttccgaagtgttgggattacagctgtgagccaccatacccatcttcacaactctttaggctccatgagaagacagattctcatccaaaaaggggttagcagagcttagggtctcagggtcttcagcagtctccttcaggtccctttgtggtagccacatctgttaaaggacaaaattagaataaatatagtttaaagacttcaatagtctttattgctattctagagtccagcaactcttcatttcctaaaatagaataagtgtaccaatgagctgagtggaagaatttggctttatagtcagagaagggcttaaaaaagcagaagcaaagacctgagagtgtattattagccctttcaaagttcttataatgcaaaggcagggatatcaaacaacagaaaagtaactgatttgttagtatcaactaacttcaggctacttcttttgtgtaagagttaaagcggagggactttagttatgccaattgaagattgaagctggtcagtttgggtgattggctgttatctctctttcctgatttcttggaaagtcagataacaacttagtggaacaacttagtagaactttagcacgggtaactccgttttcatttttagtctcgtctgttaaagcctagtgcaggaactcaatccaaaactgttatgcctcctgtaatttttgtttagtagcattttgataaattttgtcatatatactttaaaaaaaatgcctgtctttgaggaaggattagatcaaagatgccacttttgttattgaaatgttccatatccttactaatttcttgtcttcttgagctttcaggtttaaaaaaaaaatttttttttaatctgttttttagatggagttgcgctctgtcacccaggctggagtgcaatggcacaatctcggctcactgcaacctctgcctctcgggttcaagcgattcttctgcctcagcctcccaggtagctgggactacagacacgcaccatcacgcctggctaattttgtatttttaagagatgggttttccccatattggccaggctggtctcgaactcctgatctctaccgcacctggcgagctttcagtttttgagagatgtgttaaaatgtctcataatatttaggggccgggcgcggtggctcacgcctgtaatcccagcattttgggaggccaaggcaggcagatcacgaggtcaggagatcgagaccatcctggctaacatggtgaaaccccgtctctactaaaaatacaaaaaattagtcgggcatggtggcacgtgcctgtagtcccagatacttgggaggctgaggcaggagaatggcgtgaacccgggaggcggagcttgcagcgagccaagatcacgccactgcactccagcctgggtgacagagcgagactccgtctcaaaaaaaaaaaaaaaaaaaaaaatcaggaatttaagagctgggcgcagtggctcatgtttgtaatcccagcactttgggaggccgaggcaggcagactgcttgagcccaggagtttgagaccagcctggacaacatggcgaaaccctgtctctaaaaaaatatataaaaattagctgggcatggtggtgcacagctgtggtcccagcttctcaagtggctgaggtgggaggattgcttgatctcaggagggggaggctgcagtgagctgaggtcatgccactgcattcaaacatgggtgacagagtgagaccctgtttaaaaaaaaataaaaataaagatcatagatttgtcacatttgccttacattgtcagtttttgttttctatattacaagaccatgttgtgagatacatacaagatcatgattattatcccttggtagaatatttatgcaatgttcacacagtgctttttttcttgaatcagttggtctgactgtatcaggctcaatattctttgcatagtttgtattcaaattgtgtctctgccatttaatagatgtacgatcttgagaaagatttaatttctctgtgcctcagtttccatggctgtaaaatgaggttattagtgatacttgtctcacaggattatcttcaagattaaataagttaatatgtataaagaagttatacagcagtacctagtatgtagcaaatgctgtaaatgttagctatgttattgctgttttataactgtgtatgatggttggggcatcttttttaaacttttatttttatgggtacatagtagataatatttatggggtacatgagatattttgatacagccatacaatgtgtaataatcacattgggataaatgggatatccatcacctcaagcatttatcatttctttgtgttgcaaacattccaattatactctgttattttaaaatatacaattaaattattgttgagtgtaatcaccctgttgtactaaatcttcttcattctatcaagctatatttttgtacccattaactgcccccactcccccacaccccacactacccttcccagcctctgttaaccatcatcattctactctgtctctatgagttcaattgttttatttgagctcccacaaataaatgagaacatgtgaagtttgtctttctatgtctggcttatttaactgaacataatgtcctcaagttccacccatgttgttgcaaatgacaggttctaatcctttcttatggctgaatagtactccattgtgtgtatgtaccacattttctttatccatttgtttgttgatggacacttaggttgcatccaaatcttggctattgtgaatagtgctacaataaacatggaagtgcagatatgtatttgacataccgatttcccttcttttggtatatacccagcagtgggattgctggatcatatggtagctctattcttagttttttgaggaacctccaaactgttctccatagtggctataccaatttacattcctaccaacagtgcacgaggcttacccctttctctacatctttgcaagaattctttttttttttttttttttttttttgagacagagtcttgctgaggctgaagtgcagtggcgtgatcttggctcactgcaacctctgcctcccaggttcaagtgattctcatgcctcagcctcccaagtagctggaattacagacgtgcactaccatgcccagctaatttttgtatttttagtggagacggggttttaccatgttggccaggctggtctccaactcccgacctcaggtaatcctccacctcggcctctcaaaagtgctaggattacaggcgtgagccaccgtgcccagcctgcaagaattctttattgcccttcttttggataaaaaccattttaactagggtgagatgatatctcattgtagtttggatttgcatttctgtgatgatcagtgatgttgaatacctttacatatacctgtttgctgttcgtatgtcttcttttgagaaatgtctgttcagatcttttgcccatttaaaaaatctgattgttagatttttttttcctatagagttgtttgaacttcttatatattctggttattaatcctttgtcagatggatattttgcaaatattttctcccattccatggattgactcttcactttgtttcatttgctgtgcagaagctttttaaccggatgtgatcccatttgtccatttttgctttagttgcctgtgcttttggagtattactcgagcaatctttgcagaccaatgggagagtttcccccgatgttttcttgtagtagtttcatagtttgaggtcctagatcgaaatctttaatccattttgattagatttttgcatatggctagagataggagtctagtttcattcttctgcatgtaactatacagttttcccagcactatttgttgaagagactgtcctttccccaatgtatgttcttggtacttttgttgaaaatgagagtttattgtagatttatggatttgttattggattctctattctgttccattggtctatgtttctgtttttatgccaataccatgttattttggttacaatagctctgtggtataatttgaatcaggtaatgtgattcctccagtttctttctttttttcttttgagacaaagtctcagctctgtcacctaggctggagtgcagtggtgcaatcttggctcactgcaacctctgcctcccgggttcaagccattctcctgctcagcctcccgagtagctgggattacaggggcatgccatcacgctcagctagtttttgtattttttttttttagtagagacagggtttcaccatgttggccaggctgatctcaaactcctgacttcaggtgatccacccacctcggcctcccaaagtgctgggattacaggcataagctactgcacccggcccagctttttttcttttcctcaggatggctttggcgattctgggtctttgtgattccatagaaagtttagtatctgagtagtatgggaattttaaaaataccgattgttgcaattcatgaacatggaatatctttccatttttttgtatctttagtttcttacatcaatgttttataactttcattgtagagaacttttttgtttgtttttgagacagtcttgctctgtcacccaggctggagtatagtggcacgatcacagctcactgcagccttgacctcctgggctcaagcaatcctcccacctcagcttcccgactagctgggaccacaggcttgaaccaccaagcccagttaatttttttgtattttttgtagagatagtgtctcactatgttgcccaggctggtctcgaactcctggactcaagcaatccttttgtcttggcctcccaaagtattgggattacaggcgtgaaccactgtgcctggccttttagagctcttttaattcattggctaacttaatttctaggtatttaattttatttggagctactataaattggattactttttggtttctttttcagattgttcactgttggcatatagaaatgctactgatttttgtatgttgattttgtatgctgtaacttttctgaatttatcagttctaatagtttttttagtgtagtcttaggtttttccaaatacaagatcataatcatctgcagacaagaataatttggcttcttcctttccaatttggatgccctttatttctttctcttgtctgattgctctagctagggtgtccagtactatgttaaataacagtggtaaaagtggggatcctttttgtgttccatatcccagaggaaaggctttcagtttttcttcattaagtatgatactagctttgggtctgtcatatatggctttttgagctatgttccttctatacctagttttttgagggtttttattatgaagagatgttgaattttatcaaatgctttttcagcattaattgaaatgatcatatggtttttgtccctcattctgttgatataatgtatcacattgattgatttacgtatgttgaactatccttacatcccagggataaatcccggttggtcaggatgaatgatcttttcatgggttttgccattttgttaaaatcttagtgtgacagttttcagatgatggaaaaataagaagagtgactttcagctggagagtccttattaaaacacagatgtcttctgtaaatagagttggaaaaatactaccagtgagctctttgtttataaatgtttcttttaacttatccatgcaggatctgaaatggaaagctacttctctttcatcagtcaagaggtacattacaacagaatccttgatgcactgagaagagagctgggttccaaatctcactcagtgatctaggagaggagaggcagccagtgttctgcctgccttagtttttccgatcagggttcctgtggctctttgtgttttggcccggcctccccctcaacagccttccctcttctgcctggcctctctgaaacactgtttgaattctaagataagctgtgatgtctgacctgtattaatagctatgataaacttgtggagctattgtcatttcaaggagtttttggatattgaagagtttaagtaagttgtcatgttttcttttggaattcccatttggttgagtatagcatactgaaatgatactcctgaagtccgtaggatgatgacatttttgcatagtaaagtccctgttgtgcaagatatgaaatgaaatttttttaacgagaaagatctttgtgacttcatgatttttctactgcctcattcataattcctaagcaggaaacacacatatctcagtttagcttctttgaatcacacaaaatgttttgtctggtggtcttattttgctaccaatgagaccacatttacagggtgaaaacaatctttctcaagtaaagtgttatggtttatgaaacctgtggagtgtgcattgaaatgataaataatatttacacatgcacaatagattgagttctatagagggcgaatacttttagaagtagactttcctctgtgcatatgggtaatagtgtgagtggtgtggcccatgtttgttgtatttaacttgagtgtgtttaaatgattataaggtgctttgggtagagttactacaatattagctctaaaaggttcacggacttctttctatatttagcatgaaattttttttttttatagatttttttttttttttcgcgagacggaatctcgctctgtcacccaggctggagtgcagtggcacaatctccactcactgcgggccccgcctcccaggctcatgccattctcctggctcagcctcccgagtagctgggactacaggtgcccgccaccacgcccagctaattttttgtgtttttagtagagacgggatttcaccatgttagccaggctggtctcgattttgtgacctcgtgatctgtcccccttggtctcccaaagtcctgggattacaggcgtgagccactgtgcccggcctatggatttttatggtacttgggggagactttgagtatgtgggtttagcatcttataaagacagtttcattaagtgttacataaggctcatgcatatatcttcgttttgcacacttagaatgccacagaagggactcttttctgttggtgtcttaagactcaccaaggtcagccatgaggaatcagcttaaaaattttccctcattttttttttctaaggtattaaaaacaggccaggcacggtggctgggaggccaaggctggtggatcacaaggtcaggagttcgagaccagcctggccaacatggtgaaaccccgtctctactaaaaatacaaaaattagctgggcgcggtggcaggcgcttgtaatcgcagctactcgggaggcttaggcaggagaattgcttgaacccggaaggtggaggtttcagtgagccgagatcacgccactgcactctagcctgggtgacagagcaagactctgtctcaaaacaaaaacaacaacaacaacaacaaaaaaccagacatgattggctgggcatggtggctcacacctgtaatcccagcattttgggaggccgaggcaggcagatcacctgaggtcaagagtttgagaccagcctggccaacatggtgaaaacctgtctctactaaaaatacaaaaattagccgggtgtgttggcacatgcctgtaatcccagctactcaggaggctgaggcaggagaatcacttgaacctgggaggtggaggttgcagtgagccgagattgtgccactacactccagtctgggtgacacagtgagaccctgtctcaaacaaaaacaacaacagcaacaaaccagacatgatttcttttatttatttcttcatttttttctttatttcttctaaaaaaaagaaaacatgggatacatgtgcagaacatgcaggtttgtgccatggtggtttgctgcacctgttgactaagttctaagttcccttccttcaccccccacccgctaacaggccctggtgcgtgttgtttccctctctgtgtccatgtgttctcaatgttcaaaacatgcagtgttggttttctgttcctgtgttaatttgctgaggatgatggcttccagcttcatttatgtccctgcaaaggacatgacctcattcctttttatgactgcatagtattccatggtgtatatcagacatgttttcttgagatgttagtaacagtgtttttctggccaactcaatgtgaaataatactgttcttgggtagaataattcatcttcattcatggaagtgatactttaatgtaattagatgtatattttatctaaagtggcacaaaaatatcttggcatattgtacatttggagatgttgacctcacatataactattgcccttgaccctcttttcttgttctatttaatattctaggtacgacaccgagcttctggtcaggtgatggctcttaagatgaacacattgagcagtaaccgggcaaacatgctgaaagaagtacagctcatgaatagactctcccatcccaacatccttaggtaatggcttttccttccttctgatcaatgagaaaactgaaacattggaggcttgctagaatagcactaataggaaaaaaaggagggattcaggatttatcatgctgaatctatcttgctggggtttagtggtactctaggtcgttttctacccattgagacttaatttattggtaattaactgcatttaataaagcaacttcctttatctcttaagttgctttactctcattagaacattagtagcagctcattagaacaattgttttctattgctgactggtaatttatcaaagaggagagattggtctttatgtggttatttacttttcctgattactttttgggaaattgtaattaaatcaatgagtggcaataaatgtaaaattacaccctcaagttatctatccttaacttttagcactcacttgaggagacacattttgcctttgagaattgttatttttttgagatagggtctcactctgtcacccaggctggagtatagtggcatgatcatggttcactgcagccttgacctccagggcccagttgagcttccccacctcagactcctgagcagctggaactacaggcgcaccaccacatccagctaattttcacatttttcgtaaagtcagagttccaccatttgcccaggctggtctcaagttcctgggctcaagcaattcaccctccttggcctcccaaagtggacaattatttttataagtttatgtaattgtcactttttaataatccgtatctgaatctttcttgctttaattattttgatattttagtcaggcaagtatattttctttttaaaaaaaatttggctgggcgcgatggctcacgcctgtaatcccagcactttgggaggccgaggcaggcggatcatgaggtcaggagattgagaccatcctggctaacatggtgaaaccccatctctactaaaaatacaaaaaaacagttagccgggcgtggtggcacgtgcctatagtcccagccacttgggaggctgaggcaggagaattgcttgaacccgggaagtggaggttccccctgggaacctagtgcagtgagctgagattgcactactgcactccagccagggtgacagagcaagactccgtctcaaaaaaaaaaaaaaaaaaaaattttatttggccaggcatgatggctcatgcctgtaatctcagtactttgggaggccaaggtgggtggatctcttgagcctaggagtttaagaccagcctgggcaacatggtgaaaccccatctctacaaacaacaacaacaacaaacaacaaaaaaaaattagccaggtataatggcatgtgcctgtagtttcagctactcgggaggctgaggtgggaggatctcttgagccaatagttcacagctacagtgagccatgattgcagcactgcactccagcctgagtgacagagtgagaccctatattaaaaacaaaaatgattttgttaaaaaaaatttttcttaaatgagataaggtctcactgtgttgttcaggctgggattacaggtgtgatccaccacacctggccagtatatttttaaatgagaccaaataagacaatttaattcaatgtatatttagttagggtttatgtgcaggatgctttgtaaagtttaaagtactatttacttagggtcatttattgctattttttgtatgtttatattaggctagagagaactcatatggcttaagtatgacttacatgtttggtcaatggtattaaattatggaattaaattatactgcttacttgaaactttttatccttatatagaattattggcttcctagtctactacaaaaatattcagccagtatttttattgtggtgactttctttcaaatttataagtcaaattaacactttttttttgagacggagtttcactcttgtcgcccaggctggagtgcaatggctcgatctcagctctctgcaacctccacctcctgggttcaagtgattctcctgcctcagcctcccaagtagctgggattacagacactcgccatcacacccggctaatttttgtatttttagtagagacggggttttaccacgttggccaggcttgtcttgaactcctgacctcaggtaatccacctgcttcggcctcccaaagtgctgggattacaggtgtgagccaccgcacctggccagattaacacattttttgagcatctactatatgcctggtgatatattcagacatcagaaagatatcaagatatatataaaatagagtgtctgctagcaaggaatttatactttacttgctctacttacattgatggaaagagaactaataaattaactaagacaccaccatttgagtagaataaactcttaagtgccttaggagttcaaatgagtgaggggtcatattaactttgaagagtcagggaagtctgggcgtgacggctcacgcctgtaatcccagcactttgggaggctgaggcaggcagatcacaaggtcaagagttcgagaccatcctggccaacatggtgaaaccccgtctctactaaaaatacaaaaattagctgggtgtggtggcatgcacctgtagtcccagctactcgggaggctgaggcaggagaagctcttgaacctgggaggcagtggtttcagtgagctgagattgcgccactgtattccagcctggcaacagagcaagactctgtctcaaaaaaaaaaaaaaagggtcagggaagccttctaggaggggacttgaaccggactttgaatttttttttaaattacttttaatttttgtgattacatagtaagtatatctgcttatgggttacataaaatattttgatgcaggcatgtcgtgcataataatgaaccttgatttttaaaaggattttagaagataggggaggaactcagagcaaatagtgatatagaaagcacagatataaaaatgcaaagctttttgaggagtcagtgaataaaatcctatttggctaataatgacaataataataatgaccatttattgaaggcatgttgtatactgggtgtgttacttatttaaagatttcatcttcacactcactctccattgaggccaagagattatgtatgggccaaagtctcctctaaggcctatgttctttctaccaggcttctcttagaagaactgaggatttgataggatagtattggtagataaaggtggaaaagtagaattgggtcaaattatccagaaatgctttgcataaatccaaaggattgtagtttatgatctgtgattggattctgagcagaaactagaatgataaggtaattgatgacaagatgcagaatggtttagtgttagagagactggtagcaaagagatcagttagggggcttccaccatgtttgagagtgaggtagatgaggctttgatattctgcttaggaatttttaagatgatcatattttaagtaatatctagcttaagaagtaatattttaatttttttattattacagaagtgatacataattgcaatgcaaacatttagaaaatagaattagtaagaaaaagaaaataaaacttgcccttaatctcagcatgtagggctaaaactagtattagcattttggcatctttcctgctaatctttttattttatcattccttttcttactctcttcactgtgaactgaactagcaaatgcatggaaagttgactttaaataaattttattccattacagcaaaatctttagatatacttgttatataataaaatggtatagtataacctgaaactgtaaaactactaaaagaaaatgtatgctgggtacggtggctcacgcctgtaatcccagcactttaggaggccgaggtgggcggatcacgaggtcaggagatcgagaccatcctggctaatactgtgaaaccccgtctctactaaaaatataaaaaattagccaggtgtggtggtgggtgcctgtagtcccagccactcgggaggctgagacaggagaatggcgtgaaccctggaggcagagcttgcagtgagccgagatcgcgccaccgcactccagcccaggcgacagagcgagactctgtctcaaaaaaaaaaagaaaacataatagaaaaatctccatgagattgggtagacaattttttggatgtgcacaagcaacaaaagcaaaaatagacaaatgagattgcatcaaactaaaagcttggaaggccgaggcaggtggatcacctgagtcgggagttcgagaccagcctgactaacatggagaaaccctgtctctactaaaaaatataaaattagccgggtgtggtggtgcatgcctgtaaccccagctactcagggggctgaggcaggagaatcacttgaacctgggaggcagaggttgcagtgagctgagattgcaccattgcgttccagcctgggcaacaagagcgaaactgtctcaaaaaacaacaaaaaagaaggaaatactgtcatttgggacaacttggatgaacctggaggatgttacactaaatgaaataagccagacacagaaagacaaataactcatgatctcatttatgtatgaactctaaaaaagtcgatctcatagaagtagagagaagaggctgggtgcagtggctcatgcctgtaatcccagcactttgggaggctgaggtgggtggatcacgaggtcaagagatcgagaccatcctggctaacacggtgaaaccccatctctactaaaaatacaaaaaatcagccgggtgtggtggcacacacctgtagtcccagttactcaggaggctgaggcaggagaatcacttgaacccgagaggcggaggttgcagtgagccgagatcgcaccactgcgctccagcctgggtgacagagcaagactctgtctcaaaaaaaaaaaaaatgtggagagaagaatggtggttaccagaggatggggtgagtggatgggatgggggaggaaatagggggaagttggtcagagacacaaagtttcagttacataggaggaatacatttctgaaatctgttgtgcagtatggtgactatagttaataataatgtatatttccaaaaacagaaaatagaactgctatatgatccaggaataggagtaaattttaaatatgtcaccacaaaaaatgatgtgaggtagtagatatgttaattagcttgatttaatcattctacactgtatacatttatgtttgatctattttaaaaagtagtactatagtatgattaaaaatgaaggctttaggttgggtgtgcccacacctgtaatcccagcactttgggaagccgaggcagacagattccttgagctcacaagttcaagaccagcctgggcaagatggtgaaaccatgttttcttttgtattttttgtagagaaaacatggtttttgtagagaaaaccttgttttctctacaaaaaatacaaaaattaactgggcatggtggtgtgcgcctgtagccctagcgactttagaggctgaggtgggaggatggcttgagcctaggaggcagaacttgtagtgagctgagatcataccacttcactccagcctgggtgatacagccagagcttgtctcaaaaaaaaaaaaaaaaaaaaaaaaaaaaggctctagattagaggtgtccaatcttttggcttccctgggccatattggaagaagaattatctggggtcacatataaaatacactaacactaacaatagctgatgagctaaaacaaacaattgcaaaaaaaaaatctcatagtgttttaagaaagtttatgaatttgtgttgtgccacattgaaagccattctgggctacatgtggcccatgggctgtgggttggacaagcttgctctagattctagatcaaactgcctggattcaaatcctggatcttaggaaagtttagttaacctctctaagccttagttttcccatctataaaatgagggtaatgacagtaaatattttacggagttgttattgaagattaattaaattagtacacgtaaatcacttagaatagtacctggtatgtggtaagtgctcagtaaatgttagctattattattagtttcttttcctctggctgcttctttcagtggcctattatagcctttgttgttgttgttgttgttgttatttagtttttatttcgtaatcataaacttaactctgcaatccagctatgcatggaagggaacaaggaaaacatggaacccaaagggaactgcagcgaaagcacaaagattatgggatattgcgagcaaatggggtggaggagtgctctcctgagccacagaaggaatggtctggtggttaaaataaaacacaagtcaaatttattagagttgtccacagtcagcaatggtgatctccttgctggtcttgccattcccagacccaaagtgccccatggcctccacaatattcatgccttctttcaccttgccaaagaccacatgcttgccatccaaccggacacataaaccctggaataattctgtgaaagcaggaacccttataaccaaatcctttctctccagtggtcagagcacaaaagttttctgttgtctttggaaacttgtctgcaaacagctcgaaggagacgtggcccaagggctcgctgtttgactgtgatgttgaagaacatggtggggttgaccatggctgatagtacggggctcctggcggtggcagcagtgtccacaaagcacctatcttttttttattcatttactcactaaacacttgttgagtgcctactgttgcttttaatagattcaacggttttctactaaagcattgctgtccaatagaaccttctgcagtgatggaaatgttctatatttctgctgtccagtagccacatgtggctaataagcacagaaatattgctaatgcaaacaagaaattaaaattttatttggattgctttaaatttaaattgccacatgaagctagtgcctactgtatttgataatgctgggctacctacatctttgcctttgctttgctacgggtatatgtattccagcctagaaacatgtagggttgtgatgagaccaacattaccattcctattccatatctccttgatgtactttcttagcttatctccttttgatcctattgcttaggaatgatccccacctccaccctcatcccccttaacttaaaaaagtaatgttctttgctctcagccaagttttctaatgtatgaaaggtagcattcagtctatctaaatcttcccaataagcccacaaatgagatgatatatataaagcctctggcacaggaactgtcacactgcaagtataatacatgagaatgtaattattgttagccacgtgggtttgccctctgatggtgaccatttttgttctgcataagccatctgtctcaaagatactgtggtttaaaagcctgaaatggattactttttaaaagaagcttctaattatttatatcatttatgtttttatgtcttcactttcactatatattttgaagacaacaaaaggaaattattctaaccagtggcctagagcaaacaaagtccttttggcttttgttacccagacgagtattaatgtaatggaaacatttattatacttccctgtgactccttaaatgccaaactaagcatgactatgttttattctcaaggttcttagaatttgtattttctaaatgctttctggttgtcttagcaatttgctgttaatacttaggatttaaattttttggttactatttgttagtatggctcttagtctattttcaagctgtaaacattataagctttcttttataggtgcagaagtatgaaccagaatttttccccaaattgagattagatctacattgggaagaatccatctcttggaaccctaggattacacagatgtgccttctcaggtgctggccccgggtatgggaggtggctgagtagatgagacttctgttctcttggcttcatctagtcagaacagttgcactttttatcttttttatattgaacttctgtataagagttttgaagaaaaggtctcttgcttaaaagaaagagagagagagagaaatgaaggaaagaaagaaagaaagaaaaagaaaaagaatgagttgaaaattcttctgttagtgctttggaaaggctacttgggaaagaagcctatctgcatgatctgccaggtggtaggcatttaatcctctgggcataccttggttctcttctgccagagctattgtgtgcccagcaggagtgagtgagctgaacctttgtagttctctttttcttgaccccaacctcctagtttccctttttccctttatctcccttcctcctaagatttctatttgggaggaaaagtgtgggcctggtaagtcatagaggtagtacttgtgtaaattttgttcatgtgtgtgtattctgtttatacatgggcccagtgaagattggttattttatcatcagttgctcaaagttatcagttaaaaaaaggaacaataaagtactttgttgaatgcagggactgattgtttaggtctcttgtgaataaggttgtttacgccaggaagtcttatgctcaagatctgtaacccagttctatgccccactcacttccactccccagtggcctttttgaggaactatacactcagatttgttctcatacctccccacgaccccaagacagggcctcactctgttgcccaggctcactgcaatctctgccttctgggctcaagcaatcctcccacctcagcctcctgagtagctgggactgcaggcgtatgccgccacacttggctaactttgaaaatttttttgtagagaaagttctcactatattgcccaggctggtctcgaactcctgagctcaagcaatcctcccacctcggcctcccaaaatgctgggattataggcttgagccactgcactgggtctctctgttatttatgccatgagaaatttaatatttcttttagactccttcaattcaccaaatatgccttcaattcaccaaatatgaaattgaagactatgccttcaattcacaaatatttgcttggaactactcagtccctccctgtgctaggtaatatcatgattaatgcaagagaaatagaggcttcttgtctcccagagagtctccttaagaagtaaattatactatgtaggaaatagactagcattagctaatgctgtgagaatatggcaggatattttcccagtctcagttattaagacagccatctttccagttatccatcctgaaaaattccagccatttttggttatcatgtattccttgcttctaatgagaagctaagctgtgattctaaatattcaaaggcttttgcatctattccttcccgtatatgtgggctgtaattcagccttcttcactttcacctggagtgaattattttccctgtctctttgccctttttcactcttcctgatactcagctctggttgtatagtttatttcttaaaactttttgtggctcacattggtttcaaaatcgagtcaaaaattatttagactgacagttaaggttcagtctgtttttccagccttttcttccactctttctcttgtacaattcacacagctccacaatttcctaattatattctctaggacaagttatttaacctctgtgctttgatttcttctgtttaatgagaatggaccagatcagttgttagaaatcacactgaggcagggcatggtggcttacacctataatctgagcacttgggagactgaggcgggaggatccatttgagcctaggagtagtgagctatgatggcttcttcctgccagctgcacagacaaaatcaattccctgagatcgtggcattgcagtaagaaagagtttaattgactcaaggccagccatgccaaagaggcagttatcacttaaatcagtcttcctgaagccctctagaggttagagtttttatggacaatttggtgggcagggctgagggaatgggtgctgctgattaattgggggtgtggaaaagtccttgtgcgctgagtgtgcctctgtgtagggctacagcaggagtcctcaacccccaggttatggaccggtatcagcctgtggcctgttaggaactgggccacacagcaggaggtgaacaggtgagcaagcattgctgcctgagctctgcttcctgtcagatcagcggtggcattatattttcatagaagcgtgaaccctgttgtgaactgtgcatgcgagggatcttggttgcacgtcccttatgagaatcaaatgcctgatgatctcaggtggaacagtttcatcccaaaaccatccctccacctgaccctcacccgagtctgtggaaaaattgtcttccacaaaaccagtccctggtgccaaaaaggttggggaaggctgggctacaggaccagttgagtcatgagtcatgagtctgggtggggttggtctgaaaaaaatctctcagaaaaccagtcttaggttctataatagtgatgttatctataggagcagttggagaagtcacaaatcttgtgatctctagccacatgactcccaagcagtaagaaattgtagaactatacctacattttagcagaattctctcccctcccataatcctaaccttgtggcctttccttagttttacaaaggtagtttagttttgggaagggctattatcatccttgctttaaggttaaactgtaaactaaattcctcccaaagttagcttggcctatgcccaggaatgaccaaagacaaacagcttgaggttggaggcaagatagagttaacgatgtcagatttctcttttgcaaaggtggtttcagttgtgccactgaaacacagactgggtgatatagtgagaccatgtatgttaaaaaaaaaataaaaaataaaataaataaatatataaataagaaatcacattgaattaaatgttgaacaatttttaaataatcaggtttttaaaatatcttaagggtgagtgaatgtggatgtggagtgtgttccagaataaatgggcagtgttttaaaaaaaaattttttttttttgagttggagtttcgctcttgttgcccaagctggggtgcaatggtgcaatctcagcttactacaacctctgcctctcaggttcaagtgattctcctgcctcagcctcccgagtagctgggattacaggcacgcgccaccatgcccagctaattttttgtatttttaggagaaacagggtttcaccatgttagccaggctggcctcgaactcctaacctcaggtgatccgtttgcctcggcctcccaaagtactgggattacaggcgtgagccactgctcccagcctaaaatgtttttttgcatctgttgaaggttgaaaaaaaaataataaagtggatctctctgattttatcattgtaatcctggtgggtaactaggtgaaagactctcaagagagttcacaaagcatcttttgtaacactagactgtaaggtgatcttaatttttttttgagacagagtctcactctgtcacccaggctggagtacagtggcatgatctctgctcactgcaacctccgcctcccaggttctcgtgcttcagcctcccgagtagctgggattacaggcatgtgtcaccacacccagctaatttttgtatttttagtagagataggatttcaccatgttggccaggctggtctcaaactcctggcctcaagtgatctgcccccgttggcctcccaaagtgctggtattacaggtgtgagccactgtgtcttggctgaagatttttaatataaacaatgattactaattattgagtacccattatggaccactattaatttcctgccgcattccctttcttctttccagacctctcccaccattcatccatcacttgagccaaaaacttaccattcttattatctttctcttacaccctatttcaaaccatcaagtagttcagcattatcttcaaaatatgtcctgagtctttttacctctacacttactactctagcccaaccatcctaattgatctcttgtcttccccttttaccccacaatagccagattgaattttaagagggtaaatcagattatgtcatttccctgctgaatttcctaatacagctttttgtcattcttcaaagttcatactctgggctttaacctatcaggccctaaatgatttggcctacgtggctctgaccatatttccaatcattcttcctttttcttacatcattctaaccacactcactaaccctcttgtttctcagacacattaagcttttttccctgcttcagggcctttgtacttactttattccagaatcatatgatatatttctgctgagatagcccctcttcaaagaaatctttttgactagtctaaaatagacatcgatatttgttacaagttctcattacttctgaaaagaaccttattcatttgtttacctattgcttaaagcctccagtattgaatgagctctctgagggtagaagtttatctttttcaccactgtatttgtagtgcctatagtgtagtatctctagaagctgatgccaattagaaccaagccagtttgcatcacagaaacttataaaagctcaggaactgaaggtgggtgtcaggcttgggctaaaaataagagggctattcaaagtcttttaaggggtaactgggcctgaaagtcaacatccccatttcttgtaactaatcagttaaatatcacccaccccaataagacatggtttatttttggagaaaaattgaaccagaaatacttcatactagtgaacatctgatagaatgcaatacctaaaagaggagatggggggatagtctgcatactggaatggtgaggctcataagacttctagtcaccttccatcacctggctctcaggcaggcaagaatcattcctatcctaccctcaaccctgccacttgccaggaaattgatggattttttcctggagaaaatgaatagacccaaataaaggaagacagttttttaaaaatgacaacctttctcagaagtatttggctttggcaatataataaaattaaaacattttttatatgagccataggctcatgctctttgagttctcaccattcagtatgcagactaacccattgtgccgggcctggctaatacctggaggggagaaccaaaggacatgtgcttccagattgaaagggcccagcacaatgaatgaaaaaacagccacccagagcatatcattatgaaattttagaatatgggtaataaaaatattctaaacatttccacagaggaaaaaatttaaaaaaaaatcccatacaaaaaagctagagcaatggaagatgctttctgagagaaaatgatttcctacttagaatcctatgtccagctgaactaccaatcaagcatgagagtagagtgaagatatttttagataggcaaattgtcaaaaaatttgcctctcatgagccccttctcatgatgctattggaggatgtgtcccttcaaaacagggaagtaaacaaaacaccctaataaaaataaaaaggaagccttgagacctagaaagaagtgggtataaaggtaatgggaagtcccaggatgactgttgtgcaacagtctacaaaataagcagttcaggttggattcgaaggattacaagattcaggagagatgttgggaagtgggggtgtgaggaaagaacttatgtatttcctgatatgtttggcagggtggaaatccatattcagaagaattttacaattttgttggaggctttggaaagaagtagcagtaggcatgcatataagtcctttctcatgctgctaataaagacacacccaagactgggtaatttataaaggaaagaggtttaatggactcgtagttccacgtggctggggaggcctcacagtcatggcaaaagatgaaggaaaagcacagggacatcttacatggctgcaggcaagagaacatgtgcaggggaactcccctttataaaactatcagatatcgtgagacttactcactatcacgaaaacagcatgggagagacctgtccccatgattcaattacctcccaccaggtccctccaaaatgggaattatgggagctacaattcaagatgagatttgggtgggacacaaccaaaccatgatagcatgtaataactaagcaaatgaaaaaaggggtaaaatacaaacaattatagaagaaataaagtgaaatcataatatagtacttggcctcatagtgattataatcagtcataataatgtaaatgctggccaggcacggtggctcacacctataatcctagcactttgggaggctgagaccagcctgggcaacatagtgggaccctgtctcagcaaaagattaaaaaaacaaaaaaaaacccattgtggggccaccacctgtggtcctacctacccaggaggctgaggtgggaggatctcttgagcccaagagttcaaggtttcagtgagctgtaatcacaccgctgcactctagcctgtgtgacagagcaagaccctgtctctaaaaaataataataattttaacgatgtaatcctgagtcttgatttttttcccctgaatgtcaattttaccccaaattatcttataacaatattggaagggaaatatttaagaatgctaaatcctcagctgctacactgtaaaatcagtagataaggtcagaaatggcagtgtatgttagctagatgtatgaaggtaaatagaataaatagctaaaaagagttgaaagtggttccctctgaggaggtgattcaatgtggtgtgggcagggtaggggactgttattttttattatatgcctatttgaagctatgtaagtgtgtaacttaagttacttaaggaggctattgcaatcatctagatagagctcatgatgactgggaccacatggtggtagtaaaggtgaagaggagttgggttttgaatttttttatttttatttttatttttagacagagccttgctctgtcacccaggctggagtgcagtgggtgtgatcatgggttactgcagcctcgacctcctgggctcaaacgatcctcctgcctcagccttcacaacagctggtactacaggtgtgtaccacctaaatgtgtcacacccagctaattgtcttatttttgtagagacaaggtctctctatgttgcccaaactggtctctaactcctggcctcaagtgatcatcccacttcagcctcccaaagtgctgggattacaggcatgagccaccacaccctggagactttgagttcttactcatttggtaaagtctttattttgccctaacatttagttggcaggccaaccacataattttaggttcaaaatattttattgagaaattttaaaatactgttcataattatttattttgagataagatcttgctctgttgtccatgttggagtgcagtggcatgatcacagctcattgcagcctccaacccctggctcaagcaattcttctgcctcagcctgccaagtagctgagactacaggtgagcaccaccacactgggataatttttttgttttaatttttttatagagacagactgacccactatgttggccaggctagtcttggacttctgggctcaagcagtcctcccaccctggcctcccaaaatactgggattgcaggtgtgagccactgcaaccagctgggttctgaatatcttctttcttttaatttttcttatttctccaagaaaaaatagagatttttttttgagacagggtcttgctctgttgcccaggctggagtgcagtgacaccatcatggctcactgcagccttggcctcctgctgggctaaaatcatcctcccacctcagcctcccgagtagcagggactacacgtatacaccaccacacctggctaatttttgtgtgtgtgtgtatatatatgtagatatatacacacactaagattttatatatatatctatatatagatatagatatagatatattttttagagatggggtttcaccacgttgtgcagactggttttgaactcctgagctcaagcgatctgcccgcctcggcctcccaaagtgctgggattacaggtgtaagccattgcacctggccctgaatattttttaaagaggaaatcggtgagggatattagcacaagggaaggaggcataaaggatgcctcttaattaggttttttgtttgtcaatttttaaactttaaatttattcattttttatttcaaaccaccatacacatgtgcagattacttaggttttgacttgaacaactggaagaattgaattgccagtaactgtgctggggagacattgtggggaacagttttggaaatgggagatcaggagatatcaacttggcagttggataaacaagtttggaattcaaaggagagattcaggatggttgtgcctcgtagtaatttaggggatcttgagcaaattgtgaaatatctataacctcagttttcttacctgtgaagtaggaaataatagtagtactgctgtatcagcttgatgggaagattaaattagataatatacataaagaattgatcacagtacaaaggcactaaatcttacctgtcactattttttattattgttattactactgtcacaataatctgaagtatcatatattgaggctgtatagcttaaagtttaagaggtaaaaatccactccctgactccgccatttgctcattgtgtgcccttaggtgagccacttaatctttatttttcttatctctaaaatagaaataggcctggtgtggtggctcaggcctgtaatcctagtactttgggaggccaaggtgggcagatcacctaagttcaggtattcgagactaacctggccaacatagtgaaaccccgtctctaataaaaatacaaaaatagcccggcgtggtggcgcatgcctgtaatcccagctactcgggaggctgaggcaggagaattgcttgaacccaggaggtggaggttgcagtgagccaagatcgcgccactgcaatccagcctgggtgatcaagtgagactacatctcaaaaaaaaaaaaataattaaataaaatagaaatatacttatcacatatttttacaaggattaaatgagataagctctgtaaaagtatttagaacagtgtctgacacgtccttaggtgctcagtaaatgttatacatcaccatcgtttgttcccttgaagaagggaacatcacatttatttctgtagcccccacttaatcccctttgcatggcactgtacttaatatatatgtgacaggcattacaaaaatttcaagtactctaatatttatctgtggagagcacaaaccttgcaaatattaattgcttgatacatacttagtagattgacattttctttcctccatacatttcattcactttgggagagggagaagaaataaatcattgtgagagtattgtttcagaaatgtgctcacatagattgaagtctatatttctattttgttactttggtgtaaatttataagtaattttagaataaaggagaaatttggaaaggaagaagaaactttttcagggcttgggaagacaacttaaatacttgagtttgtggatattagttctcttttgaacttcctggattaagaaaaagctttttggccatatttaaagtcactgtatgtatatgtattaatagttctgcctttgtcaggagacttgtttttttttttttttttcgcttgcatggcagttttgagcaatgtgatttaaaatttttgttaaactacttataaattcattctttgtttaatttcagtttgttattcaagatagagggtatatattttcctcccagaaatcttggctgttttctatttattaaactgttctaatatttgtaagcaagcagatctgactttaactttttagatctttgtattgctttaccccaaaaaagtaaaattggaccatgaacttgattgggcctcttgttattatgtgtagtgctattgacatgatctgattgctaagcaatgtttgttctgcctttggctgtcttaaaattggactgttaaaaaccaaagacaaaaaggagaaagcgagactgaaccagctctgcttagtgtcacctgatgtgagactctggtggttaatgtctgttcagctgagttttccttatgaattctcctatctaagacctagcacaaccagttttccatgatgtaatacctctaaaacatgtttgaactgcacttacccgaggatattactgcctttttacgggtttagattcatagttcttctgggacttgagatctcagccattgccttctcttcttctttcttcttcttcatctttttctttctttctttttttttttttttcccatcacggctcactgtagtctcaacctctcaggctcaagccttccacttcagcctcctgagtagctaggaccacaggcgtgccccacacccagctaattttttgatatttagtagagatgaggtctccctatgttgcccaggctgatcttgaactcctgggctcaagcaatcctcccacctcagcctcccaaagtgctgggattacaggtgtgagctgctgtacctggcctttttgttgttgttattggtgattttttttttctagcccaagtccaagaaatgatggtatctttgtattatttgggagtaaaatgcaaagcaatttattttgtgctacgtgttaaaggttagtggagtctggtagagtacgttacaggtccctttcttccaaaattatgagaggaaattagataaaaattctggaaaaacatactttttaaaaaagaataggctggatgcattggctcatgcctgtaatcccagcactttgggaggccgaggtgggcggatcacctgaagtcgggagtttgagactagcctgaccaacatggagaaaccccatctctactaaaaatacaaaattagcttggtgtggtgctgcatgcctgtaatcccagctacttgggaggctgaggcaggagaatcgcttgaacccaggaagcagaggttgtggtcagccaagatcgcaccattgcactccagcctgggcaacaagagctaaactcagtctcaaaaaaaaaaaaagaaaaaatagtacaccaatttatttaggtttcatcaatctttgcatgcatctgtttctttttcttttttctttttcttttttttttttttttaaagacaagatcttgctgttttgcccaggcagagaagtgcagtggtatggtcatagctcactatagccttgaccttctgacctcaagtgatcctcctggctgtcttctgagtagctgggactacaagcacacaccaccatgcctggctaatttaatttttttatttttttagagacagggtctcactatgttgcccagactggtcctgaactcctggcctcaagtggtcctcccaccttgatctcccaaagtgctgggattacaggtgtgagtcactgtgcctggcctcttttcttttcttttctttttttttaatggttattagcagggtttcagtgttttagatgtaggccttttagaaaacataagtatcaaaattatgtccacgttttaacattgtattataggtttatttaggcctcttaattgttgttaccataacctttagaatcacatttttctggaaagaccagtatgggtcagaagaacccctatgatatgtatgctgcttactgctcaacgttggcagcagaaaagcttgtaaagcaaaccaggtagattttcattggttcgtagaagggcagttcttttttatgaatcaaaaaccaaaagtggttttattgaaccactggcctttttttctttctttctcattatcacaaggcaaaacacagactttggagccaaacatccagattccagtaccctctttaacctttgtcaagtcatttaaatactccaaacctcattttcctagatgataaagtgggggtaatttcatctcaggtaatatatttataaagcaattagcacagtttccaggtatattgtaggtaagcagtaagtaattttcttgacagctttgatacagtggccccagaactcttcctaccaggtgctgttattcagccttcaggaggtccatgaacagtagtaatagcagtgtcagtgtttttttaatttttattatttatttatttattattattatttctttgagatggagttttgctcttgttgcccaggctggagtgcaatggtgagatctcggctcactgcaatctccgcctcccaagttcaagcaattctcctgcctcagcctactgagtagctgggattacaggcagctgcaaccacgcccagctaatttttatatttttagtagagacagggtttcaccacgttggtcaggctggtctcaaacttctgacctcaggtgatccacctgccttggcctcccaaagtgctgggattacagatgtgagccaccacacttggccagtagtgtcagtgttttttaaatcagagtaaggatatgttttagactatgtcacacctctttcttcacttcttttttttttttttttttaagacagagtctcgctctgttgtccaggctggatggagtacagtggcatgataccggctcactgcaacctccgcctcctggtttcaagcaattcttgtgcctcagcctcctgagtagctgggattacaggtgtgtgccaccacatccggttaatttttatatttttagtagagatggggtttcatcatgttggccaggctggtcttgaactcctggcctcaggtgattcacctgccttggcctcccaaagtgctgggattataggtgtgagccaccatgcctggctcttcgttcacttctttgtttaggtaataaagtttgagggaggacatttatgctttaatgtttaactctgagctttatacagaaccgtgaatttgataaatatttgactgactgaatgcgaatgccaccaaggaacatgttaatgttattttccttatgctagtttacaaagagttaaagtctaaaatttgttttagatctgttaatgttatatcacaggggagtgacccatacaattttttgtgttatgtacctattattagttttctgtggctatcataacgaattaccacaaacttagtagcttaaaacaacacacgtttattttatcttactgttctataagtcagaggtctgacaagagtctcactgggctaaaatcaaggtatcagcagggctgcattcctctctggaggctctagaggagaatccatttccttacttttttcagctgccagtggctgtttgcattcctcggctcatagaccccttccgtcttcaaacccagcaatgagtctttctcacattgcatcactctgatattgactcttctgcctccctcttccacctatgaggaccttgtgattactttggacccacagtgataatccaggataatctctcttttaaagtcttctgaccagcaactttaattgcatctacaattttgatttatttcccttgccatataatgcgacacagtcacaggttctggggattaggacatagacatctctggggggccattagtctgcctacctcagtatcccattaggaaagcatttttgagcacatccccatgtgctactattaacccataattaaatattagtaaaatgaaatttctctttttatcaaaaataagtaaaagttttcattttcttcccatactccaacggataatgcggctcattacccattttggagactgctggctaatagtaggtcctaggaaaagacctgccttggaataagaatttcaacttttggcagggtgcagtgtcttcgtgcctgtgaaatcccagcaatttgggaggccgaggcaggcagattgcttgagcacaggagttcaagaccagcctgggtaacatgacaaaaccccatctctacaaaaatacaaaaattaggcctggtgcagtggctcacgcctgtaatcccagcactttgggaggccaaggcgggcggattacctgaggtcgggagtttgagaccaccctgaccaacatggagaaaccccatctctactaaaaatacaaaaattagctgggtgtggtggcgcatgcctataatcccagctactcgggatgctgaggcaggagaattgcttgaacctgggaggtggaggttgcagtgagctgagatcatgccacttcactctagcctgggtaacaagagcaaaactccatctcaaaaaaaatacaaaaattagctgggtgtggtggtgcgtacctgtagtcccagctacttgggaggctgaggtgggaggatcgcttgagcccaggaagtggaggctacagtgagccaagatcgtgccactgcactccagcctgggcaaaagatggagaccttgtctcaaaaaaaaaaaaaaaaaaaaaaaaaatttcaacttttatttaagttcaatgaatactgagaactaactgtgaacaaggcaatgttttaagtgtatggagaggcacaaaactacatggtatatgttgtccaggtggactaactagtggcttaaaggcttgttttttttttttttttttttttttcaggtcctagtccaatggaggttgggtagaggtggaaggagagctcattttcacctagaagagggcctcaggttcctccactggatcttctgcatctgctggcagatgaaggaagaagctgtggaaaatagtgttgaggttttatggaacaggcctagaaatgacataatcacttctgcccatataccactggccagaacttagtgttacagtcttaaccaactataataaacactgggaaatgtaatctacttcaggaggaaaggggaagcaatttgttgaacaagtagctattctcttccacacacaggatccctgccctcaaaaaccttttaatatcatggaagaggtagacattaggtaaaacttgatgtagaaggcagggcctaataaatgctccagtagaggtttatttttatttttattattatttttttgaaacggaggcttgctctgtcacccaggctggagtgcagtggctcaatctcggctcactgcagcctctgcctcctgggttcaagcaattttcttctgcctcagcctcctgagtaactgggactacaggtgcacgccaccacacccagctaattttttttgtatttttggtagagattgggtttctccatgttggccaggctggtcttgaacccttgacctcaagtgattctcccgcctcgagaaagattaattatgattggaaatatttgaaattacatctctgagctagagattcttataaccaacttcaaagagctattttaagaattcagtgacaggccaggcacagtggctcccacctgtaatcccagccctttgggaggctgaaacagaagaattgcttgaggccaggagttcgagagtagcctggacaacataaggaaaccccatctctacaaaaaaattaaaaaattagccaggtgagatggtgcatgcttgtagtctcagctattttggaggccgaggtgggaggatcgtgtgagcccatgagttcaaggctgcagttagctatgatcacgccactgcactccagcctgagtgatagagtgagatcctgtctctaaaaaacacaaaaagagttaggtgatttaatatgtggacatgtctggcacactaaatgctatataaatgtttggtgctattattgttgttgttatttggaggtgttcttgagccaagtttttaaggattcatagagctttgaaaaatggattccagacagagagactcattctcacaacaatatggaagtaggaggattcaggacatatttagaagtggcaggttgtataactgcaacatagagaatgcaggtggtgcctgtggcctcagagcctgcaggcggtgctggctctgggtccgggttggaaaaataagaattttataaaatgcaaaagaaaaagaaaagagagagaatgcaggtggatgtaataggagataaagcaagagaggtttggatcagatcattcagacctttgaataacatggtaaggaatttggactttaatcgggatctgtaagctgccacaaaagctttttgagtagcagtttctcaagggaagtgattgtgtcttgctcatctttatatactttgtataactatacagagaggtaatatagcattgtgattaagaacacagactctataatcaactgtttaggtttgactcccggctctgccttttattagctgtatgatttggggcaagttacttaatctctgtgcctcagtttctttattggtatgattgggataataaaagtactacttcattgggttattatgaggattaaatgatttcatataaggtaaagtgcttagaacaatgcctgcatagtaagtgctcattaagagttagctgataccaggctgggtgtggtggctcacacctgtaatcccagcacttcaggaggccgaggatggcggatcacttgaggtcaggagtttgagacccgcctggccaacatggtaaaatgctgtctctaataaaaataccaaaattagtcaggcatggtggtgcacgcttgtaatcccagctgcttgggaggctgaggcaggagaatcccctgaacctgggaggtggaggttgcagtgagccaagattgtgccactgcactccagcctgggcaacagagcaacgaagtgagactccatctcaaaaaaaaaaaaaaaaaaaaaaacaacttagctgataccaggccgggcgtggtggctcatgcctgtaatcccagcactttgggaggccgaggcaggtggatcacctgaggtcaggagttcgagaccagcctggccaacgtggcaaaaccctgtctctactaaaaatataaaaattagccaggcatggtggcaggcgcctgtaatcccagctactcgggaggctgaggcaggagaattgcttgaacctgggaggcagaggttgcagtaagctgagattgcactactgcactccagcgtgggcaacagagtgagactctgtttcaaaaaaaaaaaagagttatctcataccatcatcattatcatcgttgccagtgcctggcacataataggtactcaaaaaattttgagttgtgttttaaatttacccagtgaaggctgggcgcagtagctcacacctgtaatcccagtactttgggaggctgaggcgggtggatcacttgaggtcaggagttcaagaccagcctggccaacatggtgaaaccctgtctctactaaaaatacaaaaaaattagccaggtatgggggcacatgcctgtaatcttagctacttgggaggctgaggtgggagaatcacttgaacatggaggccagatagcgctgctgcattctagcctgggtgacagagcaagacccagtctcaaaataaaaataaataaaaataaataaaaataaatttacccagtgaagaatcacttgagcccaggagtttgaggctgcagtgagctatgatggtgccactgctctccagcgtagttgacagagctagatcttgcctcaaaaacaaaacaaaacaaaacaaaccataatttacccagcaagtgttttttatttttaacctccttcagagaaagactaacaagcgtttatatattgtcatatgccaggcaagagaatggtatcttgctgttaagaagcttgtggtctagtaaaaaagttataaggcatgtgataaaacatagttaaagcttggaaatgatgctataggaaggtgatataggctgggcatggtggctcacacctgtaatcctagcatatttgggagggtgaggcagaaagattgtttgagcccaggagttcaaggttgcagtgagctgtaattgcaacactgcactccagcctgggtgacagagtgggaccttgtctcaaaaaaaaaaaaaaagaaaagaaaagaaaagaaaggagtgtaaatggctgccttggtagttgaagaacatgagaaggaagtatttgaactggtatttgaggatgagtagaatctaactacagtaatgcagtgcataagatgttttggtcaacaacagaccgcatacatgatggtggttccatgagattataataccatatttttactgtaccttttctatgtttagatatgttaagatacacaaaacttaccattttgttgcagttgtctacagtattcagtacagtaatatgctgtacaggcttgtagcctaggatcaatagactctaccgtatagcctgagggtattgtaggctataccatccaggtttatgtaagtacactctatgattatgcaaccacaaaatcacctaagaatgcatttctcagaatgtatccccatcgttaagtaaggtatgtggaaatgaagagaggggcattttaggtagtgggaacagtctgagaaaaggcaaagatgtggaaaagcttaataatgacactttatggggaatggtaaatcatgctatagaaaagactctagtctctagacaaagtctagtttaccagtagtatcagagttaagagtttcctgttggggccgggtgcagtggctaatgcctgtaatcccagccttttgggaggctgagacgggcggatcacttgaggtcaggagttcgagaccagcctagccaacatggtgaaacaccccgtctctactaaaaatacaaaaattagccaggtgtggtggccgcctctaatcccagctactcgggaggctgaggcaggagaatcgcttgaactcaggaggcagaggtgcagtgaaccaagactgagccattgtactgcagcctgggcaacagagtgcggctctgtctttaaaaaaaaaaaaaaaaaaaaaaaaaaaaagagtttcctgttggtcttactatctttagagcagtgataaacagtcatttgtttaaaggctttgctactcactgcatgtagtctgtagaccaagcgacatcagcatcacctgggagtttagaaattcagattcttaggccccatccctgacctacagagtgcgagtctgcattttgacaagatccttcatgggtttgtttccacagtggtctaaagtacaaaagcaatccttggcctagtgtggtggcttactttgggaagccaaggcaggaagatcacttgaggccaggaacttgagaccagcctaggcaacacagtgagaccctgtctctaccaaaaaaaaaaaaaaaaaaaaagccagctgtggtgtgtgcctgtagtcccagctgctcaggaggctgagacagtgagacaggagagtcacttgagactgggaggttgaggctgcagcgagcttatgatcacactattgcactgtgccaccgcactccagactgggcgacagagcaagaccttgtctcaaaaaaaaaagcaaccctccttctcaacatgaatctgtatgtcatatgaaactaaaaataacaaagttgagtaatcacttactctcaaagcacatgcattaagaaagcacccccttcctgagttaagtaattctagctggtatgatttggggtggggtatggggataggggaataaaaatcattcagaatataaatttttaaggtcttgtgacatgacaatgatttgaggcttcatttcgatttttgatatagttagcaataaaaactttagtgaaaacttattgttgatgttacgtgcttttctaggcacatgtcacttccctgtcaaggatgagtaatatttcctctttatagtatattgtttttttacaacatttagagtgattaactctgttcaagctctttttttttttttttttgagacggagtctcactgtcacccaggctgaagtgcagtggcacaatcttagctcactgcaacctccatctcccaggttcaagctattctcctgcctcagcctcccgagtagctgggactacagacgcccaccaccacgcctggctaatttttgtatttttagtagagatggggtttcaccatgttggccaggatggtcttgatctcttgacctcgtgatcctcccaccttggcctcccaaagtgctgggattacagacatgagccactatgcccggccgctctttttccaatataaagctaatgcatgtctcagcttgccagctctgtgacaccactttggatgtggtggtggttttccattaggaatgatttgggagaggttaggcagtaaagttgcacgtagaagtagagttgtgtgacacgattgtgatatggttatttgagtagagggtgggaagaaagcagacagaaaactctcctatgaagccagtgcctgcctggatgtgctatgacatctctgtagatggtgtggtcaaaataatagtgggcctgggaggaagaaaagcaagggtgtgtcacatccaaaccaggtcttttcagcttctagaaaaacccatgattttaaaatgtagccattgtttttctagtagaatcctattgcctgacttctttataaatatttgattaaagaaaatcaaatacctcttggctttactgccttgtacttgcctctaatgttctttaatgtaacacgagtttacattgtgaagttaatttggtaattattgcttcttcattcaataaatgtgtgtttagcaacttgtgtacgaaacattttgtgtgagacattgtatatagaaacaaatgagacaagatctgtactcttaaaagccttggcccggcatagtggctcatgcctgtaatcctagcactttgggaggccgaggtgggaggatcacttgagcccaggaatttgagaccagcctgggcaacaaagcaatactatctctaaaaaataaattttttttttttttttgagacagagtttcactcttgttgcccaggccggagtgcaatggtgcgctctcggctcaccacaacctccacctcctgggttcaagcaattctcctgcctcagcctcccgagtatctgggattacaggcatgtgccaccacacctggctaattttgtatttttagtagagacagggttttccatgttggtcaggctggtctcaaactcccgacctgaggtgatccgccagcttctgcctcgcaaagtgctgggattacaggcgtgagccaccgcgccgggctaaaaaatattcaaataggccaagcacggtggcttatgcctgtaatcccagcactttgggaggctaaggcaggcagatcacctgaggtgggtggatcacctaaggtgaggaagtttaagaccagcctggccaacatggtgaagccctgtctgtactaaaaatacaaaaattacctgggcatggtggcaggtgcctgtaatctcagctactcaggaggctgaggcaggagaattgcttgaacccgggaggcggaggttgcagtgaggcaagattgcaccactgcacttcagcctgggtgacagagcgagacagtctcaatcagtcaatcaatcaatcaatcaataccttatattccagtctggggaaggagtcagaaatgttagattagcaagaatagctaacattttctagtgtttattatgttccagaagcccaagttatcttatttcatcttcacaataaccatatgggttaggtaatattaatatttacattttgcatgtgaagaaactgaattgcagagaggtcatcagtaaatggtagagccaggattcaaatcaaagcagtctaactctagatccagaccacttaacttaatgctaattagcagtcattcaaagtagggtgaaaagtgctagttatactgtgggaggtagggagagacaaaagagagagagaagagattaatgctaagggcgtccaggagatcctttgtatagaagatgaaattttagctgatcttggatgattttcagtaaatatagtattccaattcaaggaaggaacttcaaccaagtttccaagtcataaaaatcattcatgccatttaataaatctttactgataactagcttactgtgttccagacactatactaggtagtagaaatgcagagataaatgaagctctgaatcttccatagtgagaaaagtttcaagagtgatatggggccaatgcaggaggattgcttgacacaaacagttcaagaccaacctggacaacagcaagaccccagctctatttaaaaaattaaaaaatttgctcgctgtggtgatgtgtgcctgtagtcccagctactcaggaggctgaggtgggaggatcacgtgagccaatgaggttgaggttgcagtgagctataatcacactgttgtactccagcctggacaacaaagcaagaccctgtctcaaaaaaaaaaaaaaaaaaagggctgggcgcagtggctcacacctgtaatcccagcactttgggaggctgaggggggcggatcacgaggtcaggagatcaagaccatcctggctaacacagtgaaaccccatctctactaaaaatacaaaaattagctgggtgtggtggcatgcgcctatagttccagctactcgggaggctggggcaggagaatggcatgaacccgggaggcagagcttacagtgagccgagatcgcgccactgcactccagcctgggcgcagagtgagactccatctcaaaaaaaaaaaaaaagaaatgtagctagaggctgggtgcaatggctcacgcctgtaagctcagcactttaggaagctgaggtgggaggatttcttgaggccaggagttccagaccagcctaggcaacataatgagaccctatcgctatgataataataataataacaataacaataataataataataccaaaattagccaggcgtggtggtgcacacctatagtcctagctgctcatgaggctgaggtgggaggattgcttgagcccagaagttcaaggttgcaatgagcagtgatcacaccactgcactccagcctgggcaacaaagtaagactctttttaaagaaaaaaaaaaaaccttagaaacatagatagagaatgtaacctattcttaaagtttggtaacaaataaaaagtgaattagattcatattttagtgagggggcaagggaagatttctatttttattttttagacagagtctcgctctgttgcccaggctggagtgcagtggcgtgatcttggctcactgcaacttctgcctccctggctaaagtgatcctcctgcctcagcctactgagtagctgggaccacaggcatgccaccatgcctggctaatttttgtatttttttgtataaaaaatacaattattattttgtattttttgtaaagatcatatttcaccgtattctccaggctggtcttgatctcctgggctcaagagatctgcccgccttggcctccccaagtgccaggattccaggtgtgagccactgtgcctggcggaagaattttttaagatgagggaaatttaactatatatttgtaggctagggtcatagagcccagaggaaaaggacaggtggatgaagaataaggctcatgggaaaatgtgaggtttcaaagataagttggagtggatcatgggaagttttaatgttattctgtaggcagaagggaaccattgaagggttatgaaaaagagaatgacatattttgtgttttgaaaaggtaactctcatagccatgtaaaggataatgtaatttaggattgttaataatgataaaataaaaaccactgacctttatttgagcatacactaggcattgctacacagtatacttgaaaatatcccatttaattctcataacaaccttttaaggtggtgttatttttctgtccatttttatagatgaggaaattgcgatttataaagattaggtaactttcttaatgtctcccaggtggaaatggagagatatccctgtgctctagaggaagggtcaatgccttagtgttttctattgcttagaataccagaaactgggtaatttataaagaaaaggaaactatttcttacagttatggaggctgagaagtccagggttgagaggccacatctggtgagagtcttcttgctggtggggactctctgcagagtcccgaagtggctcagggcatcacatggcaaaggggctgagtatgccagatcaggtctctcttcctgtgtatttttgttggagacagggtctcacgctgtcacccaggcttgagtacagtggcatgatctcagctcactgcagcctcaacttcctgggctcaagtggtcctcccacctcagcctcctgagtaactgagaccacaaaagtgtgtgaccacacccagctaacatatgtatatgacgaggtctcaggtctccctatattgcccaggctagtcttgaactcctggattcaagcgatccttctgccttgaccactcaaagtgttgggattatatgcatgaaccactgtgcccagtctcttcctcctcttagaaagctaccagactcattcctgcaataatccattaatccatgaatggattaggcagagccctcatgacccaatcacctcttaaaagccatacctctcggccgggcgcggtggctcacgcctgtaatcccagcactttgggaggctgagacgggcagatcacaaggtcaggagatcgagaccatctcagctaacacggtgaaaccccgtccctactaaacatacaaaaaattagccgggcgtggtggcgggcgcctgtagtcccagctacttgggaggctgaggcaggagaatggcgtgaaccagggaggcggagcttgcagtgagccgagattgcgccactgcactccagcctgggcaacagaatgagactccgtctcaaaaaaaaaaaaaaaaaaaaagccgtacctctcaatactgccacgttgggaattaagtttcactatgagttttggagggagcaaacattcaaaccattgtagtcagcagactttttctataaagggctagatagtaaatattttagtctttacaagtcacacagtctctgtcacaactattcaactctgccattataacatcaaagaagccatagataataccatatctatgttctagtaaaacttaatttataaaaacaggtagttggccatagttagccaattcctgctagtacccatcatagtttggaaagccttaatcatgcaggaaatgtagcttatcatattttactttaactgtttttgttatagtaggataatgggaatagaattattcctaggcagggatataatttaatctcagagaagcagtctttctaaaagaggctgactagaaacagcagttcatgtatacaatttaaccacattctgcataatttatctttttattataattgccctccaacagaatgaccctagaatgaaagtttttatttactctctgtccttaatactttcaacatagcagccattcaataaataattgtttaataaattaatggcataccctcaaaattctagtgattggggagttgtatgaacatttagagaaaaatgacccatcttattttatttttattattaattaattaatcaatttatttatttttgaggcagagttttgctctggttgcccaggctggagtgcaatggcacgatctcggctcactgcagcctccgcctcccgggttcaagtgattttcctgcctcagcctcctgagtagctgggactacaggcacctgctaccatgcccagctaacttttgtatttttagtagagacagggtttcaccatgttggccagggtggtcttgaactcctgacctcaggtgatccacccgccttggcctcccaaaatgctgggatatttccacattagttgaaatgtggaagcagcatgttttaaaaactctgctgtgatattatagccaaccaggcattctcctttgtttcttctcactcagcaatcatttactgaatttgcttactctttgtttactaggtggtgttaggttctgtgaacacagggaagaatatgacatggaccctgtcttcctggaaattttatgatcctttctaacacagtcactgctgtgccttacactctgcttgtagtcagtctcttcccattcctttgctcttctaaactagaacttacttgggacttgggtattgttaatggctttaagacgtttatcttctcctactttatgatcatcatcagtcatactcattgatttatggtttttatttaaaaatcattcatatatataaatataacctgttggttgagaaaaacttcaaatatcacttaaatgtgtaaactaaaaagaaatagtgactttgtgtctgtgtgtaagcatttagttaggtaatggcagagctgaaaccagcatcaagtttatttacttccaattggggctttttccattataccatgctgttttcaagactactctccttcttccaccattgctttttaccaccaggtcttgctacaaccagatacttcatggtaaatttagaaatttatcagcctggcatcttaatcaagattaagagtcttatgccaaatcttatgcaaaggcgtaagaatgatataatgaaccctgaggacctggggggaaaggttgggagggggatgaaggataaaaaactacatatggggctgggtgcggtggctcacgcctgtaatcccatcactttgggaggccgaggcgggtggatcacaaggtcaagagattgagaccatcctggccaacatgatgaaaccccgtctctactaaaaatacaaaaattagctgggcgtggtggcgcatgcctgtagtcccagctactctggaggctgaggcaggagaattgcttgaacccgggaggcggaggttgcagtgagacaagatcatgccactgtactccagcttggcaacagggtgagactctgtctcaaaaaaaaagcaacaaaaccacatatggggtacagtgtacaatgctcaggtgacaggtgttccaaaatcccagaaatcaccagtaaaaaaactaatccatataaccaaaaaccacctgtacccctaaaactcttgaaataattaaaaacaacaaaaagattaagagtctacagggctgtacaagatagcagggggcttcacaggttctttcttcctttcctttccctttccctttctctttgcctttccctttcccttcctttcttttctatctatctttcctttttttttttttagatgcagtctcttttttttttttttttttttgagtcaaagtctcgctcttgtcccctaggctggagtgcaatggtgcgatctcagctcactgcaacctctgccttccaggttcaagggattctcctgcctcagtctcctgagcagctcggactacaggcgcatgccaccacacctgcctaatttttgtatttttaatagagatgtggtttcaccatgttggccaggatggtcttgaactcctgacctcaggtgatccgcacacctctgcctcctaaagtgcggggattacagatgtaagccatcatgccgcaccccacaggttgtttctaatgcatgggtaactaacctgatttctctatatgaatttatatttgtgtccttttcacttgttaaataattctgtcttgttctttaggttcatgggtgtatgtgttcatcaaggacaattgcatgcacttacagaggtaagacatcagtaagtgttgaagtaacgtatttgccttagtttcagcatttatagttccatagtaagtgttgcttgcatatgtaaacaaaatgtatgtgcatttatgtttatgcaaaaatggcagtgttaataatgctttattctgttgcctgggaacaatggcagtatttctttatatatatatatatatatatatatacacacacacacacatacactttaagttctggggtacatgtgcagaatgggcagtatttcttaatgtccttctattccctcataatacttggtgaatactctgacaatatgagtgctcaagtattaaagtattaagttagctcttgctgcctagatatgactccatcctaagccaagggatgacagcacttgactgcaaactctctatggcaacaaattaccagaccacctggtaatgtttgctgtcctgatctagaattccacagtccctgctgtggtttcctggttggtcttattacttgttggaatcagtttacatcttcattctcgtttcatttccagcctctgctaggcggaatatgtgatagtcattattcatcctccgaggatcagagaactctctttagagccaattcaggtaccaagttatcaacttcagaccttgcttgggtgctccttggaaacacagattcctggaatcttctaggtttaataggtttgtatagggcctattacatctatatttttaaaagctcctcagattatttcatgagcatctggatttgagaatctatgttctagattcttttcacattcctccttgagaagcaattaccaaagtacaaagtgaagaaacttaggaaggaaagttgtttaacagaatttgcaagagtgttggttttttactggcttggtaactggtattagtccttaatagcttatgaaagagggtcccatgtgcctcagtctctctcttttctcagttactgaaggcactagaatgtggaatgtgtgcagctatgccctgcctcttaaatggaaagccaaagaagacagaatggtgaagaggttaagagcatggcctctgaagtcttgattacatacgtttgaatctgtctgtatctcaaagtttccatctgtataatggggataataataattaataatacctgccccagggagtttagatagagaagatgaccaagagctgagccctagaatatttgggagtctgaggtgagaggattacctaagaccaggatttcgagaccagcctgggcaacatagcaaggctctgtctctacaaaaaaaaaaaaaaaaaaaaaaaaaaaaaaaaattaataattagctggatgtgatggcatgtacctgtagtcctatttactcaggagtctggggcagcaagattgcttgagcccaggagtttgaggctatagtgagccatgattgtgccactgcactccagcctgggcaacagagtgagaccctgtctctagatacatagatagatagatagatagatagatagatagatagatagacagatagatagatagatagatagatacgtacgtacatacatacatacatacatacatacatacatagagtgagaccctgtcgatagatagatagatgaatgaatgaatgaaagtctggggagaaggacagactgagaaggagcagttagtgaggtaggtagaaaaccagaagaacgtgctggcctgtaatgaaaaggaaagagtttcaaggaaggagtattaattgtggcaaatgctgttgatataatgttgacctcacaaggatgttgggaggatgaaatataaaatacttatttagtacagtgcctggcatgtataaattatttaatacatgttaactctttgaacaaaataacagtgactagtccctcttctgaactctgaattgttaatatttttcattttgtacttagtcctataccgctgttagtgtcattaaattagactttttactgaagtataacatatcagaaaaagtatacatatgaaaagtaccactcacaaaatttttacaaatgaacacacccataaccagcaccccagatcaagaaacatttgccatgtattttttttcttggaagtgagtctataaattcttcagagataaaattctccccttccttctgtctaccagagttctgacgctaacaagcataaaagtatttgatgcattccctgcatgtgtgattgttctctgaaatgtgaattcattggaagggctggtgtgttaattttgccgacagagaagaacatcctttaaaatctgtgttaagttgcatattttaaagcaggttgtggtggaaatgacagtaatgagtgatcataatgcaatattctcttggccatgttgtacttaatctgctgcttgttagcttctttatagccatataaaacatacaatgtgtactttatggaagagtatttattgccagtctttccagcagcattaatgagattttgacatagcttatgatattagtaatttttaatatgatgttaatagactggtagtgatgaagcccaaatagccaaatgctcttggttatttttagaagggatcagcaaaggccttgatggcataggtctttcgagacttctaggtttaattgccttataatttgacttggcagcacaactatatggtaaggataataaaaaataaattattaaaaatatctagcacagtccttgaaacttagatgacattcaccaaatacttttcagttggtggaatgcttgtcctccaaagtaatgtgagtaccattcttcatttctcttcacatttatttgtcaataattacagtagacaagcatggcactcattaatacctataaaacattgacattattaggaagaatatttcccatatacattagtgatctggactttcctgggcttgaaccatttccatgagtcttctttgtaattgtagacattaattgaacttggaacagtcagacacttagtttttatttttaaactacctgtagtaatgatagactaaagattttttttttggggggacggagtttcactcttgttgcccaggctggagtgcaatggcccgatctcagctcactgcaatccacctcccagattcaagcaattctcctgcctcagcctcctgagtagctgggattacaggcatgcgccaccatgaccggctaattttgtatttttagtagagacggggtttctccatgttggtcaggctggtcttgaactcctgacctcaggtgatccgcctgccttggcctcccaaagtgctgggattacaggtgtgagccaccgcgcccggccagctgactcaagtttttaagcaaactagtatttgttaaagtgaaagcatagtctgggcatggtagttcacgcctgtaatcccaacacttccagaggccaaggtgggcagattgcttgagctcagaaatttgagaccagcctgggcaacatggcaaaagcctgtctctacaaaaaatacaaaaattagtcaggtgtggtagcatgcacctgtagtcccagctattggagaggctgaggtaggaggatcacctgagcccaggaggttgaggctgcagtgagccatacttgcactactgtattccagccttggtgacagagcaagaccctgtttcaaaaaatatatagtgaaaacggtttggtgaaaagtcacatgaaaccttttaaatttaatgagttgaaatatgaatctgtattgaggctgggtgcagtggctcatgcctataatcccaacacttttaggaggtagaggcagaaggattgcctgaggccatgattttgaaaccagccttggcaacatagtgagacccagactctacaaaaaattaaaaaaatcagccagatgtggtgatacacacctacagtctcagctacttgggaggctgagacaggatgattgcttgagcccaggaggttgaaggttgagaatgcaatgagccatgattgtaccactgcacttcagcctgagcaacagagagagacctcttaaaaaaaaaaaaaaaaaaaaaaaagaataggaatgtaccataagtatgtctttcattcacaagacctaaccttgtctttcacttagtcacaagtatcagggaagtgtaaatctttgttttttttttaacagaaaatataattctgtgtattggttagctgttgccctccagccacaaaacctcaaaagcatacaataaacgtttatttctcatacatttccagagttagctgaactgagtggggctagatttggcagttgtgctgatctcaggctcactcatgcatctgcaggtcagctggtggtctgctctaggctgaaatttgctgggagaactttgctctggctcatcctccttctggggccagtgggctagactggacttgtcctttttaagatgataccagaatagcaagaatatgacagtccatttgcacaactgattttcatgactctccttatgttcagatttgcttggccaacatcccattggacaaagcaagtcacatgcttgagtccaggggtaggaagtatgctctgcccttatcaggaatatgccgcaaagttatgtgtcaaaaggcacagattcagtagaaggcgaagaattggaacctttgacaatcaaccatgccctgtaaatatcccagtcagcagatcataagtatttgtgttttctgccccattggagagtaaagaatttctcccatttcttaaaccataacaactattagttatttaaactcccactatgggcagaatgctatggttgatactgtatattaactataattctcacaatgctataatcttatttcttccattttgtagatgagaaaactaaagcttagagaaattaagttacttccccaaagtaggattgcatccaggttcatctgacttcaaagtctatttctattacaacatgctgtgcttaattgatttttatattccccacggtgctaagcacaagatcttatgtgtgtagcatgcatagtatttgtagaattcaattctgactcactttttatgtattctgggttatttggaaaagatactttcttcctggtcattgggtgtattagaatgtgtttgggagcaagtaacagaaaatagttaaatgggctttaaacaacaaaaggactcatataactggaattttagcagtttattagattaagtattgatataattcaatggttaaattgacgctgtccagagaccttattctttctctttgctctgtctttatgttgtcagtttcatcctaaaataaagatgtctgtcactcataatcaaaaagtagctgccaaaaacttacatggtatatgttttctcttctatagccaagatgagtgggaggttgggatggagaggagaggaagaaagagagaagagaaagagatgcctctggatagattgtatgtcatctcaaagcgctttttccttttaatattgttaagaaaggcacagagaaggaaataccgtcaaaatcaagcagtttgggaacctgttagtgcagaaactctcagtggctagaagattggggaactgggtaaggtatatggttgtggagagggttcacaaatggcagtactctctgatcaggagagtcagcaattgaattgcttggtgagcaggatgttttgggggtctctcttgccttttctgccatgaagaaaactatccagccaggtgcagtggctcatgcctgtaatcccaacactttgggaggccgaggcgggtggatcacctgaggccaggagtttgagaccagcctggccaacatggtgaaactccgtctctataaaaaatacaaaaattagccaggcatgggtggcacaagcccatggtcccagttactccggaggctgaggcaggagaatcacttgaacctgggaggtggaggttgcagtgagccgagatcatgccactacactctagccaacagagctctaggcaacagagcgagactctgcctaaaaaaaaaatttaaaaaaaaataaactattcttattttcttctgtggcgatgagaaccactcagccaattctgcagttgcagaatattccttggcctagtcgaggtgattcggtctttttacaacagagccatctcagtcgagcagatgtttggtactgaaagaaatgcttttagctaaaggctattgcagagagtttgttattcacatagctctgatcctcctgtcactccctattcccacccaaccatacatcttctttctttattaaagagtattagtgactttggaaatttcttgtttatgcgggttgatatgtattgcttctgagttggttttgtcagacttataagaagccttatataatcagacagcttacaatgaaactccatgggttcagtgaccaaactcatgcgttatttataaaaatgagcaagccaaggccatgtccagtggcttcacacctgtgaccccagcactttgggaggttgagaggcaggaggattatatgaggccaggcgttcaagaccagcctaggcagcatagtgagaccttatctctacaaaaaaatttaaaaattagccaggcatgatagtttgtgcctgtggtcccagctactcctgctgaggcagaaggattacttgagcccaggagggcaaggcttcaatgagctaggattctgccactgcaccccagcctgcacaacaaagtgagaccccatctcaaagaaaggaaaagtgagcaaggcagaccctgattccagtttttttggtgtgctgtgatatgtgatattgttattagttgtgcctgcttcttatttttttgtgtgtttcagtacagaatattttcctatccttatttaccatgataaagatgtgaagttgcttggtgccctgccttgggttaactttggcagcaaaggcatacctatctttcaagtttgggactggcagctgttaaccaccacatggtagtttagagacacaccagaggtactaacagtgattgcatctgtgattcaggttttcctaaaaggacaagtgagggggaaacgacaaagatgtaaattagaaaatacacgggaaggtagagattcacttgatacacaccattttgagtgaatctactatgggctaggtactttgctaggctttaggtttaggataaaaagacatctgctcccatgatctattgttacataacaagctaccccaaaacttagtggctttctaattttagtttgcttgtgattttgtaggtcaggtatgcagaagggctttcctggatctttgatccatatgtgtcagctggagtgactgagctggcaaatccatttccaagatggcttcttcatttgcatatctggtgccatggtactccttggttcttctctttttccacatggtgtctcattctttagatcatctccatatggcttaggcttcccacagcatggtgatctcaggatagttagactggtacaaaccactcaagtggaagctgcaagccttttatgacctagccttgcaagttccagaatgtcccttaagctgcattttattggtcaagcaagtcactaaggccatctgtcaatgaccatctttagttcactggagtgtctttcatgaactcaatggttaatggctgggatagtgagaaaattcttactgtgcccttccttagaaactgttttttaaaaatctgttatcccatgctgttaactctcagatctctctgtatattaatagttgttactcattatagttcattttctttttttccactcagttattttgctagtgtttgcagtacagcttagcttggttaccttccccaaactggccatccattccaaccttatcatttcatttctttattttttgagatggagtcttgctctgtcacccaggctggagtgcagtggcaccatctcagctcactgcaacctccacctcccaggttcaagagattctcctgctttagcctcccaagtggctgggactacaggcgcacaccaccacacccagctaatttttgtatttttaatagagacatgttttcaccatgttggccatgctggtctcaaactcctgacctcgtgatccgcccacctcggcctcccaaagtgttggaattacaggtgtgagccactgtgcccggcccttatcattattagaatccttgttcttggccgggcacagtggctcacacctgtaatcccagcactttgggaggccaaggtgggcagattacctgaggtcaggagttcgagaccagcctggccaacatggtgaaaccctgtctctactaaaaatacaaaaattagctgggcatggtggcacatgcttgtaatcccagctactcgggaggctaaggcaggagaatcacttgagcctgggaggcagaggtggcagtgagccgggatcgcaccactgcactccagcctggcaaacagagcaagactgtctcaaaaaaaaaaaaaaaaaatccttgttctcttattagaatcctttgttctttggggttagttttgattttttctcatcacttgaatttaatcggtccgccgtcttttcctattttcttctttgtgatatctttctgattatttttctttctcttcattccaaagccataatattatttcatgcctcaattcctacaaatactttttttttttcttaagagacaaggtcttgctgctctgtcacctaagatggaatacagtggcaccatcatagctcactgcagcctcaaacccttgggctcaaatgatcctcctgtctcagcctccccattagctggaactacaggtgcatgccaccacacccagctaatttttacattttttgtagagatggagtctcactatatcacccaggctggtctcgaactcctgaccttaagggatcctcccacctgggcctcccagagtgctgggattacaggtgtgagctatcacacctgacctgttttcttcattttgacatactactatctgaataatcatcatcaagcacacctgataatgtgatgcttctgtctaaaaaattatgtttcctattctaaattctctctaatctcgtttgataatacgaatccctcccttagttacatgggtctttttgctctcttctatacattcttgctttaggtgtcccttccagtactaggaatgtccttatctctcttctctccaagctgtgtcaaatcccaggttctctaatggaactaagtctcctagatagagcttataataatactctgtgtggctgggcccatagtatatgcttagtgtgtgtttgtagttgatggtctagtgtagacccaactctaagaaagctgaattagccctagcggaaagagccagaaatcaaaaatagtgtgaaggccaggcacagtggctcacgcctgtaatcctagcactttgggaggccaaggcagatggataacttgaggtcaggagtacaagaccagcctggccaacatggtgaaaccctgtctctactaaaaaaaaaaaaaaaattagccagacgtggtggcgggggcctgtaatcccagctacttgagaggctgaggcaggagaattgcttcatccctggaggcagaggctacaaagccgaaatcacaccactatgctctatcctgggtgacagagtgagactctgtctcaaaaaaaaaaaaaaaaaaaaaagagagagaaagaaatgtcacatctcaaatcctttcataattagaagtttatttcacttaaacttctatgtgcaaaaaatatttctacaaatacagtttgacatgtactttgcttttggaaaaagtaatttttatttaatttttttgctttgctcatttagtaataaaaaactctcaaactgtggtacatttctgttcttatttttagtaactccctgtgacatttgagaaacaagaatttgaggttggcaagctagcccacaaataatagaagagtttatttagtttactttatccttaaaacagtttttctctgacttgcttgcttgcttttggctcatttattcatccaaaagatatttatttggctcctaccatgtctggcactattccaggtactgggaatacaataatgaacaaataaaaatccctgtcccacgttttaattttttttaagtttaactttattttatattttttatttttggtagtgacatgggtcttgctgtgttgcccaggctggtcctgggctcaagtgatcctcccaccttggcctctcaaagcactgggactacaggcatgagccactgtacccagctggaatttatattttaatcagcagggggcgggcagaggagttaaactaaacaagggaacaaattgtaatatatgtgatgttaagtgctaggtggtttacaattttcaacatgtagacagggaaggcctcataaaagaggctaaaatttaagaaggtgggctgggtgcagtggctcacaaaaaaaaaaaaaaaagggtgaaggaactagctgtgtggatatcaaagtgttctaggtagttggaatagtatatgcaaaggcgtggaggcagaagtgtgcctggtctggttgaataactccaaggtgggtgatgtgactgcagtggagagcatgaagagaacagtagtagatggggtcagagaggaaacactggctagatcagagtctcatatatactgctgtaagaactttagattttactcaggataaattgtgaagtctttggaggtttttgtgacttattctttaatgggatcatcctggctactgtttggtgaatgactgaaaaaagagaaagggtggaagcaggaaaaccagttaagagactgttacaataaagtctgtgcaatacataaagactgcaaaaaaggtgagagttaatggtaatggaccagaatgatagcagtggagctgggaattctggatccattttgaaagcagaagaaaaacaaacaaataggctttcctgatgcattggctgtggggtatgagaggatgagagaagtcaaggataactctgaggtttttggcctgaacacctaaaaaatagagttgccattaatggagatgggaagactataggaggtacacaatgggagatgatcaagaggtcatttttgaataggttcagtttgagatatttattggacattcgagttgagatatcttcatagagtactggtgtctgaaggagtactctgagtgataccttccttgttcatatcctgtttatcaacattttcattagagagtgtttcattgatttggaaggaggcatttttcaactgctgtattatctcctgagtaacaaaaataaaaaaatcattcagtgatttttcatactaaatgttttctatgtgccagggtctgctaagctttttttttctccctctcaatatattatttaattagcatgcaatcctatgaaataggtaatatttttcccattttacagatgacaaatctgaggctcagaaagagattaagttagctaaggtcttgtagctgagctaggatttaaatcaagttttggctgactataatcctgtacttactagtctttgagctccttgggcttggctattgttcactgctgaattgtcagtaactggagcataaaggcatgcaataaatatttgttgggtaaatggaaaatggataaataagtactgctcccaacacttgagcttttaacagttaaactgttagctgcaaagatatctgcctctttcaaggtcatttcagccatccatttgatgaatctttttacagcattggtagtatgaggacagcagaaggatttagaaagttcttcagaggatttctagctaatctttctcctaatcccctcatgattgttaaactagtgtgacacttgaattcacagagttctttttgagtttaggctagatatgtttctaatagatttgccaagtgtaattttcctaacttgataagtggtatcattcccaggagttggttctatgttggctcctgggagctgttccaactttggaatctgtagcaagtaggaccatggaaggagggtctcccaatatacctctcacacattgctactactcaggggcatttctgcatccctgtgcctgatacataatcactgtctgcactttctgtatttactttctctttctctttatgtggtcttttcttgttatcctggtcaccattatttgcttagataataaattcttagatcagtgttttccagagtcagtcataggcatttatttccttacttgctcattttagctcatttcaatgcaattgcttgtgtctgtttcctatttaacaaataattattaagcaggtactgtgtcaatggctagtttagtgaacttcaaaaaatgagaagttgttctatcatagtggcagaatgattgtctaaaatcttctgtaatactaggcacaagtagctgctcaatgaatgtttgttaaatgaattaataacttgcaaaagtattaatatagtgaatggctcttctacaaatgatagtttccttttcctttatccctaatctatcccttttccaaatcttaccaatcaccatgtcctgttcatcttacctctttactattcttgaatcatttatcttacatcattccttctgccatcattatgtcttgccataaccttttaactagtctctttgtcagtcttgttccacactttaaatctatagtctctattgccagctggagtggtcctgaaatacaaatctttttttgttgttttgaatcatcttagccatttttaaatatatagttcagcagttagtattaagtattatcacgttgttgtgcaacagatctccagacctttttcttttctttttttttttttttttttgagacggagattcgctcttgttgcccaggctggagtgcaatggcgtgatctcggctcaccgcaacctccgcctcccaggttcgagcaattctcctgcctcagcctcccaagtagctgggattacaggcatgcaccactacgcccagctaattttgtatttttagtagagatggggtttctccatgttgaggctggtctcgaactccagatgatccacccgtctcagcctcccaaagtgctgggattacaggcatgaaccaccgtgcctggccttcttttctttttttttttaagaaagaagcagagtcttgctctgttgcccagactagagttcatagtgcattacagccgcaaattcttgggctcaagcagtcctcctgccttagcctcccacgtaatagggacagtagctactgtaccaggccagatcttgttttgttgttgttgttgttgagacagtctcgctctgtcacccaggctggagtgcagtggcacgatcttggctcactgcaacctctgcctcctgggttcaagcgattctcctgcctcagcctctcgagtagctgggattacaggcatgcaccaccacacccggctaattttttgtatttttagtggaaacagagtttcaccatgttgcgcaggctggtcttgaactcctgagctcaggtgatctgcctgcctcggcctcccaaagtgctgggattacaggcttgagccactgtgcctggctgccagatctttttcatctttttttttttaattgttattttttcaaaaataagatgggtctcactccatcacccaggctggaatgcagtgggatgatcatggcttactgcagccttgatctcccaagctcaagtgattctcctgtctcagcctttcgagtagctgatactacaggcgtgtgccaccacatctggctaattttttattttttgtaaatatgaggtctcgctaagttgcccaggctggtctcaaactcctgggctcaagcaatcctctcaccttgttctaaagtgctgggagtatagaagtgagccactatggctggcctttttcatcttgtgaaacaaactctatacccattaaacaacaactactcatttctccctcttcccagctcctggtaacaaccattctattttctttttacttttgagacaggatctcgctgtcacccaggctggagtgcaatggtgtaatctcggctgcctgcaacctccacctcccaggctcaagggattctcccacctcagcctcccaagtagctgggactacaggcgtgcatcaccatgcccagctaatttttttttggtattttttgtagagatggggtttcaccatgttgcccaggctggtctcgaactcctgagctcaggcaattcgcccacctcagcctcctaaagtgctgggattacaggcgtgagccaccacacccagcctgtactttcagtttctatgaatttgactacttttgatacctcatataagtggaatcatatggtatttgtcttttggggatcacattatttcacttagtataatatccacaaggttcatccatgttgttgcatgtgatagtattttcttcctttttatggctgcataaatattttattgtatgtatataccatactttgttgatccattcatgggttgatgaacatttgggttgctttcacctcttggctagtgtaaattatgctgctatgaacatgggtatgcaaatatctctttgaaaccttactttccagacttttgggtacatacccagaagtaggattgctggaccatatagtagttctatttttaactttttgaggaactgccatattttttttctgtagcagttgcaccattttacaatccattgatggtgcataagggttccagtttctccacatcctcaccaatacttgttattttctgtgttttttttttttgatagtagctatcttaatggatgtgaggtgatatctcattgtggtttgatttgcatttctcatttgttgcaaagactgtcctttcccagttgataggtgtttatttctgggctctctattccattacattggtctatatgtctgtttttatgccagtaccacttttgaatacacatctaattttgtttctccctgaaaaaacccttctgtggctcctcattgtcctcagggtaaagtcaaaactgatcttgctactgcttatctctatggcctcactcctcacttctcttgcctctctattcctgtctcaactgtgtgctacagctgtactgaacctctttcagttccacaaatggaacatgaccctttccacctttagagctctgcaccagactttttctttgcccagaacacacctcttcatcccccctggcccaaccaattcctcaggccccagcttagaattcattttctctgggaagccttttctgatcttccaagagtagtttggtacccctcctatgtgctctcataatacaatataatttatcattgatttcaactgactgtttgtatgtgtagattataaattccttgagggcaacgattgttttatttacattgacatccactggttcctagcacagtgcctgacaaatggtagctgcttatcatatttgttgattgaataaataaattaacaatcaatggcatttcctggctcagaaaccttcagtgatttcctcattgattaaagtcttaggtgagatgcagatatctgtatttaaaaataaataaataaagttctacaaattattttgattcacagctagagtttaaaaatggaattcaggataaactcagcctgatatcctagtcctttatgccctactataatactacttttctcctagttctcctcttctttaacaagtactctataattcaggcaaactggatttcttattgtttactgaacatggtctgtgttttcctgcctctttatccatatggtttcttcaacctagaatatgctctttccctctgtcctatagaaatcatcttccctggctggacgcggtggctgacgcctgtaatcccagcactttgggaggtcaaggtgggtggatcatgaggtcaggagttcgagaccagcctggccaacatggtgaaacccccatctctactaaaaatacaaaaattagctgggtgtgatggtgcgcacctttaatcccagctactggggaggttgaggcaggagaattgcttgaacccaggaggtggaggttgcagtgagctgagattgtaccgctgcactccagcctgggtgatagagcaagactccatctcaaaaaaaaaaaaagaaaaattatcttaccttcaagacctggcctcagagtccgcttatttccccataaaacctttcctgattctttttctcggccgcatcctctctgcccgcctccactgccaccactcatttgatcataatgtttccctccattcatcttctcctatatagaatttttgtacctttgttattacacattctttcttttctttccttttatttatttatttatttagagatggagtttcacttttgttgcccaggctggagtgcagtggtgcaatctcggctaactgcaacctccaccttctggtttcaagtgattctcctgcctcagcctcctgggattacaggtgcccaccaccatgcccagctaattttgttgtatttttagtagagacggggtttcacaatgttggccaggctggtcttgaactcttgacctcgtgatccacctgccttggcctcccaaagtgctgagattacaggcgtgagccactgcactcagccccattctttcatttattaaagctttttttgctttagcttccctacataaatgtacactcctagggtagaagaaacccaggcttttaggtcacaaggcttggatacaaatccaagctgtactatttactagttgaataatcataggcaagttatttaagttctctgggccagcctggtggctcatacccataatcccagcactttgggaggccgaggcaggtggatcacttaaggtcaggagttcaagaccagcctgaccaacatggtgaaaccccatctccactaaaaacacacacacaaaaattagccaggcatggtggcgcacacctgtaattccagcttcttgggaggctgaggcaggagaattgcttgaacccaggaggtggaggttgcagtgagccaagatggcgccattgcactccagcctgggcaacaagaacaaaactccatctcaaaaaacaaacaaacaaaaaccagccaggtgcagtggctcacacctgggcaacaagagcaaaactccgtctcaaaaaacaaacaaccaaccagccgggtgcggtggctcatgcctgtaatctcagcactttgggaggccgaggcaggtggatcacctgaggtcaggagttcgagaccagcctgaccaataaggtgaaacctcgtctctactaaaaaatacaaaaattagccgggcgtggtggcaggcgcctgtagtcccaggtactcgggaggctgagacaggagaattgcttgaacccagaggcggaggttgcagtgagctgagattgcgccactgcagcccagcctgggcaatggagcgggactccgtctgaaaaacaaaacaaaagaaaaccaaaaaaaacaaaaaacacacacaaaaaaacaaaaacaaaaagatgacaagaatgtttcaagatattacaatggtcaggccgggtgtggtggctcacacctgtaatcccagcacttcgggaggccaagatgggtggatcacctgaagtcaggagttcaagaccagcctggccaacatggtgaaacccatctctattaaatatacaaaaaattagccgggtgtggtggcaggcgcctgtaatcccagctactcgggaggctgaggcaggagaatcatttgaacccaggaggcggaggttgcagtgagccaagatcgcgccattgcactccagcctgggcaacaagagtgaaactccatctcaaaaaaaaaaaaaaaaatttcaatggtcaaatgaggtaactatgaaagtgctttgccaggcatggtggcttacgcctgtaatcccagcactttgagaggctgaggtgggtagatcacctgaggtcaggagttcgagaccagcctggccaacatggtgaaaccccgtctctactaaaaatacaaaaaattagctgggcgtggtgggaggcacctgtaatcccagctactcgggaggctgaggcaggagaattgcttgaacctgggaggcagaggttgcagtgagccaagatcactccattgcactgcagcctgggcaacaagagagaaactccatctcaaaaaaaaaaaaaaaaaatgctttgtgaccagatgcagtggctcacgcctgtaatccctacactttgggaggccgaggcaggtggatcacctgaggtcaggatttggatagcaacctgacaaacatggtgaaaccctatctctactaaaaatacaacaattagccaggcatggtggcacatgcctgtaatcccagctacttgggagactgaggcaagagaattgcttgaacccggagtcaacagagactccatctcaaaaaaaaaaaaaaaggagaacgaggaaccaaatgatgcccagtttctaggtgggtggcgatgccgtttactgagatgtagaaaacttggagggtgcagctggaatacttccttctttcagctgtgtatgcattacttgggaattggtttttttgaatataacactaatcaacatggtctcctcaatgtagaagatcagactcagtcttttgcctgagcctttctttgtctgagtaggcattattaaacattttattttattttattttattttatttattttttgagactaggtctggctctaatgcccaggctggggtgcagtgttgcaatgttggctcactgcagcctctgcctcctcagctcaagccatcctcccacctcagcctcctgagtagctgagactacaggcatgcaccactatgcccagctaatttttgtattttttgcagagacaaggttttgccatgttacccaggctggtctcgaactcgtgagctcaagcaatctgcccaccttggcctccaaaagtgctgggattacaggcatgagcctctgcgcccagccagcattattaaatatttgtttttgcatgatatttattggaaagttcctctaaaagcacatttctcttttatatcttaaattacattttaatgattaaattgaggggtggggcttccaataaaagagggaacttaaaacccacctccatttatttaaatgcacttaattatgtatttgtttgttcaacaatttcactgagttttacaaaggggcttacaaaattgagcaggacctagttcctgccataaatgttatagtacagtgtgatgaacaatagtagaaacatgtgcaggatgctaaagtggcaccaagaatgggctcgaactcctgggctcaagcaatactcctgcctcagcctcccaaagtactgggattacaggtgtgagctactgtgcccagcctagcactaagaatgggatggagtatcaaggaatgctttccatgagttcagaaggatgaataagtggctggccgtggtggctcacacctgtaatcccaacactttgggaggcttaagcggtcagatcacttgaggtcaggagtttgagaccagctggccaacatgttgaaactccgtctctgctaaaaataccaaaaattagccaggtctggtggtccatgcctgtaatcccagttactcaggaggctgatgcaggagaattgcttaaaccctggaggtggaggttgcagtgagctgggatcacgccactgcactccagcctgggtgacaaataaataaataagggccagtgtggtggttcatgcttgtaatcccagcactttgggaggtcgaggcaggcggatcacctgaggtcaggagtttgagaccagcctggccaacatggtgaaaccccgtctctactaaaaatacaaaattaggctgggtgcagtggctcatgcctgtaatcccagcactttgggaggccaaggtaggtggatcacaaggtcaggagttcaaaaccagcctgaccaacatggtgaaaccccatctctactaaaaatacaaaaattagccaggtgtggtggcacacgcctgtaatcccagctactcaggaggctgaggcagaattgcttgaacccgggaggcagaggttgcagtgagctgagattacgccactgcactgcagcctgggcaacagagtgagactctgtctcaaaaaaaaaaaaaaaaaaagccgggcgtggtggtgcacgcctgtaatcccagctactcaggaggcagaggcaggagaatcacttgaacgcaagaggaggaggttgcaacgagctgagatcatgccattgtgctccagcctgggcaacgagggaaactttatctcaaaataataataataaaaaaaatgaaaataaataaacaaggaggatgaataagaattagcaaagctatgaagaagggtattcagcaagcatatatgaaggccaagagttaaacacttaaatattctgaaatatattttgggttattaacaacgttttactctgtggctagaactagtgttccctttttctttttgagtcagctcattactactgactgtttcagtcaggcaggccctggtgaacctcctggagcggtaggcaaattcagtccttggcagatatacggatgtacgcttgtagtggctgtggatcctcgagctgagaacaggaggcttctttggagcacaagcctcccacagggcactcttgggatgtctgttctggaattacccagagcagtaacaaagctttcttttcttccttaacccaagccagcaggatgggatgtcggctagcctttgtgtttggagcctaccaacaaacatacggtggccagcacaaaagtattgttgggctacagtgaaaactaggtcggggcccaaacccttttctgcaaagagcccctccaaagagtagagtgccaacaagccactaatttggctgtttgacattgatactggtttctgacaggtttctgacttactgatggcacattgagtcatttaagattctgaaatctttttccattgctgtctgaacctttcaatttggaatctctgagatgtctttgactctttttccttatttctcatatctatcactcagttgctaaaaagctttatattctgactatagccaactttttcttgcccataaatagcactgttagttagatgtttggtcacctctcatctggctgttgcagtaccctccaaaactgcctctaattccttctctatcctgctaccagaatgatctttctaaaatgcagtttgggtcatgtattagtttcttagagctgccatagcaaagcactacaatgtgggtgacatagcagaaacttattatctcagagttctgaaggctggaagtccaaaatcaaagtgttggtagggccttgttctctctgaaggctctacgggaagatccttcttgccttttcctagcttctggtaggtttttggtgttctttggcttgtagatgtctcagtccaatttctgcctctatcttaacatgacattttccctgtgtgcctatatctcttgccactctttttataaggattccagtcgtattggattaagggcctgccctactccaatgtgacctcatcttaacttgattacattggcaaagaccctatttccaaataaggtcacatttatagttaccttaccagggtttaggacttgcatgcatcttttggggggatgtaattcaacccccattagatcatattatacctttacctataaaccttcagtggcccctgtggtctgctgaattaactgtagatgcttcatcttggtattccagaacttctgcactaataacaaatataataataataatagaaatagtcataactgacatattgagcactttccttgacattattcttagcattttacatgtatcaacttactgaatcttcacaacaactctgtgggttaggcactattattattcccattttatagatgtgtattaaacaaactgagtaaccaactcagggctctacaactattatagtctgagatgagattcaatcctagccagcctaactgcagtcaccactatattatactgcccatcttaactttttagcttcatactttctcccctacttatacagaaaaaaaaaaaagaataattactaatctctgtgctttgttatctttgtgttccttttgcatagactgtctttcttatccccaaccctgcctatgggttaccatgaaatggaattaaatcctcaacaatgagtgaatattagccaggcctaggtggggaaaggggaaggatattagaggtaaagggaccagcaatgtgtacaaatgtgcaggtgagcaggagtcagacttttataagcaggagtgaaaggctttgtgtgcctttctaaggattgtgggttttatcctacaagtaatagcacatcactgaataattttaacaggagagtggcttcaggttggcatttcagaaagattgtcttggctatattgtggaaaatggattggaatgagggctaaatcttttcaagatgcaaaagggggcaagaaaacaggttagaaagctaatggaataacctaagggaggcgtgagaatgataagttattgatagtgggttctacctgttgtaaaaaatgaaaataaattttaaaaagatactgttaaatgggagaatgagttgtgtactatgagctaaacaccaaactggactgactttgtatttagaccttatctctttaattactccttgcctttgaacaaacaccaaatcttgctgattctacctctaatgtctctgagataataacctcctttccattcttgctgccattgtcttattcaggccttggttatcctaactcttctcccagcctcagttcctgaccttttcatacaatttttatactactgttagaatatttctatgtagcatatctgatcatgttattctcctgtgtgaaaaaaaaaaagtgttagttgattgtatggcatccctactagaccatctaggctagactagtctctgtgggcagagactggccccatttatctttgtgtttcacattgtaggttttcagtgtttgggtaggtgaacagaaggatggatgaatctttctcagtaccatgttgctaattagatggtagcaaattatctctgctagttagatgacagcacagttatcttctttgggtaaatgccctaactcctggccagttgggtagatttttcaaaaaggaataataattcttagagttgatattttctccagaccttctctgaatgcctttgaaccactgttcagagataagcttatttggttgcaggtatcagtacactggtaattcaaatttttttaaaactaccattttgtcttattgttctgaatagttataattggttgaaactactgtagctgactagaatcagcaagaattgggaactggagtcctgggtgcatttacctcagagagaggtacatattccctagagccagtccagaatattctctgtatggatatgtttatgtgcttgtctgtgcctgaattggtacctaccagaccctatagggatatgtgggaagaacctatactctttagcctaggcagttgtcttagtccatttatgctgctataagaatatatcatagactgggtagcttataaacaacaaaaatttatttctcacacttctggaggctgggcaatctaagatctaggcacaggcagattcagtgtttggtgagggcctacttcatggttcataaatgcctgtctttttgttgtgtccttacatagtggaagggactaaagaactatggggacacttgtacacacattctctatcgtggtaaaatacatataacatataatttaccatcttttttttgagtgggggtcttgctatgttgcccaggctggtcttgagctcctggcctcaagcgatcctcccacatcagcttctcaaagtgctgggattacaggcgagagccactgtgcctggccaagagacaagttcttactctcatatggaagtggcagtagggggaggagtgctcaataaatgtttgtagaaataacctgaattgatattcctgagtggagaactgagtgtccacttctctgtgcctttggtgattttaaaaaagatgttggcatatgatttcttgcattttagtaataaaggtttatttacataatatagttgaattaccaatacactttagaaagttattgagtgccttctaggaaaaggctgtatatatttaatgaaaccaagtatcaaacacaaatgaaatggaagaaactctgttattttattagaccgtgaggaagtgaggcaagttttggtataggtaaagttggtatagaaaaaggtaacagccactgagaggtattgaagtatctataacacattttattgactgtattatagttttctaacttgaaaggttaaaataacaacaattaaaaatattaaaacttctgtattaattaaatgtattaccaatgccttgggtcattttatagggctgaccgagggagtagtctagctgaaaatgaaagcaaagcagctgttatccccatccgggaaagctgaacatgctaatgcagttgctcttgtctctgcttcctgcagagggatttgtttagaggccacaccagctgagtctgcactgggagttgcttatggagaagtgaacattccagctaatgggcacagagaccgtgtagcaatcttctggctgggtgcggtagctcacgcctgtaatcctagcactttgggaggctgaggcgggtggatcacctgaggtcaggagttcgagacaagcctggccaacatgggaaaaccctgtctctactaaaaaatacaaaaattagctgggtgtggtgacacagcctgtaatcccagctacacgggaagctgaggctggagaatcacttgaacctgggaggtggaggttgcagtgagccgagatggcgccactgcactccagcctgagggacagagtgagactccgtctcaaaaaaaagaaagaaatcttccttgttgacaaatctcaaatttccttttcttatgcatgcagaggtcttgaaacattgagaagcggtttctgagggcctacaggcttatcagcccaactaatgtattcaccaaaggcaggcaagagaaatgggttgtaaaagcaaattccatttgttttccctctctggtccttggtttgcgctttttccagtttgcctggagaagccagaatctattagccaagtgtgattcctcatcttttgtcaccttttcctgtgctctccaccctctggctttgcatatggatttccagggccttcagagacactgctgaacagagtaaacaagtgtttcccagaaccaagagtcctggtgtcacctggcctatagagagtgcacatacagtcttttcattatagtgtcttctgcctggcactcagttgggaaacctgagtggctcctgaagacaggcccgacatatcacactgtcatcatgctaaagaagtgaaccactgcctaccttttgactttcagagctaaagaaatctgcctgcatgattagatgtcagcttcactgcccacttataaccctgaagttcacaagctcagtttcttttcagcaaatgggcacctcaaatgtgaatcttgggcagattcaactagaatgaagagagcaaggcgctgtgcttatgccgtcattatgccttattttaagattttcaaagatggattatcaagcaggatgaagcagatcaacaagtttcccttttgagaagttggaagatttatttttagtcattctttctgtcttgccaaaactggtccgacgcttccaaggatctgaagtgctgcatggtgctgcccccaactggttctttttggtgcttatattattaccacatcagaaaatatatgacatttaaatttttttcgaagcgctttcacatattttattttattattatttttttgagacagagtctcaccctgttgcccaggctggagtgcagtgatatgatctctgcccaccgcaacctctgcctccaaggttcaagtgattctcgtgcctcagcctcccaagtagctgggatcacagtcgtctgccaccatgccctgcttatttttgtatctttagtagagatggggtttcaccatgttggccagactggtctcgaactcctagcctcaggggatccacctgccttggcctcccaaagtgctaggaatacaggtgtgagccatctcgcctggccaacttttacatatttttttttcaagacagggtctcactctgttgcctaggctggagtgcagtggctcaatctcacttcactgcagcctccgcctcccgggttcaagtgattctcctgcctcagcctcccgagtagctgggattacaggcacccaccaccatgcccggctaatttttgtatttttagtagagatggggtttcactatgttggccaggctagtcttgaactcctgaccttaggtgatctgcccgccttggcctcccaaagtgctgagattacaggcgtgagccacggcgcctggccaactttcacatattttattagattctcataacaacactgcaaattaggtgaatcagggattatcatacctacttatagttgagaaaagtgaaagatggatagccttattagttgatttgtccaagttaaatggctattaggaggctgaattgggctagaattcagatatttctcctcttatcccattaagttccctagtcctttgtaaatgcaatggtacccaaaaatatgtattaagatataaattttaggcttagaggaatttccctctttttctcccttgggaggaggagggagataatacatcatataaggtttgagtaaattcatttttgagctcctgtgctgcatgaggctctcttactcagatgctgtggtctctaagtctccagtgcaacgtagtggtaaagagtatggactctggagccagactgcagagtctgccagtctctgccacttaataactggataactttaagcaagttgcttaatttctaaatgccttctctaaaatgagtaatagtatgtagtcattttgtagtccatagcacgatgattggattttcatgtgcatgtgtgaggtgtactaccctcaaaccttattaatgtctgcacgttgtctgacatgaaaaaaaaaaggaaaaaaagtaccagtgtacctaccttatagggttattgtgcagattaaatgagataatatatgcaaaactctcagaacagtgcctgaaacaatttagatactatataaataacagctgctattattatttataaatacatatacttactcacttttttttgagactgggtctctctctgttgcctaggctggaatctagtggcacaatcatggctcactacagccttgacctcctgaggttcaagtgatcatcccaacctcaacctgtgagtagctgtgactataggcacacaccaccacacccagctaatttttttttttttttgagatggagtctcgctctgttgcccaggctggagtgcagtggtacagtctcggctcactgcaagctccgcctcctgggttcatgccattctcctgcctcaacttcccgagtagctgggactacaggcgcctgcaaccacgcccggctaattttttgtatttttagtagagacggggattcagcatgttagctaggacggtctcgatctcctgacctcgtgatctgcccaccttggcctcccaaagtgctgggattacaggtgtgagccattgtgcccaggctttttttttttttttttttttttttagacggagtttcactccgtcacttgcccaggctggagtacaatggtgcaatctcggcttactgcaacctccatctcccgtgttcaagcgattctcctgcctcatcctctcgagtactgggattacacgcatgcgccaccatgcctggctaattttgtatttttagtagagacagggtttctccatgttggtcaggctggtctcgaactcccgacctcaggtaatccacctgccttggcctcccaaagtgctgggattacaggtgttagctactatgatcccacccctgggagctaccgtgcctggccaatttttgtattttttgtagggacgggattttgccactttccccaggctggtctcaaactcctgacctcaagtgatcctcccaccttggcctcctaccgtgcccagccttattcacttttttttctttttttttttttttactaaaaaagcaaagctgcccttcatgggtatttaggaatgatgaacagcaagactatcttcaaatagtttctccataaccttatctgctactctttcctctgttcacttcagtcttactcgtcttaaccactttactgaaactgctctgtccaaggttgccaatgatttcctggttgcaaattcagtggatacctttcaagctcgtcttcctcattcatggcttttgatactgtcagtcatttcctttgtagaatgctttccttctgacatgtagaatgtcattgtccttctgaacatacatacatacatacatacatttatttatttatttatttatttatttatttatttatttatttatgagatggagtttagctcttgttgcccaggctggagtgcaatggcacgatctcagctcactactacctctgcctcccgggttcaagtgattctcctgccttagcctcttgagtagctgggattacagacgcctgctaccatgctcagctaatttttttgtatttttaacagagacagagtttcaccatcttggccaggctggtcttgaactcctgatgtcaggtgatccacccgcctcggcctcccaaagtgctaggattacaggcatgagccattgcgcccggccgtccttctgaacatttagaatgttctcctattgacattcttgcctgttccttgggattctgttgatttcccatcttacatgttaaaccctgggcatgcatgaccttggaatgcatgactgcttcagctcaatgtttttgcctcctaaatattgtctttcacttagactttgttcttaagcttcaaactgactctatttagatcatttccaccttggttgtccaataagcacctgtacctttaataatttaacttctcccagctgaactcactatcttttttttttttttttttaagacagggtctcgctctgtctatcacccaggctggagtgcattggcatgatcttagctcactgcagcctcaacctcccaggctcaggcgatcttcccatgtagctaggactacatgtgtgcaccatcacgtccagctaattctgtttatttttgtagagactaagtctctcactatgctgttcaggccggtctgaactcctgagctcaagcgatcctctacctctcaaagttctaggattacaggcatgagtcaccacacctggcctgaactcactctcttttaacattgcctcttcttctaaaaacctactcctctccttgctctctgggtatttaaaaatgacatccagggaccaatagcctattgctctcattctctaatccaggcaattatcaagttttttttttttaattctgccatctaaatacattttgaatcttgccttgttccaatgcctccactattgccatgattcagatgccctgctctcaccaggattattgcagtaatctcctatttccctttctctgtatttttcactctaatccatctatcataccatggctaaaataatattttctttaaaaagcaaatataaccatgtggctctcctgcttaaaatgcttcttttgtttcctatagacaggataaagttcacatatcttagcaaaacatgtcagcctcacttcctgactcatctataaatgcactctggccatatcgaagtaaattaagttcctgaatgcatcatgcacttaacctgtaactttgcatatgctgctccctctgtgtctttcgtgctactttcctgctactccaggtcatcctttctgactccttatttcctctctgcatttcctctgacatgcctccacagtttagctttatccttgttgctgcatggtgttgtcctacctgcacataactatattttaatatttattatatgatattgtttgactatgtcccttaatagattgtgatctccttaaaggaaagtgtcattgtgtgcagcacctaccatagtgcttggaggcagaataagccctcagtaacttaaaaaaaaaatacagtctctctcttccaggtgtttactctctaatggtttcaccactagcctaaatatttctgataaatggtagctgggttttccttctgttttgcagtatatcaactccgggaacctggaacagttgctagacagtaacctgcatttgccttggactgtgagggtaaaactggcctatgacatagcagtgggcctcagctaccttcacttcaaaggcatttttcatcgggacctcacatctaaggtatgaaggctttactctcacaactcattgagagataccacccttctcttttgccaagaaagctgtgttagatttaacatttaatcacagaggacataattcattatattttatagttagtccttagaaagcctacatcttttccttctgtttttgaggcagtgtctcactctgttgcccaggctggagtgcttctgcctcctgggttcaacgactctcgtgcctcagtctcctgagtagctgggactagaagtgtatattaccacactcagctaatttttagtagaggcagaattttgccatattggccaggctggtcttgaactcctggctgcaaacaatccacccgccttggcctcccaaagtgctgggattacaggcgtgagtcactgtgccccaccataagcctatattttcttatagcaggttcctttcagtgctgagtgagccaacatatatatatatatatatatatatatatatatattttttttttttttttttttttttttttttgagacggtctcaccttgtcactcaggctggagtacagtggcatggtctcggctcactgcagcctccactccatcggctcaagcaatcctcctacctcagcctcccgaatagctgggaccacaggcgtacaccaccatgcctggctgtattttggtcttgttttgtttttttccactcttattgcccaggctggagttcaatggagtgatcttggctcactgcaacctccacctcctgggttcaagcaattatcctgcctcagcctcctgagtagctgggattacagacgcctgccatcacccctcgctaattttttgtatttttagtagagatggggtttcaccatgttggcaggctggtctcaaactcctgacctcaggtgatccacgtgccttggcctcccaaagtgttgggattacaggcatgagccaccatacccagcctttcttttgtatttttaacagagatggggtcttgccatgttacccagactggtctcaaacttgtgagctcaagcagtcacccacctcagcctcctaaggtgctgggattacaggcatgcactgtgcccagccaactcatacatcttgagagccttcatgtttaacttcaatctcctgaatatgtgttacaggagcaaatgacatgagaagggttaagaaattcttgccttataggaatgacagcagtcaaggcagtataggggcctatcagttttctttcctgtggccccaggatgtagttcttagctaagagcaggagttcagtgatttttagtcacttgaatgcaggtttttagggccatatgtactgacccattttctgcctgtgtgattgagtttctgctgccctgccagttcctctttggcatcagctgatctctgtagcactctcttgctgtccaaattgctgtgtgaccaggttagaaaagagtcgctttcagaggaagttggccatgccacaaaacagacacctcatagccaaatggcctaagataccatcatgacaaggcttatataaatagtaccgtttgattattaatgggggaactataaggcaatctaacatatctaatatgactgctgcccaagaactgaattaaagtctgctagggaggtgtataagagttttgtacctgcctaagaatagctgtcacttcattccccaccctcaatacctacatgtacacatattcacatatgcatgcacatactcctactccttctgccccagatgaaggggaggggaagggagcccatcttaagaaaaagcttgaaagggaacaaaagcagcagtactgagtcaataaagcctaaagcagtaagtacctggatgcctcacatagaatggttttggtgtgtggcagagtcatttgtagtcagctgcactgttcctgaaggagcacaagactggcaagtagaaactgggaaccagcagaggcctagttgtaaggagccctttatctacattactgtctgtaagaactggacagttaggcagttgggacctggaaggtgatatcttatctctttattagccatttcttctcccccagaatgttttggaaaaccaagactaagaaaagtgcaggccgggcatggtggctcacacctgtaatcccagcactttgggaggccgaggcgggcagatcacctgaggtcaggagttcaagaccagcctgaccaacatggtgaaacccttcctctactaaaatacaaaaattagccgggcatgatggcaggtgcctgtaatcccagctactcgggaggctgagatgggagaatcgcttgaacccaggagatggtggctgtggtgagccgagatcgtgccactgcactctagcctggcgactgagcgagactccgtcttggaaaaaaaaaagaaaaaaaaaaagaaaattgcatttgttccaggcaaatggatgggactgaatcaactcagatatcaaatctttgcttcctactcagaaagcgccattttttctaagatagaaggagtttgtgacaaaatatgtatcagttacacagatactccccccacacacacacacacacaagtgtctcctatacctggctccaaggatgaaggaatattagaaaagaggaacttctgacctagaggtatgtacagttttgttggcaaataactaaaaagtagtgcacagcattttataattgtttagctacatagacgacaagttttctgagcaggaaagatcactctaggccagggtagctaggcttcctcgaggaaagcccccactccctaagagttcatcatattcccttctgtgccccaaaagcactttgtcccattgtgctagtgtccaagtgtggttctgtctgggcttgttgtgctgtattataaaaataacctttttggactataggataagaccactaccctttgcttttccttatggggaatgggtattcccagtgtcaactgacttgagacaagaaactaggaacataggagaaataactccctatatttctgggctgtactttcttgggtccggactttaaggaggttttgaggataattccaggtggtgagaacaaaggacgtttgcaaactctagaggaaggctgggaagtacactataggggatctcaagttgaagacaaacaagtgagtcttatgaaccagactgtccaatttgagataccgtctgtgttcattgcccttttatcatctctgagaaataaagctaaagggacagtagagggctcggaggtttccaaattatctcttcatagtccatcttgggtctgtgtcttatttctttaaggacagtatcaggctttcttatattttaatattatacactccatatcacttgattgttctgttgtgtctgtatctcccaccagcatgagtttctcaagtgcttctcttatttacttttgttttcttaccacctagcacagagcctatgagagtataaagtcttcctgggcctatttcagggaagggcgaagggcttgatagcaaagaggccaaaacgcctgctccagagctgagattctgggttccaggcccagttttgtccccatctctgaacgacttcagtgaccttggaacctccgtgctcccagtctgtaaaacagatgctgtccttgactttgcaggagcgatcagtccacactgctcagaccagagctaacaagagggatttaaagtagaggtaacatgttccaagtgggtaaaccaggacagagagaagaagatgcctttttccaaatgatcctaagcctgtggttagaagcaaaaagatccctagtttcctatcaacgtgcctcctgaaagtagtattacctttataggactcatgtccgcagctactgcaataatgctctaagagtaaaatgtctgtcagatatagccattcagtctaattttgtaattacttctaagaaacagcctgaaacagacttttgcagtggcaaggccaagaacttacttggaaggaagtgggaggcagtgtggctttaaaaatattcagtttgtgagcactatgaagaagtgccaatagccacacacaggcttttatcagtagctctagaagtaaccagtacacacatacccgagccttggctcttgggggcagctgagaaagtagtttgcttctgcttaataccattactgcccaactgatcttctgtgattactgttgggaatgagtatgaattatgaattgcacctttagttcttagttcttttctgttgttattgttgactgcatagaagccacttaggtgatttcactggaatgaaaagcctattcagttatggtcttaggctatgccacacaatgaggaatagaaaatgccaattttcagagtgaagagaacatgaattaggaacaacgttgaatgctggagggatgtagagaatgactgttagtgtaccctaaagttaatttttataattaaaaccatcagcagcttctgggaactatttatgctgtgctattagagggcacaatattggggaatccaatctctaccttccatgggctctactctagttgtggagatatttaagtcagcaggccattacacaagagctatggtaaaggtatgagatcacatggtaggattgagggcaagggatgggacacatcacaccaaaacagataatcctctaagagacttgaaatataacagtccctgaggcatttaggagtccggcagttcggtcactgatctccctgtgctatgaaaagaacctcttaactgttcagtctttcagtagaatcttagtcttttcctgcctgatcctaactgggtttagggagtcagtttgttgcgggtgaggggaaagaggtgaagccacatagaaagtgttttgttgtttttgttgcagaaacagctttagagtgaacatgagttaatagacttggcatttcttcactcaggtggctttattcagtgttaatactgactgtgcagctgttccaggacacctcaggcactttcaggtgtctgatctggcccagttctgaagaatttgtgtaggtttccaggaaatgcatccatggccacccttttgagtctcttgtcagctcagtcctcactatggagagtggaatgtatgattattgtatacgtttgacacacgctttttttaattttaatttttgagacagagtctcactgtcacccaggctggagtgcagtggtgtgatcttggctcactgcaacctctgcctcccggattcaagtgattctcctgcctcagcctcctgagtagctgggattacaggtgcctgccactgcacctggctaatttttgtatttttagtagagacagggtttcaccatgttggccaagctggtctcgaactcctgacctcaggtgatccacgtgccttggccttccaaagtgctggaattacaggcatgagccatcacacccagcttgacacatgcttttaaaagaagcccagttgcttcagtcatcagactaaactttcatttaacacacttttgccaagctccttctgggtacctgtgctaggttacagatacagaggcaaatgaaatcattccttgccagtgaagaggcaaacatgtaagtcactgttgcagtgtgatataataggtgtgaggaaatgaagaatgggaaccaggcagcaacagtgcctgggctgttttctgaaactgaaaaggtcacctcttgcctcagggaaatctgactggtcctctcttactgcttagtgtaggcagggctacctcactcaaaagtcttctaggagggaagagacataggtgacatatctgagctgccactgcctcacaggctggtgccctatagctggggctttggctaataggcaggctggcctagggcccatcttctcacagacagtcaaagtcagggagctgcgagtgctgagccagcaggactgattagagagccaaagccaggacaagcacaagaactgtccttcctggaagccagagatgaggcatgtctacctgtgatccagggtagaagtgatgaaatcacggctccttccagcttggggaagggaaatagtgtaatcatgtcaaggccagagtaagggattgatttgtacctgacaggagtaagcaggaggtgacttggcatgtcttagcaactagataccaaggctggcaaggaagagggagggctggtttgggtcagatggggccttgctggctccagaagtgtttctgtgagccaaggatccctgctctctgctattctgaaggaagcgggtggggtgaggtgcctcttgagccagagcagtgtagggctattttgaaagcagctatttggggagagctggttgccgctttttgtttatttacaggtcacttgggttgacctgaagacagcattttttcagtgagcatgttctcagcctgtctcatgaattgaaagctgtgaggaaggaaggcaaaccagaacttgctcctgaggggttcatagcttttctgctagactgtaagaggagtggcatagaggaggagctaagagttgagatgagagggagaaagatgaggtcatggctaaaaaggtagcttgccttaaaatacaaaattttcttaggtgaaaaggataattgggagaatatttcaaatgaaagggaacaatgtaagcaaaggcaaaggcttgaaggacctgttcaggtttggtaagtcaagcttgtctgtgacaagtttggatgaggatatgtgcataggggcaccaggaacagggggacagcggctaggccagttggataaagccagatcatagacttttaatgccagagaagaggttggttgtgatcttgtggacagtgaaggttagtgaaggcttagacacttgtcttgtgcttatatcaagttggcaaggtcaggcctgggctttgggtctgtgtttctgaggaaggaggaagggaggccaggggcctgatagtctgttgttctcccctatattgcaagctccaagaggacaagggttttggttgttttcatctagctatttctagcacttaaaattatgcctagcacttagaaagcaaagatgagtaattgtgtttggaatgtgaagtgtatcctaggacagccacccaagacccaggactaactcatctcacctggctgtcttagagcccctgacctgaccagtggggtcagcttgagtgcggttcaccaaggagcagaggacaaggtgccctgtgataggaaggggggaatgggtggtaactctatggctgatccccgcttctgagccacattattttctcttccttcctgggaaccctagaactgcctgataaagagggatgagaatggttactctgcagtggtagctgactttggcctggctgagaagatccccgatgtcaggtgtgtagccctactggatgctggggtccaagggacagggggctgaagctaagggaaaattctagcctcctccccagaggccaggacttggtcacagctcaacctcagctccctaaatttgtttagtcctcgtctgtacccatccttgaggtggaggaatggtcaaaagattccattgcaccagccattggcaagctcattttctgtataatctcaccccacagcatggggagtgagaagctggccgtggtgggttccccattctggatggcacctgaggttctccgagatgagccctataatgaaaaggtaagtttggaggatctcaaggcctgattctccttttttctttttcttttttttgagatggtctcactatgttgctcaggctggaatgcagtggcacgatctcggcttactgcctcccgagttcaagctattctcctgcctcagcttcccaagtagctggaattacaggcatgcaccaccacgcccagctaatttttttatttttagtagagacagggtttcaccatattggccaggctggtctcagactcctgacctgaagtgatctgcccacctcggcctcttgaagtgctgggattacaggcatgagccatcgcgctcggctgattctccctagaatccactcttagcagagtgtccaagatgttcctaccaagagcagtggtggtacctggcagctgcccagtgactgactgggatgaagtatgggcaatatggcccaggcctgggctgttagatggtggggtgcaggggaggcaggggcaggggcagataccctacccctcaacccattaagagggaaaccaaagtccgactacccaccaggcagatgtgttctcttatggtatcatcctctgcgagatcatcgcccgcatccaggccgatccggactatcttccccgcacagaggtgagctgcaagcatggggatcattgccactgatggggctagtttgaagcaatggaactgttctgtccctgggatggacttgctggaactctctgttgctggttgtcaggggcagctcccaaccacttctactgagcaggctaggatgggtggggggattaatgaactgtctacctatgctttccatacccatccacagaatttcgggctggactatgatgctttccagcacatggtgggagactgtcccccagattttctgcaacttactttcaactgctgtaacgtgagtgtctttctccctctgcctttcatcaggggctggctgaacccttttcacctggttaggactgtacagagaggctgctaattagcttcatgagggacctcattttcactgtagtgacagcaaccacacctcctcctcctccctctggcagctaacctattcagagctctggacaaaggaaagaaagaagttgttttgtattatctggtcctcaacctgtagggtagacccatcactccttgcgttaggtgttgatggaactctggtccggttttattgttggactgtggatccaactggtcctgaggcatatgagaaaggctcttcttggccttcatgtatgtagctctggggctggaccttacctgttaggatcaaggggtaggtgggctttgttcagatacctcccagaaacacattaggagcagaactcaagaacagaataaactaatatgagcatacttttggaaggttctgtgacaaggtgataagacaaacactaagacagggagggtagtagacagtagtgttttccctgacctgaactgtagggatcaccttcattgtctggggcctttagaaaaggtctctcagctgcacatctgaatcttcaaagatgccagaaatagactcaaatgccatctttggggtgggagatggagggcagagctcatggctgttgtggatacctacagatggatcccaaactgcgcccatcttttgtggagattgggaagaccctggaggaaattctgagccgcctacaggaagaagagcaggagagggataggaagctgcagcccacagccaggggtaagagattagaccagggagcccaacctaaccctaagggaggaaattcggatgtggggccttctcctcttagggttgtgattgccaggatcccaggtccagaaacaaatgggaggggaaggagatgatgcagaaagtactggcctttttaagagctgtggcttggcatactgcttcccctctctgagtctgtttcttcattggtaaaacagggccatggtatcagctttgctttcatgagtgaaaacattctgtggtaaaatgctgcttgtatttgttatgactagtgagagtaacccagacttgattattcttcaggactcttggagaaagcacctggggtgaagcgactaagctcactggatgacaagatcccccacaagtcaccatgcccaagacgtaccatctggctgtctcgaagccagtcagatatcttttcccgtaagcccccacgtacagtgagtgtcttggacccatactaccggccacgagatggtgctgcccgcacccccaaagtcaacccttttagtgctcgccaggacctcatggggggcaagatcaagttttttgacctgcccagcaagtctgtcatctctctggtatttgacctggatgcaccagggcccggaactatgcccctggctgactggcaggagcccctggccccacctattcgccggtggcgttccttgcctggttcgcctgagttcttgcatcaagaggcttgtccatttgtgggccgggaagaatcgctatctgatgggcccccaccacgcctaagtagtctcaagtacagagttaaagagatcccaccattccgggcatctgccctaccagctgctcaagcccatgaggctatggactgctccattctccaggaagaaaatggttttgggtccaggccccaggggaccagtccatgccctgcgggtgcttctgaggagatggaggtagaagaaaggccagcaggctcaactccagccaccttctccacctcaggcataggcctgcaaacccagggaaagcaggatgggtgagggggtttagtccctgcctcaccttggggatggaccttcagctgaaaccatatggccccctaggtgcacagccttgattcttccctggagcctacagagcaggcaggctaggccaagccaggctcaacttctgggctcccagtgcccattggctgtgtatgacgggaggcagcagtgagaggccttcctagttagggccaacagctgataccaagcctctgaaatccagcaaggaggtctgcctcccaccagaccctctccagtgtacttccccagataggaccagaggatgtctagttctaggctgagctggcaggcagctattaccccggttctttccccaccccaggtctgtctcttgccttttcttggggcatataagctactgagtggaacatggagctgatcaagaggccgtaatggtcatggctgtttcccagacctgaatattggggtgcttcttgccagtattctaagacatttgagtaattgctgtttgcacttactgcatggtcagaccacgtcactacatttctatgcaaggggacagcaaggcagcgtggtggtcatggctcttagctaacctattcaaagaccttttcctgttgattaatctattttcatatttataaaggagtcttaatgttctgccccataagactttcaaccttgtggttgggagtggggctggttttgtaggccctagggcctgcttctatgtatttatcaacatgtgatacattcaattggttaaatggtttatacagggactgatttgcttcccttcctgccatggctggagctttgggaacagtctgtccttacagagctgcaataagaaataaccaaagatgaagctggtcaaatattttcataacttgcttctgttgatttttttttttgtaaaactttcccaagacattttcagacttaaaaataaagtcagtgttacaggtgctggtcagccttcttacttgtacctcaaacactgggataaaggaggcggtccagggcaatgcagtgatgtctgtcaagacattccccctcccctaaactcagtagcagttgaggatgacatttcaggctagagagacccaaaatacctctgttccacctgagagcaaggtggaagttgcatcagctactgccccaagtgagcttcatcttctgattgtgggctttggaggaacgagagaactggctcttggccactgtgaggggtacagctttgccactcaaatataccttattgtggcattcagggagccagggtccagagctgcagggctgcggtccctggctcacttccacataggccatcacataacctgtcataaaggcatcaaaaccagcccggtgcaatccatccccaggcactgggttaggactggcttggctccctggcacttctgaggtagctctatcagctatttcaggccttgctgccttaatccccatctctaagtcatttttgttgccttgcttggagtgaggcaggttcctagtttcatcggcagccacctcctgctcggtttcttcaggcttgatgctatccccacagacctgcttcttgggaggaccatccttagcttccccagaggtctgtgtccccggtaggttcaataaagccctcttccgtttttccctacgtcgtcgccgtcgccgcttgtcctctgccgcagcctcatcagtgtcaatgataaggtcaatatcgtgagactgaggacactgtggtcccagggggcaccagccataagcctaggggtgggaaagaggcttagaaagaggctccaggcatcagaaccttccctcccaagaaacaggtgggtgctctcaccgagaagttgtcacagatgctggtgggatgaggacggtgggttgctgggggcaggcagcagcggtaatcaatatggtccctcatgctggaaggatagttgcagaactccagggtaaggtgtgggctgccagctgcccgctgcttcccattttcccgttcactgcaacagcgcaagagggtaatggtccactagcatataagctccataagagcagggttttgtggtctgttttgttcactgctgaatcctcagcacctaaaacactgcctgggcacatggtaggagctcaataaatatcttaagtgaatgaaataaactcgtatcaggccccacccctttccctcaaccatttcctcaccatttccggaaggcatattctaagtaggaggccacgaaacgggcatgaaactcagcagcatatttggtgtcataaatgcctgctgggaacatctcacacaggtcagcggtgaaggttcccagactctcagggaggtgtgcatagaagttctggtacaggaacaccaagtctataaggccattgtgtagcaccaggggccggcgggctcggattagctccaggaatagggtccgtactgactggctctggctctcatcaccctagatgaaagtaaaggggtcaatgaggaggacagagtcccccagggagcctcttctgctgggcacttatcccagacttccccacttggaacgctctctctctaccttacccaatgctgcccaccctcctcataccagtcttgtttcccaagccctgtcactagtgattccccatactccctaagaagcagattctccccagacatccagcctagggtaggaagaaataaagtcacagaaagggcagactcaaggctagggaggctagaggcctaccttgtcattgcccttatggtaggggatgccttgggcatactgctggttgaagttgaagccatgctgtatcaggaactgcacagactttggttctatgacatactcctccatgcacagcagagtgagattgaacacttgagccagataggaatgttcaccctgggagaaagagaagtctgctatatcaagatttcagagagccaagctaggaggatgcaaaagcttaagaatgatacaatggactctggggactcaggggggaaaggatggaggcaggtgagggataaaagactacgcattgggcacagtgtacactgggtgataggtgcaccaaaatctcagaaattgccactaaagaacttactcatttaaccaaacaccacctgttccccataaacctattcaaataaaaaaaaaaaaactatcaagtcaaaaaaaaagatttgggagagaaatgcttcctatctgatgttccctagaatctctctaccctccaccccacagccacacctaggattggggtgagatcagctcataccttgtctggctgccgcttgaagcaggcgaggcccagggaaaggatagaacgggtcctggcagcatgacacacggccttgtaacgttcctcaatgcaccttggggttgggtatgggggttgctgtggctaggagttagccttatgaaggacccaaaccacccaggtctgtgacccccccactccacagttgagggctggcactaaagagaaaagggcttatacttactggttcagcaaactcttcctgtccccaagcccactcagctcctgtgggtaggtaaagggagagttgtgacaggcctctagcaccagccccttcacaaccacctgccctccttgtttcccaactctcaccgtgtccacagccacgaaattagctgtctttatggctagcaggagggatggccacatctccttgaagttgttgctttgcacatccactacgggaacctggactactagctcctccccagatgttgtgcttttgctgacaccacctgggggttaggagggtgatggatgttcatgcttaaggaaagagcccaggggaacagacaccaagctaggccacggtgatggtggtaaggggggtagtttccattggtagcttttcccacaagcctttgtaacccacgtgttctacacacaggccttggagtggagaatgccctgaatttggggagaggaagcctgagtcttctactggcttgtatgagcctgggtaaattacttcccacctcgctttcacaatctgtagaggagaaagttggactagacgacctttgattcttttttcccatgtcctgcaggaaacattttgtagggcttgaggatctcagctcccttaatatcccacagggatccatactactgttctcatggtgccccagcgccacaagcaacagctcccagtaagccccagagcctggcagtgccccacaccagagctcccaatacgtcctaccttcctttggatcacaacgctcaatccactccactgaactgaatcacaactattactactaaccgttatgagctccagactacatctcccgccatgcctccatcagccccatgctcccaacgctccaggcttttgcagccggagccgcggtgtacaacggaacttgtagtctcctcgtggctagttcaggcggaaggagcagtcctctgaagcttgaggagcctctagaactatgagcccgaggccttcccctctcccagagcgcagaggctttgaaggctacctctgggaagccgctcaccgtcggaagctgcgggagctgaaactgcgccatcgtcactgtcggcggccatgacaccgctcgtctcccgcctgagtcgtctgtgggtacgctggacttgcggtccgtctcctggcgcggttcaggcagtcggggatggggcggggtctcgccgtcgggtcgccgatgggtcgaacttccgttcagacgtcccgggtccggcgcggggaaggcagcctggcgcgcgctaattgcctattggcctgtgctgccggctcgcagcccgggtggacccgagccacgccccctggagtgcgccggaaagccgggcgcgctagagctcgcgggaggtaatctttctctcctgctctcgcggcgggaacgcggggcctccgtgttctgctgtcttcatcagcgtgggccgcgggtagcgggtagtggggtggctgggtttgggctttccagagaaggtgacgctgcctgagctgagcttaaagcacgcccaggagttagactaggagagggtcgtgtgggggaaagaagggcgttctgggcatcggtaaattcccagagaggatggagagctcagtgatctccagaaagtgaaagaggcggggagtgggccatcggaggaggctgcccagggtgtaagagcgaccgattggtagggaagcttttgtaataatccaatcaagtgataatgtgaacttgaattaaggctggcagtatggatggcgaggaagggacaaattgtgaagcagctaggcggtatagtcgacctagagggtgattgaatttgaaagaggttcctaggccgggcgcggtggctcacgcctgtaatcccagcactttgggaggccgaggcgggcggattacctgaggtccggagttcaaaaccagcctggccaacatggtgaaaccccgtctctactaaaagtacaaaaaaaattagctgggtatggtgcgggcgcctgtaatcccactacttgggaggctgaggcaggagaatcgcttgaacctgggaggcagaggttgcggtgagccgagatcacgccattttgcacttcagcctaggcaacaagagcgaaactccgtctcaaaaaaaaaaaaaaaaaaaaaattcctattggagactagtccctccgtaaacactacgattcccatccacctctgccttccagtgctcctttgttactcattgtttatagttaatcttcagcttctctcaactgagcccatttcatcattattcagaactgcttgggccgggcgcagtggcttatggcctgtaatcatcttaggaggccaaggtgggaggatcgcttgaccctaggagttcaagactagcctgggcaacatagtgaaaccttgtctctacaaaaagaaaattaaaaattagttgggcatggtggtgcgcacctgtagtcccagctacaggaggctgaggtgagaggatggcttgagcccaggaggtcgaggctgcagtgagccatgttcttattgcactccagcctgagtggcagagcagcaaagtgagggacacactgtctctaaaaacaaaacaaacaaacaaaaaaaaaacaaaaataaaaaaactctttggatttctcctatcctaaaaaagggaaactcttttgactatcccccatcccattaattcatttaacaggtatctattgtgtacagtttacctggcactgactttggacacacaccaatcaacaagagaatcagtccttgcactcaagtcgttttttacagtcaaattcaggaagtacacactgatggaaagaatcaaagtaatgtaaaattacattaggtaagagctacaaggcagaaatatgtgataggataagatgaggggacctgatttggacatttcagtcaagacttgaaaaatgataaggtgttaggtaaaagcataaaagagtccaaacagaggaaatggattgtgtgaggccccaaggtgggcagacacacttgaggtgtttaagcaactaaattcagtcaaccttggctagagcatagtgaggggatgaggcggatggtgcccggatcactggacctgcaaggctgtagtaagaggactgccttctaagagcaagggtgtggcagccaaatccctccaatggcctataaggtactttgtgaccctcctctccccacctcatctggtttacttctctgacctcttctaccactcagtcccatctcattccattctaaccacattgacctacttactgtaccacagacataccaggcaccctccttggggcctttgcactcacttagaatgctttgggtctaccttgaccacagtctttaaaattgcaacattaaaccccaccttggcactcttttttttcccctcttggtctaatttttgctttttatgctaatatttatcacctaacatcttatggaatttacttatgttcattattccttttctgtccccattagaatataagctccctgagggcaggaacttttgatgttttatttactgaagtatgccaagtgcctaaaactgcttggcacatattagggggctctataaatatttgctcaatctttttttttctttaagagacaaggtcttgctgagcccagggtggagtgcagtggcacaatcatagctcactgcagcctcgaccttctgggctcaagctgttcttcacttcagcctccagagtagcaggattacagtgttgagccaccacaaccagcttgctcaagaatttaatgacccatagtaaaggcctacagtatttaaaaaagaaagaaaaaggaaaaaaggaaggaaggaaagagggagggagaaaaaaagagaaaagaaagaaaataaaagaatataatggggtgtcaccaggcgccgtggctcatgcctgtatcccagcactttgggaggccgaggcgggttgattgcttgagctctggaggtggagactagcctgggcaacatggtgaaaccctgtctctaacaaaaatacaaaaattagctggatgtggtggtggtgtgcgcctgtggtcccagctgcttggagttggggtggggtattggggtgggaggattgcttgagccgaggaagcagaggttgcagtgagccaagatcacaccactgcactccagcctgggtgacagagtgagaccccatcccaaaaaaaaaaaaaagaatgggaaaccattgaaggttataaggaaggaagtgacgtgatctggaaaagattcctttgctctttggagaatagattgtagaatgaatgtggaagtaagcaggtttggtgaaggaagtttggctatgaagggaaggagggtgggatttgattgtgttacgagccaaggggaaaatctttccctttgccctctgaagatctgctgaaaaatcagctcacaaaaggcaggttaactggagaaaaggcatacaaatttattaacatgcacattgggagaaccataaagtgattacccatctccctacagagttcgtgagtttatataccatctggcaaaacagattatgggaggggtgtctcacgtgtgtccatgtgaagagaccaccaaacaggctttgtctgagcaacaaggctgtttatttcacctgggtgcagacaggctgagtctgaaaaaaaggagtcagcaaagggtggtggaattatcattagttcttataggttttgggataggcattggagttaagagcaatgttttgggggcagggggtggatctcacaaagtacattctcaagggtggggagattataaagaaccttcttaagggtgggggggagattaccaagtacattgatcagttagcgtggggcagaaacaaatcacagtggtggaatgtgatcagttaaggctattttcacttcttttgtagatcttcagttgcttcaggccatctggatgtataagtgcaggttactgaggatatgatggcttagcttgggctcagaggcctgacaaggggtagaagagaaattctgtttttctgtttttgtagagacggggtcttgctatgttgcaagcctaatctcgaactcctgggctcaagtaatcctcctgccttggcctcccaaagtgctgggattacaggcctgagccagcatgtccagctctatttgtttttaaataaaccgaactttggccagaaggagattctgttgaagggcaataaaggattactagagagaatggaatggggacagaggttgacttgttaatagttctctttggaatttgagtgatcctgaggtacacaatacctgtgaaagggtttgttcaggtgtggttacatgttagtcttattgggaggggaagaaaaaacaagtattctttttagtgagtttggactttaggcagataaagagttccagagaacaactttatcctggctttgggagagtctggggtggaaggatcagagagaccttgcggcttcttgagttcagcatgtcagagggccatattttggggtattggtttcttttcttttctttttttttgagacagagtcttgctctgtctttgttgcccaggctgtgcagtggcatgatctcagctcactgcaagctctgcctcctgggttcaagcgagcacgtctggctaatttttttggatttttagtagagatggggtttcgccatgttggccaggctggtctcgaactcctggcctcaagtgatctgcctgccttagcctcccgcagtgttgggattacaggcatgagccaccgtgcctggcctggggtattagtttctgagttccaacagttagacgggattggaggagcaggaccctgaagaggaggagggtaagacagtgcaaatggaggtagatttgaagttggtttttttttttctgaaggaggaggcaagctcttttgatgaaaatgaggtggtaaagtcaaaggtttggggggagagtttgatacagaggcttagcagggactgcattttatcacagtataagaatgctggtcgtggatttgaaagaacaagtcgcttaatctccataaacctcaatttccttataactaaggtggaggtgatactagtacatacctcatagagtcaccaggagattgagagatccggtaaagctcttcatggggtctgacatagagtaggcactcacaaaatatcaactaattttagctgttagagaaaaggcggccattataacagttagggagcagtgaaaatcaaccaggcacattttctcattgttgatggtcagccacctatggtttactagattaggaataaaaatagctaatctctgttctcccactgatttgccatctgttctcagacagatcttttgtccctctgatccttggtttcttctaggataaaatgaaggttttggacttaatgactactacaggctgtttcagtgtaaccatgctacatctctaagaggcagagaaaccgcctacccccattctcccagacacacctaaacaacccctatccacacacacagtcacagtaagcatcagagatacacaaatgctcccaaacaggaggctttcatccttgacccatcccagccctggcctcacagtctttgcatgtctccagggctgtaacgccggcccccttgaggccacttgctcagctatactagttgtatctcagtgctgcagccagccaagagtaaacccgtgagcatcttgagagtgcttgagagaagctggaccccatgtgaatggtggatgagagggagatagctatcacccttggaaggcctcaaaatttggcctcattgtgactgactgctttggctgggtctttttgtttcaggccatcatgaggaagccacgagcagccgtgggaagtggtcacaggaagcaggcagccagccaggaagggaggcagaagcatgctaagaacaacagtcaggccaagccttctgcctgtgatggtaaggaactaggttgtggcccaaggctcattggccatgaaaggcagattcaggctgggaagggattgtgatacgtatcaagacattaagagacttactaagggccaggtgcggtggctcacacctgtaatcccagcactttgggaggccgaggcaggtggatcccttgagcccaggagtttgagaccagcttgggtaacatggcgaaatcccctctctatgctcgcgtggtggtgagcgtctgtagtcccagctactcgggaagctgaggtgacaggatcgcttgagcctggaaggcagaagttgcactgagtcaagataatgcaactgcatttcagtctgggcaacagagccagactcttgtctcaaaacaaaagagactcactgagggtgtaattctgactgtattgctgtgtgacattgggacaattgctctgaatggctgctttcttaccagtaaaatggagcagtagttcagcatttcctccctcatgtggctttcatgggaccaaatgagtttatgagcctgaaagtgttttgtgaataggaaggtcctgcaccagtatacattctagctggctaaaactattaggttttcattatggctcagagacaagccagtagtaccaccctgagaaaattaaggccagaaacttagccacagctacacacaattacataactctggtctgactccagctccaaagcttaagggggttagttgggggaagccctaagtgggagcatactgccacaggctgctgtgtcccaagaccctgatgcacagcctgtgcagggatgattgctgagtgtcctggggccccagcaggcctggccaggcagccggaagaggtggtattgcaggcctctgtctcctcataccatctattcagagacgtagctgaagtcacagccttccgagggagcctgctaagctggtacgaccaagagaaacgggacctaccatggagaagacgggtaggcaggcgaggagcagggacagtgggtgggaggcaggcacccagccccctccaccctaactcctcatctggggttgcattgacaggcagaagatgagatggacctggacaggcgggcatatgctggtcagtacatctcctgagagcagggccactttgcctcgaggcccttgggtctgggggctgtgggccaggtaggggcaggtcagcagtgtcctcatgccaacccctttcccccagtgtgggtctcagaggtcatgctgcagcagacccaggttgccactgtgatcaactactataccggatggatgcaggtgactccaggggaggaagggaagggtcatgggtcagaccccagatgagagcctctactttggggtgggtgtagagaaggcttcctctaccaccttcacccttgaccttgtctctttctgcctgcctgtggctatagaagtggcctacactgcaggacctggccagtgcttccctggaggtgagagccaccctagggtaggggaaataggaacaatagagggactgacgggtgatctctttgacctctgatcctacccacaggaggtgaatcaactctgggctggcctgggctactattctcgtggccggcggctgcaggagggagctcggaaggtaaggggatggcaggagggtaggaacccaggagtcttgggtgtcttataatcttgagtcttgcactccaatcaggtggtagaggagctagggggccacatgccacgtacagcagagaccctgcagcagctcctgcctggcgtggggcgctacacagctggggccattgcctctatcgcctttggccaggtgatctcacagcccacccccactttgtgcgtgcccagcctccttcctcccagcccaggctaactctttggcccctctgtgccaggcaaccggtgtggtggatggcaacgtagcacgggtgctgtgccgtgtccgagccattggtgctgatcccagcagcacccttgtttcccagcagctctggtaggatgttggggtaacaagggtgcttcaggggtgtctgcaaaggagctctgcttcacagcagtgttcccttcttttaggggtctagcccagcagctggtggacccagcccggccaggagatttcaaccaagcagccatggagctaggggccacagtgtgtaccccacagcgcccactgtgcagccagtgccctgtggagagcctgtgccgggcacgccagagagtaagcctactggggaaggggcagtgagaagtcctaaggagtgactctgccctatgacactcaaccctgtgcctctcaggtggagcaggaacagctcttagcctcagggagcctgtcgggcagtcctgacgtggaggagtgtggtgagcaccaaacctagcccccaccccaacccttcctggcccagtcagaagccccattccagttcttcctctaacctgagtaagattctgcagaacccggccaaagcccactctctaggttggcccctaaagccctcttggcttgagtagggttcggggatctccgttcccagctcccaacactggacagtgccacctgtgcctgcctccctcggagccctgggaccagaccctgggagtggtcaacttccccagaaaggccagccgcaagccccccagggaggagagctctgccacctgtgttctggaacagcctggggcccttggggcccaaattctgctggtgcagaggcccaactcaggtacctggatactgggcgtggagggcagtggcatgagtaacaagagagaatggagggaatcggcagctgaggcctgacccctgcctggctgccctccctctcaggtctgctggcaggactgtgggagttcccgtccgtgacctgggagccctcagagcagcttcagcgcaaggccctgctgcaggaactacagcgttgggctgggcccctcccagccacgcacctccggcaccttggggaggtaagtgagcagcggaatagccaaggatgttggcttttgaggctatatccacaggcctatttgaaccccttgacccttcctccaggttgtccacaccttctctcacatcaagctgacatatcaagtatatgggctggccttggaagggcagaccccagtgaccaccgtaccaccaggtgctcgctggctgacgcaggaggaatttcacaccgcagctgtttccaccgccatgaaaaaggcactacctttgttgtctttgttgtacttccttgtgtttcctacatgttctacatgaatatattactgtgtaaacaggaaaaaaagcatttttttttgagacggagaatcgctctgttgcccaggctggagtgcaatggcgctatctcggttgactgcaacctccatctcccgggttcaagtgattctcctgcctcagcttcctgagtagctcggattacaggcgcccgccaccatgcctggctaatttttgtatttttagtagagatgaggtttcaccatgctggccaggctggtctccaactcttgacctcaagtgatccgcccgcctcagcctcccagaatgctgggattacaggtgtgagctaccacacccagccatgattttttgtatttttagagatggggtttcaccatgttggccaggctggtctcaaactcctggcctcaagtgatccacccgacttggcctcccaaaatgctgggattataggcgtgagccaccatgcctggccaaaaaagcatattttaaacaaaagtactgggacatgaagttaagggcagaacaccggtttatctcttttgcaaaaagtgccagccctcacctccctgtcttcttgtctaggttttccgtgtgtatcagggccaacagccagggacctgtatggtaagtctcctaggcctctcccaaccgtgtctccccaggcctgagtccataggtttttagtcagttaactaacgaatgtctgggtgaacattctccactccaggcttcactggagggaggaatagttcttgacctggagaccttccattgtggggtgcagggtagagggaaaggaaaaaaatgatgaggactctccagtgtcacaggtgtgtgaaatgcctgtactgagttttgtgggatatgaattgtggagccatcagttcttttttttttttttttttttttttgagacagtctcactgtcacccaagctagagtgcagtggcccgatctcggctcactgcaatctcccacaactggattaaagcgattctcctgcctcagtctcccaagtagctgggattacaggtgcctgctaccacacccaactaatttttgtatttttagtagagacagggtttcaccatgttgactaggctggtctcgaactcctgacctcaagtgatctgcccatcttggcctcccaaagtgctgggattacaggcgtgagccaccacacccatccatgggagctatcagttctaattgggagacggatcaggaaaggctgtttggaggaagcagctggtaatcttcgtcctagaaatgaatccttttcttcaggtttgggaggggaatcaaccgtagcgatgttctttccagtcccaagagtagtgtgagcaaaggtggagcccagtgcaggctgcagtgctcaaggagctgtgagcagttggtttagctggaaaggtcagcagggcctgctgggtcagtcagggtgtgagccctaggctgctgactcattttaggtggaggagagaggagtcagatttgcatttttaggacaattcgattccctcaggcagccttttggagggttgattgatggggcagatacttgaggcaggatgaaagctctacagcattccaggctaagcctagctagatcagtagagtcggggaaagggagagaggacaaggagaggattctctgctccccctcccccaactacaaggcctccctccttccattttttcacagggttccaaaaggtcccaggtgtcctctccgtgcagtcggaaaaagccccgcatgggccagcaagtcctggataatttctttcggtctcacatctccactgatgcacacagcctcaacagtgcagcccagtgacacctctgaaagcccccattccctgagaatcctgttgttagtaaagtgcttatttttgtagtt

SEQ ID NO: 36766 - DNA, 20443 bp, Homo sapiens
gtaaaaactcctggaagaaaagatcctgcaatttggctttttgtgagatggaaaagattacaccttgccctgcaaacttcccccctttaaaggcgaaggtttgttaggttagttagcctgtgagaaaactgtgcgttcttagcaatcaaaggccagacatctgggggtacaggggggaggaagactaggataagagactctagacggggacagaattaaaaggaaaaaaaaattaaataagcctccgtctccttttatctcctagcagtaggcagtaatttaataaataaaggagccccgttagcgttttccctgtccattctttcccaggcacggtgacctagacagcagcaaaaagcgagttaatagggaggggttatgtaggaagcaaaagtcaaggaatgtggctacagctgattacaggaactgagaaagtggaccaaacaatattgactcccagcacgccaccgcgatgtccatcttggggaatccgttgctggaagggacccatctcgcccacccttaggggtcgaggtgggcgaagggggaggagagggctggcggggcggggcggggttgctccgcccccggaggctgggctgtgaccagcaggcggctccacagagcagcgggcgcgctcataaagggcacagccgagggtacgtggatcgcggtgcggagactgaggttagaaggcacaggtggcgagatgagccgggtaccagcgttcctgagcgcggccgaggtggaggaacacctccgcagctccagcctcctcatcccgcctctagagacggccctggccaacttctccagcggtcccgaaggaggggtcatgcagcccgtgcgcaccgtggtgccggtgaccaagcacagggggtgagtgaggagggtcggggtcaggggcaggagaaactggaaagcggggaaaggaggagcaggaagaggaggggtgggagaagggaagagacggcttgcctaaccgttgctaacagctgccacttttaataggcgctacccggtgtgctaagtgggcgttttacaggtgttaccttgtttatttcagcacactctccacctagggaggtattgataccaccatttgattggtggaaaactgagactcagagaggttaagtgacttacctaagcttacacagctactaagtggcagagctggaaaggttttctgatccagagccagacttctgaacatactgtgcatagtgtctaagggaagggcagagggatgcgggggctggaagagggccagtggggtggtgaggaaggaaagaaaaaggaaagtatatggatactttctaagagaccccagcattgatgggaaggggctgaagctgctccctctctccttgtagctacctgggggtcatgcccgcctacagtgctgcagaggatgcactgaccaccaagttggtcaccttctacgaggaccgcggcatcacctcggtcgtcccttcccaccaggctactgtgctactctttgagcccagcaatggcaccctgctggcggtgagcaacttcctgtcccggggtggaatggggcccctgggcccagattgaagctcaaaagtaagttctccgcagcagggggagtcttgattgtgactacgcgtgcccctctgcaagtgactggataccagcaacagtgaaggttatctgtgtccatgtatctatttctaggactgcctgaggatgcataacacggcaccagcgcccactgctgcctcaagcatgtgacagtgtggaaataataatcttgttgtcattcttgcatatgtccttgtcctatactcagttgccccaaatacgcagcttgaatgaacccattagccaagggaagacttacttactgaatccttgtcgacatggaaaagaaggggtgttctataatccctgggagtcttcagaggggtatacggtgtgacctgttttaatatctaatcatagtttcaaaaggtagcagtagcttgtgtttatggagtactttttataatgcatcaggcacttttctaaacatttcacatttattaatcctcttaatacttaaaactattctatgatatgggtaatatgattactcccactttatagatgaggaaaccgagtcagagcaactatgttcaacttaccgaggtttatgtaaccaacaattagcatggttggacttcagagctgctcagtctaagtccacggtccataggtccagactcttctaagaccaccgccattttaactgctacatattgggcacttatgtgccaagaaggagacgctgatcacattcaattctgcaaaattcctctatgggtgtttttattaactccccttccccccaatttctgttgaggtccttgaggctcaggttagtagagtcactttgcttgaggtcacacatctggttagtgaaagactcaagaatcactcccaggtgtgacagttaactcttaaggtctgtgcgctccaagctgggtcttacaatgtccctccttttcccctgaatttctggatcgccaaataatctggccgtttaacactcctttgagaatatctagctttccccaacttacactcatccaaccgagatggcattcatactacctgccaacagcggttccctaggggggtagaacccaaggctttgaaactagatgacagctgaatctgctcagtgacttcgtgattcacttcctcatctgtaaaatgaggttgatgatgcctattttttgatgatcagctgagatgaataacagggagaggagtgcagaggatggtttttactagcgaggcataattttcaaccttcgctgtgtatcggaatcacctgggctgtctgggtctcactcctggaagagatacagactgggttaatctaagggtggtatctgagcatcttcacgaagctttccacatgtgcagcaggaacggagagccactaagagtttcatggccgttgtccagatgtcaattggcaaccttctctctctagttccttcttaatttggtgttttgagaatcctagggcaagaaaagaaaatgggcagttcttgagggctcaccatgtgctagatgtttccagatatgccagtgcatttaatcctcacaataaccctctgaatggctggcattatcttttttacaggtgaggaaaccagtgcttaaagattaaagtgtttgttcaaagttgcatatctcgtaagtggaggaatcggatccaggtctgacgccaaacccatgctgtttgtaggatgctataaaacttcctaagctaatattttagaactgtttcttctaatttatgcagtggacaggggttccccttgctcactgtctctcttttcctccaaggtcatggatggaaatgtcataactgcaaagagaacagctgcagtttctgccattgccaccaaggtaagatgaatggctggctgtaccattaaggtgagctgtcaagtggggtctggtgtctcaatcttgagagactaaaggagaagtggggaacttattttggtttcctgttggacatagctggaactccagatgtcagatatatcagtaattcacgaaattattagctaccaattagtgtgcatgaccagatttcaagtaccttatgtgcataattctcaatcttcccatcagtcttgaagaatcgaaatgagaaattctctccaccttccaggtcaaggaatatggctcagagagcttctgtgaattgcccaggatcacacagctaataagtgctagagtaagaatttaatacttgacctctctggcttccaggactggcttcttgtccctgtaccacattgcccctggtaagacagtataattgtcccatagaccaaagctagtactacacaagaggctgagtgaactgaacatatccaagccagatccctgtattcattcgacaagtattgactgggcttctatcatgtgtcaggcactgttctaaatgttagggaaatggcagtgagaaaaacagaggggcacacacaggggaggtagacaataccaataaaaaggaaaacacaggctgggtacagtggctcacgcctgtaatcccaacattttgggaggctgaggcaggcgtatcacttgagctcaggagttggagaccagcctggtcaacatggtgaaacctcgtctcttgtaaaaacacaaaaattagctggtcgtggtggtgggcgcctataatctcagctacccgggagagtgaggcaggagaaacgtttgaactcaggaggcagaggttgcaatgagcccagatcgagccactgcactctagcctgggcaaaagagtgagtgtcttaaaaaacaaaacaaaaaggaaacaaaacaaaacaaacaaaaacatctgttgagtttaataatgtgttaaatagtaataaataatatgtaattaaataattagtacatattaataaatgattaatagcgtgcttagaatttgctaaaaaataaaaccaacaataatccaaaaagccacataacatgttaggtgaagataaagcagaagtgagagtattggagaagctgtcacattttacattatccaagaaaggcctccctgagaaggtgacatttgagtcaaagctgaaagcagtgagttagcgaaccatgcaaaaacacggaggggcactccaggcagagggaacagtaagcaatgggggtgatgatgttcccaagcaatgtcaaggcatcctataagaaaaacagcatttttaaaagttagagttaagaggatgaggcttaggaaacagggtgtctgtgggaacgattggagtctggagtctttcacattaaatgtggaagtacaaggtcttgggacactggttttcctaagttattataaaggaaacgtggtaacccagggaaagttgcagcagcaaagaccaggtgttcaggttgcatgtcgaggttttctagatacctgctggggagggaagaatgggaggattaatctggtaattgtatgcgaagggagtagaccaacagcacccacctcaatgaactggtttttagttatatccagacctgactcaactgaagtaatcaaggactccttgctatgtttgctggtaatttgggaacagaatgaatcttgtattactgtcatttgcaaagagctttagtctttttcaaactcatttccagccccttgtctggactacgagtttctgtgaggaaggcagagaaagtattaatggcctcattttacgcataaaagaatagaaacttgggtttcctgaagtcatacaaccaggttcctgcgggtccttttgaggccacatggtcttgtcccagataagaagtttccaacagaagcaagctatgcagcagcattagctagggaagtttttaaaaactcaaattcccatgcctactgaatcaaaatcacagagtgaggatcaaccaggtctggaaaccacacttttgtagacccagcctgcaataacactgctttgttgcattaataaaaatctgtgctcccagaagaatcaagaagccttgggttgacacttcaaagtttagacacttcaaagtttaggctgaaacttcacagctttatttccaggggctcagatgaactgtttcaataaggaacaaagggtctattttacttgttgccttgagagtagaatattttcttgtccatcatttctcttctatttagggctcttgttggggagaataagtatacggagctctagggtctgatgaacataatacattttttgtgcttgggtctcacataagcttcattgaagcctctgatatgttttctcaaggtgatagtatatattagggtttagcactaacatacatttattcaacaaatatttgagtgtccaccaaatgcaaggttctgcgctcagcatggggtaagcaaaaccagatacagtacttgccctcatgtagtacagggtccagtgggggaggcaagatatagtccaaagatcacatcaataggctgggcgcagtggctcacgcctgcaatcccagcactttgggaggctgaggcaggcagattacctgaggtcaggagttcaagaccagcctgaccaacatggaaaaaccccatctgtactaaaaaaaaaaaaaaaaaaaaaaaaaaaaaaattagctgggcatggtggcaggtgcctgtaatcccagctacttgggaggctgaggcaagggaattgcttgaatcctggaggcggaggttacagtgagccaagatcacaccactgcactccagcctggacaacgagtgagactcagtctccaaaaaaaaaaaaaaaattcacaccaataaatatgaaactacaacgctgacaagtgctgtaagagtgtaaagcagtatgtcttgatctagcctgtggctgtgtctctgtaggggatatttgagctgagattgaaggataatcagttacttgtgagggggagaggggacaaagcagcctagcatcgtatggcaaggaattaattcatgcaaaggccctgtggttgaaggaagtacatgagcttgggaagctgcaaggaagccagtatggctggaagacaggaagtgcaggggaacatggcatggtggtatgagagacagctttagagataggagggccagaccatgcaaggccttggcaaatgcaaatgaaacagactttcagactctttaaatgagaaacccagcagattcatatacgtgtacttaataacctgcatgcttaggagaaaagattgaagtgccactaatgctgtttaataaatcttataaacatatgattaaaaatcggctgggtgcagtggcttacacctgtaatcccagcacttttggaggccgaggcaggtggatcacttgaggtcaggagttcgagaccagcctggccaacatggcgaaaccccatctttaccaaaaaaaaaaaaaaaaattagccaagtatggtggcacatacctgtaatcccagctactcgggaggctgaggcatgagaatcgcttgaacccaggaagcagaggttgcagtgagctgagatcacaccgctgcattccagcctgggcgacaaagcgagactgtctcggaaaaaaaaaaaaattttaaaaatatcaattatcacactattaccagggcaacaaattatcaagtaagacaaccaattagaattacacatttagtttaggaagttgaaggttatttttatgggatactgtaacaatttctgaagctcacctgtactttcaagaatagattcatattaactgagaacagaagaaaatggtaacaattaaggaaaaaaatctaattatccttatcagacagcaacataagatttctagtcttgtggatattatcattttgaaaccttttcaaatcagagacgttaaactatattttatggcacagaatggtatctctccttcggtagctgcaggagataaaattaattcctaatatttcagagatgctgttttgctagtaattagtagttaagaagacttttcactttttaaatattatactccaaaattccagtgagtagcattttataaaagaacagaccacagggaactcaaagtttactaaatggaatagagaaaaggcagaagagggttttatttaatacatatggtgtcgagggccaagtgatgtctttcctctatgccagtggttctccactgagcatgagtttgccacctgctccagagacatttaggagtgtgcagacgtttttagttcccacaacttgaaggggtggaaaatgctactaacatctaatggatagaaaccagagatactgttgcacatcctataatacacaggttggtgcccctccccaataaagaattgtccagcccaaatgttagtagtaccgaggttgagaagcccagtgctacctcttgtaggtcatagtaggtatgtaccagttctgtgcaaataagactacctctgtcctcatggggcttaaagacctgtagaagaaaatctacaaacaaataagtgctatggcctggtgcattctatcaaggaggtcagaaaggcttcattggagaggtggcactggacgtgagttgatcacagaatcctgctctcaaacacagacaccctcaggagatgccacaaatgctaattctacattcgtctttagaggaagacagaggcagtgaaaagatcaacagagttggcccagtgaatatagctagaaccctgggaaggaagggctcacagaatccaggcagctcttagaagcagctcagagctctgagaagtgggtatggctgagcatgtacctgagatatgaagaaaggacatgggctttggagtatggaagacgtgactttagagccacactgtgcccttcaatagttgtaagacctggctaggtgcggtggctcacgtctgtaatcccagtactttgggaggccgaggtgcacagatcacctgaggtcaggagtttgagaccagcctggccaacatggtgaaaccccatctctatcgaaaatacaaaaattagctgggtgttgtggcgcacacctataatcccagctccacggggggctgaggtaggataatcactggaacccaggaggcagaggttgcaatgagccaagatcgtgccactgcactccagcctaggcgacagagcgagactccatctcaaaaaaaaagaaaagaaagaaagaaagaaaaagaaataaataaataattttaaaaagtagttgtaagacccagagcaagttcacctttctgttaccagggcaacctcagtctcttcatctgtaagaagaagatagtaggagtccccaactcgtagggtcaatgtctagactaaatgagatcatgggggcaaagcattggcatacattagctgttcagtgaagccttcttccttcttttcccacttgatacgggggaaactagacacaaaaggaaattctcttgattgcctgcaagctcttgagggaggcagaagagagggcagaagtcacctgatactcaaaccatcttagttttttacccgtctgctagggtctcccttgacctttgccacttcatttctctcatatagtttctgaaacctcccagcagtgaagtgctgtgcatccttggggctggggtccaggcctacagccattatgagatcttcacagagcagttctcctttaaggaggtaagtccaggggtgggggtgggagagaagagggaagggggtggtccttgacctgtctatactgcttcactgcaccacaggttattctgaaataattaagttgtgagccccatctagaccattcttgtatcttcatgacttcccagaagccctgatggaggggatggaggataagagtcaggggaagatctgattacctgtttccagtcctcagttcagagggcatttgtctgaggatacagcaagcttactcggttaaaagattctattatatctcttgtatacattcagttgtccttttagctcctgtctattatgtttttcttaggagaatccagagtttttaagtattcaaggttatggatcaagaaactgggtgggatgagacctggagaccaggaggccacagcctctctcttttgcagtctccatactggtccaccttccccccactgcgtctcatgcttccccctgggaatttttgatgctattgttattttatgtgtgtgtatgaaagggatggagcagttttaaagtatgatttaatgatgaaaataaaaccactgccttgagaaatatagactattaggtgagtgcaaaagtaattgcagttttggccatgacttttttttttttttttttttttgaaatggagtctcgcgctgtcgcccaggctggagtgcagtggcataatctcggctcactgcaacctccatctcctgggttcaagtgattcttgggcctcagcctcccaagtagcttggattataggcgcccactaccacacctggctaatttttgtatttttagtagagatggggtttcaccatgttggccaggctagtctggaacttctgacctcaggtgatccacctgccttgtcctcccaaagttctgggattacaggcgtgaaccactgcgcccagttgccattacttttaatacaaggaagaaaacaaaagaaaaatgccctttcatctgttttcaaagacagttaatgttttctgatcttccctcttcagctttttataacatagctttagtcacgttagatatgcaccattttatatcctctcttactgaatgttctaacatcacttttcaggttatctaatttttgcataaaatttgcatagtcttctatcaagaagggtgaagaggttaaccatgcacttccggccgggcaaaatgtcctgtttttcaccttgcttggtgaacttgcttagacataaagtttgtttccgtatgtattatatttccttatgagaaattctgtaggccttattttcagttgacgggtgacaagcccttgacccaaacattgaaacctgtcaagcaagtcggcaagtccccagctcctggtgaggccgctgccccaccctccaaccccagcacctttcaggattccagccgtagctaccattcttggccttttcattggctatgccatttaccttcaaactcgtctgatcttgaatttcctaagtattcttcaccgatcaagttattccatgaaaaacattatcataaataatccttcatatgaatctcccacccattacaactcctttacggggtctcagacataaagtgtgagttccacacagactttgccagttatatttccattttacagatgtggaaactaaggctgaatgacatgaagcaatttcaggaaatagcagagtggagattggttccaagcctacctggctccagaacttgctctgctaatcattatgctattaatatataatagctatgaagttactgaggctgtgcctcttggcctagaagtgaaatacttccactcattttaaaaggggaaagtggtagagaacgctgattttcaaatacctggctaggtgtctaagttaatgctgtacccctgatcaaatgtccattctccatggggaatgatttaggagtgatttagataaccactgacccctatgccagagtagttcaactttccctccgcatccctgggctcagtgtaacataagcagccaaaaaatggcgccaatatccttcttgttactcccaatgaaggtgaggatatggaaccgcaccaaagaaaatgcagagaagtttgcagacacagtgcaaggagaggtacgggtctgttcttcggtccaggaggctgtggcaggtgcagatgtgatcatcacagtcaccctggcaacagagcccattttgtttggtgaatgggtgaagccaggggctcacatcaatggtaagtagagtggctccataaggcatgatgggtggtggccaggctcctctctagacgggaccagtcgactacatttgcagagccagtttattcatgcagaatgcccaagctatttaagggccttgaaaacatgtgagattgaaaaaaacaatatttggctgggtgcagtggctcatgcctgtaatcccagcactttgggagactgaggcaggtggattgcttgaggccaggagtttaagactaacctggtcaacatggcaaaaccccgtctctactaaaaatacaaaagttagccaggcatggtggcttgcacctgtagtcccagctactcatgaggctgaggcatgagaatggcttgaacccaggaggcagaggttgcagtgagccaagattgtgccactgcactttagcctgggcaacagagagagactctgtcttaaaaaacaaacaaacaatatttgctccaagaaatgtaaaagggaaattacaaacctgaaactaaagaatatttaatgttctataaaatgtaagttttttttctttttttgggacagggtctcactctgtcgctcaggctggagtgcagtggcgagatctcagctcactgcaacctctgcctcctgggttcaagcgattctcccacttcagcctcccgagtagctgggactacaggcatgtgccaccatgcccagctaattttttgtaatttttggtagagacaaggtttcaccatgttggccaggctggtctcgaactcctggcctcaagcactctacccacttcagcctcccaaagtgctgcgactgattacaagtatgagccactacgcctgaccataacatgtaaaattatggcaaatggtaattcacagctcaattctaaaatgtgatgaaatttaaatcagaaaggccaaatgagtcactttttcttaacactaagaattataaacctttaaatttcttttgtactgtaattttttatgtgacatgtatatgctttttaatatgtgtgataggatgaggggcaggagagggggctctagacatgagggtgcctggggcctctgtagaccttcagatggccctgggtgttatagcaagagctggtctacatctaatactactgcaggtgctgtcatgaattctttgtataattctttgtatattaaatgacattattctatgtataatgtcatttaatacttataaccaacttatgaggcaggaactattatcataaacattttatagggggatgaaccaaggcatggagaaattatataacttttccaaagtcacaagtttttgtttgtttgtttgtttgtttgtttgagatggagtctcactctgtcacccaggctggagtgcagtggcatgatctcagctcactgcaacctccacctcccatgttaagtgactctcctgcctcagcctgccgagtagctgagattacagacacacgccaccatgccagctaatttttttgtatttttagtagagatggggtttcaccacattgtccaggctggtctcgaactcctgacctcaaatgatccacccgcctcagcctcccaaagtgctgggattacaggcgtgagccactgtgccaagcccaaaatcagaggttcttgatggcagagctgggatttgaacggaggcactctatcctcagagtccaagctttaaatgatactcatgattgccttccaacaggaagactggattctggtgagcagagcaggcaaattttagaggatttaaagatggtcttggtgccctgtgttttagtgacaagcacatggtgtgaactcagaagctaagagctttgcacacgtgggcagatgagccggcgagagccaagtcaaatgatgacgcattcaatcatacatgctgactgaatctctaccgtgtgccaggcactattctagatgccagggatgccacaataaccaggcagtcaaggtcactggtttcatggtggttaatttcagtgaggagagatagacaacaaacaaacacatagaggaactagatcgttctggctaaagatgagaccggaaagaacaaggccctgggtgatagaggctggtggtggaggtggaaggtagaagcagagagaggtgttttcaatagggttatctgagaagctctctaagatgtgttttttgagctgtgacctgaatgaggaggaagagcagccatgccaagagctgaaggaaaggcattcagggtagagggcacagcagatgcaaaggccttgagtgtggaagcgaacatggcgtgtttgaggaatggatcaaagtaatttgaaagtctcaggctgcatgggactggtggtcagactgggtccagggaatgggtaagaggtaagtcagggctgagtttatggacaataagaccatttctggaaggacctgggaaatcaaaaggaaccagttcatggtgaaatgggtttccaaggctgcatcttcagaaagatggacttgatttttttttcagcttaaaacaacacattattatcatctcacagttcccgtggttcaggagactgggtgtgggtagctggatcctctgtgcaaagtctcacaaaaaagaaattgggcaacatccgggctgcaatctcatctcatgctcgggggtcctcttccaggctcccatggtgtggcaggattcagttccttacactggaggatggggggagcccctttccttggggccattctcagctcccagagatgacccaaatttcccaccatatggactctccatcctcacatccagccacagacaatctcccttatgttggatccctctctcacttggaatcattctccaggaagggctgacttgattttgagtcaaggcatctcttctgttttcctggcccagggacaaaattggtttatgtgttcacagaggcaacacatacatttaagaaaaatgtgtcacaagcgcagacaacagggaaataccaacaacagattttacttagtttacagctcagcggagggacaggcccagttccaccctgccccatgcctccctcctcctgcccccacaccctgtcaagcctgtctgcgaccctcactcatttagccccatcacaaccaagccagagccttgtttgagtcaggcttctctctctttactgcctggcccacctccatccgcctgagtgacctcacacaaccctttgagaactcgcccggctcataagcagtggttgtgcaggggaaatagtccagtgagaaggagtggcctgagaaacgggggttttgttcccaccagcttatgatttatttacaagcttccttaagctagtgcttttgttctatagaactctccgcacaaacaaccttcaagatggacatttttacacaactctctttggaaattagaatgagggagaacagaacgggagggaacaaagggagaaaacggggcggcagtggaagaaggcatataaatgctgtcttatatttgtataaggctttatagcagttttcaaagactagccagccaggggctggatccagccagcagatgtgtttggtttggaccatagagtaatctaaaactcaaggagtgacatatgcaaatagatttcctgtttctcttctaagaaaacaactggggcatatctggtaacagtggatctacattcacacgtggtaatgattagctggagctgaacaatgactgtccccttcggaagggcctgctggcttccccgcccctcagtctccaccacatctaatccagtccctctgaccagctttgttcattttcattacctccctggccttgcaggcatttggtggcagcctctgcattctcctgtgtcctggtgccagggggcgtgacaccttggattcatcattctggtcctggactccatagaggatgtgacagttcagggccaggacggagccagttttctttctgacgagacttctccatgaccctgacactgagtttttgttgttgttgttttttttcttttgtcatgagttaagagagaaccgggggtgaggagagggaaaggggcatagtggcaggcgtctgtggtcccaacagtttgggaggctgaggcgggaggatcacttgagctcaggagtttgaggctgtggtgagtttttgtttgtttgttttttgagatggagtctcactctgtcgcctggtttggagcacagtggcgcagtcttggctcgctgcaacctccaactcccaggttcaagagattctcctgcctcagcctcccaggtagctgggattacaggcgtgtgctaccatgcccagataatttttgtatttcagtagagacagggtttcaccatgttggccaggctggtcttgaactcctgacctcaagtgaaccacccacctcagccttccagagtgttaggattacaggcatgagccactgcacccagcctgtggtgagttctgattgcaccactacactccagcctgggcaacagagtgagaccctctctccaaaaagaaaaaaatagatattaaaagaactggttgagggtgaggaatgggaatgatggagatcaagaggagagtgaggtgtgaataagcaccaagtgatgtctctgtttcgggatttttgtgaggaaggtgttcctgttaagcagaagaggtgtgagcgcctaggtgctctctcagacctggattcacccatcagatccttaaccttggcaaacaccttcacttctttgagcctccattcgtgcatctgttaagtgagaaccagactttgaaatgtacttgcgagaaccataaatagtacgtgcaaaacatcccacagagagtagacaccctgtaaatgaatgctatgtcgtctcaaaatcttttagcaatgaggtgggatatagaatagaaaggcaaaatggtaggtagttttttttgtttgtttgtttgtttttttgagatggagcctcactctgttgcccaggctggagtgcagtggcatgatcttggctcactgcaacctccgcctcccaggtttaagcaattctcatgcctcagcctccagagtagcaaagactacaggtgtgagccaccacgcctggataattttttgtatttttagtagacacagggtttcaccatgttggccaggctagtctcaaactcctggcttcaagtgatctgcctgcctcagcctcccaaagtgctgggattacaggtgtgagccaccacacctggcctatttcttaataagtatttcgtcctactgattgggagagcatggcctggggaatgagggggtattttgaatctgagtgtgttcacgagtcctttgttcacctctctcctgtgctttgggcttcttagcagcctttggcactaatcctgggcttaaggtctgttttgctgtctcttagctgttggagccagcagacctgactggagagaactggatgatgagctcatgaaagaagctgtgctgtacgtggattcccaggaggctgccctgaaggagtctggagatgtcctgctgtcaggggtgaggcccttctgaccccagtcagggctgccacctggctggcctcacctggatcccagggtttcattaacttcccttccagtttggtctgctccagacctcagccaccccacctccttgtaggggaaggagctcctaaacattttgcaaccctctttaattccattccagaaaaatatgggcattatgggtggtgacatgtgtgttcctggaaggagaagctcagtggattttatttttttgctgggctgtcctctaaagaagtgggattggaagcttcttgcagcctggaaaccttcccaatgtggccaacatgataagactgtgttgcccaccttctggcctcattttacggttataatcagcataaaacaagaagggagctgctggcatgcatgttcagataacagcatgtctatttcctcactgacacaatgatcttggcaggacagctccctgagcaccaactcgaatctctgtgtttatggtatcacaaaagcaaatgccaccccaaaaggatttcggggccagcctcctccctaatatcattcagtgtacaaaggatctctctctttttttttttttttttaatcaaatttatctcttatccaattcaggaattccctgggctggcttcaaaagccaaccctgcacagactttagcttcatgcctgggtcagcgtatgtttgtttcctaggccgagatctttgctgagctgggagaagtgattaagggagtgaaaccagcccactgtgagaagaccaccgtgttcaagtctttgggtaagatccattgctccctgggcacaaatccaactagcgcacaaggcaggttcacccattggtggaaagagcaatgagtcaccagactctgcagctgaatcattgtgctccatcattcaggtcaattatttacatggtttagcctagtgctaagcccatgaactctggaactgagcagtcctgggtcagagtcccttccccgccactcaaaggcaggtgtccttaggcaagtgatctgacctctgtaggcctcagtttcctcaccacctgttaccattgaggattaggtgggatttgcatataaaatgaatcagttcggtgcagatcttgatgaaattcagaaggtacccttcagaggtggagggggcaggggacaaagatgttaaaagacaggaaccttaagggaaatggcagagacccaacctgaaagagtcagatggaaagtatagcctaagccctgttcattccctccttccctactctcccacttgctgctttgaggagggcttccatggggagccccctaccacctgagttgtatggggtaccttatagaagcccaacaaagggtgggctcccagtggccagtctgtcccttgccccaggtcctcttccaccctatgagattgaaggaaacagaagtacatgggaacaggctgagctcggtggctcacgcctgtaatcccaacactttgggaggccaaggtgggcagatcacttgagctaaggagtttgagaccagcctggccaacatggtgaaactccatctctactaaaaatacaaaaattagccaggcgtggtggtgcacatctgcaatcccagctacttgggaggttgaggcaggagaatcacttgaacccggaaggtggaggttgtagtgagctgacatcgtgcactccagcctgggcaacagagcaagactccatctcaaaaaataaataaataaagtacatgggaacagagctgatacacctaaaacactgaaatactcccaaactggttggtaaacagttgctatcctgagcccctcgagagtgccctctgtccccctctcatgaccttccatacttcgtgatcaagcagcaaaagagtaaatgcctggcagagcatcaggagcgctctggccacccagagcccatgccattggttaagtatccatgccttgcaggttggtaaatgtctttaaaatctctcatgcactggaagacaaaggcaatacaattttatctggagcctggttcaaagacatcacatggatccagttttgtctgaaaacttcaaaggtcatggcagatcagaggtcagccagcccttacttaaggagccaaaatgctgcagaaacttgttctgtcctttttggcaatttttgctttcttacttttggggatcagtttattggtgcattgtttcatctaacagatgcgtatcaagcacctaattatctgtgctgggtgcagaggttaaggtatctaccaaaattacaagacaaaggggagatatcaaaggatgcagcattcaaactggaccaagcgtcagaaaactacagtcctggggccagacctgctctgctgcctgcttttgtgtggcctatgagctagaaatggtttttagattttcaaatgaatggggggagaaaatatttcatgatgtctgaaaatgatacaaaattcaagcttcagtcccatcaataatttcactggaacacagcccacagccaggctcttttgtttacctgttggctgtgttttctactctaaaggcagagttgaataattgtaatagagaccctgtggcccacaaagcctaaaggatttactgtctgaccctttttgaaaagtttgttcaggccaggcgtggtggctcatgcctgtaagcccagcactttgggaggccgaggtgggcggatcgcctgaggtcaggagtttgaaactagcctggtcaacatggtgaaaccctgtctctactaaaaatacaaaaaaaaaaaaaattagccaggcatggtggcatgcacctgtaatcccagctactcaggaggctgaggcaggagaatcacttgatcctgggaggcagagtttgcagtgagccaaaatcgcgccactgcacttcagcctgggcaacagagcgagactccatctcgaaaaaaaaaaaaattaaaaaaaaaaatttgctcagccctgagctagatttagaaagatgcacaatttgttggtgggtgtttcttactatcatattctctgcccctttgcagacaattgaagcctgagctcatctctgggtatcagtccctgttattccaataggcattggcaacatggacatgtatcaggaaacttccagccatggggcctgggttgtttcaagaaaagttgttttgaccaaaggcgaaccaaatttctgtctattctaggaatggcagtggaagacacagttgcagccaaactcatctatgattcctggtcatctggtaaataaaacaaaggaacttgatgttgagatggatgcttgaggaatattgctgctggttctcataatttctagagtaaatgagggagtccagtccccagtgaactctccttttgtgcttatcatgttttaccttaaatgctgagatcctcatttatgtttgtagttggaaagcaaagctaggtagccatttcttctgttctaccaagttataatagcattcatttccctttatatttccctgaaataaagcacattccaattgtgcagtg

SEQ ID NO: 36767 - DNA, 302306 bp, Homo sapiens
ccgcgctctctgatcagaggcgaagctcggaggtactggagtggggctccgggagtctggctttattttcctcctgttgtgccagggggcctgagggtgaaccctgggactctagttgtttatgaaaacgggaggatctgtcttatatatttacacggataattttttattccggatgacttggctgtgctcccctcctccttgcgaagaagttgttttctgctggtgggttgttgtaacccaatctagtgtgtgtgtgtgtgtgtgtgtgtgtgtgtgtgtgtgtgtgtgtgtgtctggaagttggtgagggcggcagggagttgcgggcgacagacgaaccatcacactctggcgtctgctctggcccgcgagtagtgtacgtggaggggtttactccggagacagttttgttaaagtcataaaagttttgctagtgtgtttctgtttgccatcatctgcctggctgcggcaggaactgccgaggctgctgctgttgcgcggggaagaatccccggcagcgcgactggagagactggggaggtcgagctgtgcgcgtggacacagcgcgcagagcgcgcggtcttttgcgcgtttgtgcgggccgcagccgcacgttggcaccgatggaactggggtcagtagagtgacagccaccagtccgcatgaactggggtaagtggaaattgtggcgagccgacctcccccagcttttgacacactagtggttgtaaaatcaaccaggcttaaagttttgacagaactgccagaggctgcgggtcaatggggtggccgcgtgtctagggagagggcgctggcggcgcagagggtgcggggcagggcacttgcgagtgcgtggggaagtctatttggggcgagtgctttatatatagcccgaggggatgcctgctgagaccgagctgcgggggctctcggtctggcgcggactgtgtgtcctgaatgagtgtacgtgtgcgctgtgtgtgcgcgcgcgagtgtgcgcctggggaggcgtgtcggcgcctgagccagtagggtgtgcagggtggaagaggccacagaggtgccgcctgtctgtttgtgccgccaggagaccttggaagggacagagaaaggtaacggaaggccaaagtgttgggaagtcagagtagtttctgcataggattaagtattaagggctttaaaataactaaacgcattgccctgagtggctgaggactggaagtgaggttttggggagttctcaggagaactgcatgggagggcgtttgggaggtctaagggatgtgtaatatgtgtgagtacagaacttcggagacagacacaggttggagctatgaatttgaaattttcagggtgctgctgtccacagtccagggactggctggtttcagaggtattcaggctccctggtgtgtgtgcctgggaagacactcatcttttcttgcagacatgggatattgtggcaggtcaggctctgtttcctgagcaactggtgttccaggctagtttccacctgaatcaccctagaagtgtcttttttctgatgataaatgttgaaacctttccagaaattaaaatgctggatagaaacaaaattgatgcagcagacaggattgttgattctatttattcagtgattgggagctctttttccttttgagaaaagcaaagctcagtgtttccagattagatttcaaggagtcttcagctatctacagcttcccttctgggcctttggatggagctggaaggatgtgttttggcctaaagacctttggaagacatcatgtgtagcttaaagaggttgtcccgtctctcatcatcttcttccacccttataaactttttgttttgcattaatctaaggaaagttggtgtgtcaacatttagcttttttttattggagtaaatatatcacagtgaaattatagttatggtctcctgaagcccatggaaagccaacacttaatgggcaaaggtgtgaaatgaaagtctataaatgcaatgacaaagtgacgagatgagtgcattcttttttcaaaatgaacataactgtgctcacaaaaatttgttttagccaggctttgggcccatgttttttattattagtttttaaacagcagactccacatcataaaccactttaaaatggatactagaggcctcctgtatgctatctctggcgcctgcttaaacagatgtttacagtgcttggtaacctatgggattgtcatgttgagtatcttgttagctcaggacataatgtttatagcataatataataaatggagccacagttgcagcgtgcttcttccaagtgcatgaagcaaatcttgcagcagggaaacaaatcttgcagttggtccaacttggctagccttctttggctatctcctggtgagcaatgttaatgtaaagataaatgtgagtgacgtagtgagaaagtgggacagtaaattgtttagcttagtgaaaaaagcatggattatgttttttaaatctgctaacctgaagattacacttctcaggtcgtaccactggcaaattgcacaactatgggaatttggtttgcttttaaagagcaatttttaaaaagtatgtcagtaatgaaaataacttatatttcttaatgtgtttatgtgtgtccatacaagccaatactttttcttctttaaaaagaaccctataatttctgtggtaattatttaaatattatgagcattcaaatctcctaatcaccttttcaatcttcaattgataagaatcgaagtttggtaagactggagtcatccctcagccaattgtgtaaacaagacagtacagaatgtctttctggcaagtaatttttttcaacctgaaacagataatataaataatatgtcccataaaagaattacttaagatgataattactttagaggtaattatctggtgcatgaacctctatctgtgaaaatggtctagtctatctcttattggaaataatcagttggaaatctccctttttcattggtcagtccattctaggaaagattcatttctagaaagttcttatactgaatcaacattttcttccatccacttgcctatccttcagcagctgaccacaatgaatctagtctcttttccctgtgtttaccatacttgaaaacaaatattatcctccttgccgaatccccttttgcctactcttggagcagtttttcatccactatagggttccaccctcctctgccttgaacaagatgcccttgattgtacattctcattgtattagtctgttctcatgctgctaataaagacatacgtgagactgtgtaatttataaagaaaaagaggtttaatggattcacagttccacatggctggggaggcctcacaatcatggcggaaggtgaaggaggagcaaaggcatgtcttacatgacagcaggcaagaaagcatgtgcaggggaactgccctttatagaaccatcagatctcattagacttattcactatcatgagaacaacatgggaaaaacccacttccatgatttaatcaactcctactgggtcccttccaccacatgtgggaattatgggaactacaattcaagatggcatttgggtggagacaaagccaaaccatatcattccgctcctagcccctcctaaatctcatgttctcacatttcaaaaccaatcataccttcccaacagtcccccaaagtcttaactcatttcagcattaactcaaaaatccacagtccaaagtctcacctgaaccaaggcaagtcccttccacctatgagcctgtaaaatcaaaagcaagttagttactttctagatacaatggaggtacaggcattgtgtaaatatgcccattccaaatgggagaaattggccaaaacagaggggctataggtgcaagtccaaagtctaatagggcagtcattaaaccttaaagttctgaaatgaactcctttgacttcatgtctcacatccaggctgttttcatggctggcattgactgtggcttttccaggcacatggtgctaactgtcagcccctaccattgggggtgctggggaatggtggccctcttctcttagctctactaggcagtgacccactggggactctgtgtagaggatccaaccccacatttcttttcctcattgccctagcaagggttgtttatgagggctctgcccctgcaggacaactctgcctggacatccaggcatttccatacatcctctgaaatctaggtggaagttcccaaacctcagttcttgtcttctgtgcacctgcaggaccaacaccacatggaagcttccaagacttggggctttcaccctttgcagccatggcctgagctgtaccttggccccttttagacatggctagaggggctgggacacagggtaccaagtacctaggctgcacctagcaggcccagaaaaccatttttccctcgtaggcctctgggcctgtgatgtgaggggctgccataaaggcctctgacatgttctggagacattttccctattgtcttggtgaccaacatttggcttctcattacttatgcaaatttctgcagcagtcttgaatttctccccagaaaatgggtttttcttttctatggcatcatcagcttgcacattttccaaacttttatgctcttttcacctcttgaatgctttgctgcttctaaatttcttctgccagataccctaaataatctctctcaagtttaaagttccacagatctctaggacaggggaaaaatgccaccagtctctttgctaaagcattaacaagagtcacctttgctccagttcccaacaagttcttcatcttcatctgagaccacatcagcctggactttattgtccatatcactataagcattttggtcaaagccattcaacaagtctctaggaagttccaaactttcccacatcttcctgttttctgagccctccaagtctctagaaagttccaaactttcccacattttcctgtcttcttttgagccctccatactgttcaaacctctgcctgttacccagttctaaagttgcttccacatttttgggtatctttacagcagcaccaactctaccattaccaacttactatattagcccattctcatgctgctaacaaagacatacccaagactgggtaatttataaagaaaattaggtttaatggtcgcacagttccacatggctgggaggcctctcaatcatggcagaaggtgaaggaggaataaggcactcttacatggtggcagacaataaggcatgtgcgggggaactaccctttataaaaccatcacatctcatgagacttaatcactatcgcaagaacagcatgggaaaaactcgccctcttggttcaatgacctcccactgggttcctcccatgacacatggggattatggtagctacaattcaagatgaaattggggtggggacacagcaaaaccatattactgactgtccctcctaatgtgtgttttctaaacaaaagatttataatttgtagttctgaacattctatatctattaagacagtttaatattaatgaaattctttagccatttcattacgctcttgattaatttcatacctataaacaagataacttgttcttttcagattattaatcatccatagtcaaagcatttttataatagcttcaaaacattttttcatgcctgaatgtactataaatttatggaaagtataatactgtgtgggtaaataaaattctataaacagtgcaaatagtgacttaatttctccctatcaaggaatatcaaccccaaatataccgaaagtagaatgttccaaagataaacaagttgaaactacatgttatagacaggtagggactatgatgtatttttttcataggcctcattgtgtctgcttccatgaacatgagtcagtactagcaatcaggcatttattgaaggcttgttctgccaaagtcccagagagtatgccatctggccttaaatgaagtgaaagtacatcaaataaagatacttccttgggcaactgggatttaagatgtgcatgcaggacatgtctaagtcagccatctactttttctcaggaggtaaatggcttgccaatgccacaggaaagtctaaagtgttcacactccataagcaggtcccatgtcctgttgtaggtctggacaggagctggacaaaggccctgttactcttagcttaccaagtcttagctgccttggaagaagatagcaaatctggcttatccagaggagaggcctgaagtgtgcattgggcacctacctggtgtgactgatttctcttttatgtatctgtcttgggcttccagctaaattgtgaattccccttgccaccaagctaagaatctgccacagcattgtcttcctgcacacacacacacatacacacacacaaaaacatatatgttggatgatgaagagacaatgtcagtttttcagcaagtctgaatgtgaaacaaatggctatgtttcttggtgcagtggggtgggaggatgagagagaaaaaacaaacctgtgatataaactgacatctgagcctaccaaaagccctttgagagacctttgatcaagacaaggggataatcatagtgttgtgcacttagataaaattgtccatgctagtcccgtgtgtgtgtgtgtgtgtgtgtgtgtgtgtatgtgtgtgtttcttcactttatccccagcattatggtctcaattcatacacatttgcttttttgctttattctagtctgatatgaagggaagaaataagcaatgattcagttcctttttttacatttcaaacattcatttcactactccccacctcccagtcctcaccccccaaaattacaagagacccattggcaagtacttggacatgcaattttcaaaccaaaggtttactttgctataagaaacgtctaagttaggatgatataatatgaaataatagtaaattagatgtcaagaaacttgggtcctctccaagctctgcctttaatgggctttgcagtttttgccaactatttaaccttcctgggcttcatatttcttgtatgttaaaaacaagcaaaaaggagaagtaaacaaaatgaccccttagaattctcttcagggctattgtttgaatccatttaattatcaaatttctctcttcttttaaatgtaagcatcaaaaaatgtttgcctattttattctctcatcattaatttttaatcaattaaataaaatagataaaaattttatcaaaaccatgcttcttgctttcattctaaaacaatgcaactcatcactatctgatgcagaaagtctttctgaaatattgtttttctcttttgttgttgtttttttctttgtgctaaagaaaattcattgatgagtaccaggttcttcaaagaaggatggaaaagtcattgttttttagtctcaacttctttcttcagtgcttcttcctaccttttaatataggcaaataaagccttaggccaggcactaattttacttagtaatgattcataagaaggtagtgattttgtcagaaattgctggctgcatgcttttaatcagcatctaaacttaccttcaaatactccattccaaaatcagcagataacttcttctacagagtctttcaaacttccagatgtgtttactgttttgattagggctttcttcttttgttgttgataagacttcagccagttttctttaggctaacattattatattcccaatgaattatacttcttaggttgtgaatttgtttaaagataaatctatctccagctggctggcttctaagtaaaaaggggtatcctagggaagaagtgcacttcacagggattcagtacaggtgtagagaattccctgatagagaattggaacacatcaagagtttgcaaattgaaaaggtacttttatgtacttatccatggtggacaacctgtgtcctagggaagaagcgcatttcacagggattcagcacaggtgtagagaattccctgatagggaactggaacacatcaagattttgcaatctgaacaggtacttttatgtacttatccatggttgacaacctactgtgctagacatttgctgtagtaactccttgattttttcctcggttgtttataaaattaaacatttgaagtagcctattgaaaagtcttaaaagaagcatctcctctattcctttagaatacagtatattaaacaagtgataaagtccaaagaaaaatccttattcttttcttgctttaaaaaatgcactttattttattaagcattatatctatcttttaaaactttgaattgccatatcaatgaaagtagagtgttatcattacaaaacagaatcgcagatagttctttccctgtgcttattgagagaaaaggtgcataattgatgctgtaaatgatcatcttgaatttgatgatggctggtgagaaacctcagtcagacattcaattttgattgccattggtcagaaaggcagcctttgttcttcgtcactatgtggcacatgatcctaattcaccctatcagctgcttctctgcacactttcaagctatgtgattgttatactagaaagcctctaagttggccaaactaatgaagactaatctgacaaagcatatgtgaatgataaattctgtaaagaccgtggagatagagcctctgcagtggcttcttcccctggggatagaagaagataccagaatccctgggcaagatgaaatagataaaggaaaggcatcatttttatacctaggaaatcagaaagattaaagaaagagaagcaagaataaagaagaactactactttcatagttcattctttcaatgtagcaccttatttcccatagagacattggtgaagccatgcttttctttgccatagaataggtgttcagtaaatattttgcaggtggccttaatatgtagtaaaacatacagaaatatggaagcattgacaagaagtttgtggataatttgagggcaaaaggatgtagataggatcaggttcataatgcaaatttgctattattctccttagattaatgatgtcactcaaacttcatgacctgctttccaaggtgtatgctgttcacagccttggaaacatttagaagtttttagtacttggagcaagatggatatatgtttcacattttatctaggacttagtaggacttgggagacatatctactttgccagatcttagtatacttattatggagcatgacattttaattctctttgcttttgtcctacaaagtttagtgttttaatttatttttctcggtgcatatagggagagaattatttatataatctgaaaagtactttgaaaactacttgggaaaatatgttgaataaataagtttttttttaaattagcctacaggatgtaagtctggccaggctagtggtatttttggtatcattgtgaaaaatcaaaaacagaacatgtatttatcaatccattagtgtgttcccaggaatgtgctagacactagggaattaaaacatgactcttgactttagtaccaagcattcaagctagaaggcaacactattaatgtacattcatggtgtgattatggaacagtcgatgactgtacaacttaatgaaaagttcattagagactataaatgctacatttatttagagagaaggacaatctgtttggactgagggattggaagagtggccttcatgggcaacatggctcctgagccagtacttaagatatggtattttttttttttttttttttttttggttaggtagaagggttggagaggtttcatgcaaggagttaggaactgaggaccaggaggcgtatcttgagttcactggggttactggtaatagggaggaggcagagagtaccaggctgtggatttgttatccgttggaagctcttcccattgcttattatggtcgctgcatataggctcatcccttgggtagggctattggagtggccaccctgaccctattgctgattggatagtggtggctgctgtgtggtatttcagcacatttatcttttctgaacattatgtaaattcagtctgaaaacttctttcttaaacaatgttccaagaggcctattaaagatgccaacaatatgacttccattcaagaatatgatcttgaatgggctttacaatggcagagctgacctgagattacctcctctgctcctgctctcaagccatgtgctgatgctgacagtcctggcccaatagagccatagggcctcacagaacttgagatcatctaccagtggctgtcaaccaagccactcctttctgctaggtagtgcatagggacattgggaaatacagttattataagaactggaaagagttgtaggcttttggtgcctgaagtcagaaatgctaaatttctgtgatgccaggggcagtcctatataagaaattattgtgcctcctcaaatgccagtagatccctattgaaatacttgagtctcatatcctcactttatttataggtgaggaaatgggaggccctgagaagtgacaaaactttcttctaggattaaacttcacagtctcagtgacagatttataactcaattcttttagttttctttcaagagctcttgttgcagcaccacagtccctcctattaacatgggctataactatggaatagcatgttgtttatctctgccatttttatagaaggatgatagttagctatgttaactatctgaatgggtggaatgtgaattgagataactggtacttgaccagcagttctttcgcctgggaacacacacagattcacctgtaaattagggttggcagatgcctgttgagatgtcaaccatagccaaagcttacaaattggttgactttttggaaagggcatggagtaggctttggattcacacaaatctgcttgtctgaccggatttgaatacaacccttcttatctttactatctttgtgactctcagccaattaaactctctgagctttatctgcaaaaaaacagttgattattcttatttcacaagcaatgagtcaaaatagtgcctggcacatattgggcactgcagatatagagaattccctacagtatctttttgagcataaagacttgaaaccttcacttataaaagaccctcttgataacagtcgctatttttttctcctcctttccccaaacaacgaaactagggcttcagtgagtccctgaagtgtttactttgtttgaactgttgagatttccctcctccagaagagtcctgctggccagagatgagttccttttgacttctctgtcaacgtgcctgtattattgtcacatagtaaaaatgaaagatatatctagatgattattagcaggttatgaaacttagattttaaagtcaataataaaagccattcctgggtagagaagtttttcagagagatttctaccttgccagcgatgagagagcctacttaggtgaggtgaatactttaggcaagttaagggataacacaatataatttatttaagtaagttttttatctgggactaatttcaggtttgcagaaaagttgcaaaaattttagaggtcctgtatattcctcacctagtttcccatgttgacatccataatcatgatatatttgtcaacactaagaaaccaatgttagtacagtactattaactaaaatccagacttcatcctaattcccccagagcttccactcacatcttcttttctgttccaggattcaatccagaagcgtgcactgcttttgattttatgatttttaaatactgtgcatgtgcttttttaatttgggccctctcatgtgttaaacttaccggcctttgtaaccagatagcaagttctgtaacagaaaatacaatgatgttgaatccaacatcatgctgggcacaaagtatgttctccaaactaattaaatttatcacagcaacaagaacaaagttttactcagcgtacatatgtagctgagtcctcattggtaagctaagaggtagtcataagagtgggataacttggaagaaatttgattttgaatgtgtgccctgaacattggtataaaacaggaccccctaaatcatatatgaactgagtctgtacactgtgcctagcattgtgtgtgcatatcacacttactcctgataactgtaaggcacatagccttgagtaacttagctgaggaaatgagaccaagggaagttaagttacttggccagggattcacagctagtaacacagctgagattaaaacatatgtttttctggcttcagagcctacactcctaatgctgtattcaattactcccacacttctccacttgcttaacccctattcttggtgtcctttttctaggtatacagaatttgaaaactatattgtcaaactacagcagacctggatgcatggtatacacttctttgtgagctggattaagtttcagccttgaatttgtggattattttcaaaacctgcctaacatctgtaaaacatgttgtttttttaatatgtagatatccacataaattgaccacaatgctcttcagaaagtcccataatccaataataaataaatttttgatacatggctaataacaggcacagaagcatctccaaaggacaggacattgatattgtgtaataatttaaagtattttatgattgtataatgtgcctgagttttggatagttgacctctatttctcagtctttacatagttactgcttttttaagtgttacatgagggatgtggaatattcagtgtaacatttgactaatctttatgttttgagtggcccaactgaaaattacccttggttgccttggaactctgggcatgatgttcaaaactagaaattcttgcaaattatttgagctttggctctgggaagataaacaacatgaataactaggttaaccagggctgaaatttctctaacctataattctaaattcagaaaagaatgggctttagggttttttgtttatttttgctttgattacaagttgttggaagcctagagttagtatctaataacacaatctatgtaaaacacaaattattggctcagaatgatatctaatttctaagaagatatgaggaggcaatcatgtaaaaacgtgcttttcttcctagaaggaataagctgggattggccaaaaggtaatccctttagagtctaatgtttagagcattgcatatttttaaagaagacatattaccttttagaacatatgtaggaaaccattttctttgcttatatggctacataaagttgtcatggttttaaaccgtgaccttagataccttatagaagtaattacaggcacaatctgtgaatgaagatttgcaaactatgcttcaccaagcctcagggactattggatgtccagaggacagagccatgttggatgtcttatgggccttcagtcctgcaaagtggtgtgctttcatgttttacacacagcagttctgagaaaatttaagttgaaaaaacagcctctcttcttattatttttatatttatttatttatttatttatttatttatttatttgaaacgaaatcttgctgtgtcaccaggctggagtgcagtggcgtgaacttggctcactgcaacctctgcctcccaggttcaagcgattctcttgcctctgcctcctgagtaggtgggactacaggtgcaggccaccacgcccagctaatttttgtatatatgtatttttaatagagacagggtttagccaggttgcccaggctgatcttgaactcctgagctcaagtgatcagcccacctcagcctctccaagtgctgggattacaggtgtgaggcaccgtgccgagccatcctgtcttctgaaaaaaaaaaaaaagcaaacaaaaatgtttaagcctggtatatattttcttatattgcataagctacttttctgactgcctctctttagaaattcctctgatttctagagaaaaaaaaatcgcattagctttttggtttctaaattcaggctcactttagtaactgctagattataaactcttagaaggcaaagggctatgtattctctacttgtggacactcaattagtttgcttaagcaattacttctgtgtaagcaacattaatgaagtgcttactatgatcaagggctataccaagtccttttttatattatttaatcccacacaaaacccatgatcgacctaattgtacacttggtgaaactatgatgtagggaggttaaataatttgttcaagaacccacagctggtaagtcgcacagtgtattcaaacccagatcttcctaattgcaaatgtgtccaactcccatgcttctaaccactgcctatgtgatggttctttgaaattcctccctccaagaagtggaatttaattccccccgtccattgaatgtgggccaaactcaggtgactcatttctattaaatggagtaaagtggaagtgaagatgtgtggctttagcgactaggtcattcaaagtggctcctgtcttggttgttctgtctcttatacctattgggcatttaatctggggaaaaccagctgccatgttttgagctgctctgtggaaaggctaacatgaaaagatactgtggatcctacagacagcttcaaatgaggacctgaggccctcagaccagtagccagtatgaaactgaagcctcttgaccacagcctccatgagagtaatggaatcttgaccccctagtgaaccacagcctccatgagagtaaaattcaagatggagccttgacacccagtggagcctcgagatgactgcagtcttccaccaacagcttgattcatgaaagaccatcagccagagccacccagctaaggtgattctaggcccctactcctagaaaataaatatttgctgttttgactgccaagtgtttgattaatttgttacgcagcaatagataaataatgcagcctaacactgtcctggtcatttttaaaaaagaaattgttttaattttactaaatcacaaattttaaaacattgatacagcaaggagaaactttccagaaaaaaaatgctgccaaatttaagtagtaaaatattaatgtccaaaaaacatcatagttacaatgacatctctaggattgaggattttgtaagtcaaaggtcagctgcttaaaaaacccataattttaaaaggaaggatattaataataactgcattattgaacatagatagcattttgaacttttaagaaatcctcatgggaaaactcaggaaataatctgtttggtaagttatcactcataatcttaaattgttaggtgcatgtttgcactttccatgatttgaagaggaatataaagcaaagttgaattttaacctcttccctaatgattttactcagcttttcaaaggggtcctaaaagctcagaggtcaagtcatttcttggtttgctctacctgacaaattgcattaactctgctttatagccacttgcagtttaataaatgacttggactttgattaatatctttagtgcttaagcccaagaatttgtataagactttgggatatagtactgtaaatttatctaaagatggacactggaaggtagaaggagatatattagtgttggtttgggtacatgtctaggtactgaatttggatcatcataagtccttacagaagatacttgttgacttgtcttttaaaaaatatgtgaaagtgattttttaatatatttacaaagtgatctaagtgatttaaggaattcattcatgaagtggatatgactagttcttgtttagtattcagaatgactgtaaaatagaaatgctgattttccttgcccagattgtagaacacagatcaaaccctcctagtccttcccttaaatgttttttctccatacagcttatgccctgagttctcaaaacattttttatattgaactggactgtatagtatatgcctgaccctgattcatgggattatgctgcaagggaatataaagatgaatattgatagcctgagtgtgaaaattcatcattactctcatcctcattcattaattcatttgttcattaactcataaacacactaattgattcaacagatatttattgaacgtttacactttgcccagtggagcactggactaggtgctagcatagtataataagcaacccagaaatagcctctgccttgctgcatttcatagtctaggacggagaaaggcattaaccaagtataatttaaaattgttttaagtaatgtgaaataaacatatatgagaacttgactcaggttggtatatttgatggttagggaaagcttcaaaaatgggatatttgagatctaagtaagagggaaaagaaagagcataatgggtagagaaaaaataggatccaggaagatacttagtacttctgagaactaaaaacagtcaagtcagtgtagtcagagttcaaagaaggagaaagaacatgatccaagaagaagccagaaaagtaagcagggactacatcttacacgatgatgtaggctgtattttagtttttacttatcttaagagcaatagaaaaccattgaagggtttgaagcaggggagtgacataatcaggtctgcattttaaggaggtcacctgctctattatgaagcatgaatggaggaggatggaaagagatattcagggagctggtttatgagtctgttgtaggccagaggtattggtagcttggaccagggtgatgatgctgaagattgaaaggagttaatagatttataatatatttgtgaagtaaagttgactgtacttagtgctgacttagatagtactggtgagggatgtcatggtaaactccaaggtactgggcttcttcaactgagtggaaaacactagagggagaccaggtaaaggttgaaggaaagtgaggaacagtagttcagtttggggatattttgatttggaggcctttttaagacttcctcaaagagacacagtgcagtcttgagtcctggatcagaggagatacctcaatgtataaatttgtaagacaatggtttatacacactattaaagccactgaggtaagtgagatcatgtacagagtgaaaatgaagtgagagaagaaagcataagtctgagccatgagaactccaacatttaaaggccaagtggaaaagttgacaagagtgggaattgtgactggggtagatgctagaggggcatctcagaggccaaggaaagagaatcatttaaggtgctgatgaggggtaaagtaagaaggtcctgtaaatgtcctcttggattaataaatttgatgttttgaaggactttagggagaatgagtttgttgtagtgatgggggcagaagccagaatgaagtgtcatgggaaatgggtggaagtcttgaaagagagacaatgaatatagataactcaagatatgtggtcaagggaaacaaaaaggataaggctttaactagaggaggaaatggagttaaaggaggagtttttttttttttgagacggagtctcgccatgtcgcccaggctggagtgcagtggcacgatcttggctcactgcaagctccgcctcctgggttcacgccattctcctgcctcagcctcctgagtagctgggactacaggtgccctccaccacgcccagctaattttttatatttttagtagagacggggtttcaccgtgttagccaggatggtctcgatctcctgacctcatgattcgcctgccttggcctcccaaagtgctgggattacaggtgtgagccaccactcccagccaggaggagtattttttaaagatgggagacttgagcacatttgaacaataatggggaagaccagtggggaggatcaggggtggcctgaagatagacagagggtggataaataatcatgtaggattcctgagaagatagaagaagttggatccagagcacagcagggggaattagctggccttggagaggagagatgatctctatcctctattctagaaggaagccaaaggtgatgtgtgcagatgcagaggtgtgtttgatgtggtgaagccaagtcaaaggagtttttgttcgatgccttatatctgctccagaaagcagttgagtcaccaactgagacagggagagagaaaggggctggcatactaggaaggaaaggggatcatttcagatatttgaggaggacagagtaagttggaatatgaaagggaataaatgagtgaaatttagtaggactgctagtcactgcttgaaggctcagctgaggctgatgatcatgaattcatggtactactgttagaattattataaaatatatgagcctttttggaggtgctcagcagtttaccagacacagaaaaacaggttcatctaggcttaggattttgtcagagaggtatgatgaaaagattgcaaaggagtttaggatattggcatgggcaagggagcttctggagtgataaaccaggaatctaagcctgctagggagggacatatagacaggagaaggagagtatagagatctttctgaaggttagaggaaatttgtaatcaaagtggttgattaaacaagacagaagtatagcagtcagtgatcagcccaggatgctgcaccccagatcaattaaatctgtatttctgggtgtagggcccatcccagtttctcaggagattccagtgctttccttaagggagaatattgatataactgttattaagactattgtgaaaaaacatattagcaatgtgaaatcaagacaaaaacacaaacacagaaagaagttagacaaaaacaaaaaacactgaaattacacattttctttttcacaaatcaaagtcaaattcacggaccttcttccctgactcattctccctgacattagaagtccaaagggagcaagtaaagtctttatggggaagatggtataattaagcaccaattacctagggaccagatgctttgggatttgactgatgaaaacagattagaagcatggtgaatttgttcactactgtctttttggaggggcaacactcctggctcacttggcatgaggtaatgtcagtctggctacaaagatttgaatgtggggcttgagtttctaaaaggggactgattggacttctcttagccaggatacttggacttggtggctatatcatggctcacagtgtcttggaatggtcttgagcctagttgaaatttgttgaaattacatatgaatattcattaatgtattacttggaactcagtgagaaggatcatcactgccagatttcctagttaggaaaacttaccttcattccttccagttaaatagaagaccattgtatagttcattttgggctaagtggagtgtttatgaaatgtgtagggcttataggcataactattgctaaagaaagcccagtaaagcttgacatcccctctgttgcccttgtctgtcattccataaatttaatgtcaagggcatttttagagaagatgatcacaggatgattcaggtagacatggagcaggttgtgaaaacactggcatgtttcaccaatgtattagggtttccagagaaacaggaccagtagggtgtgtgtgtgtgtgtgtgtagatttattttaagagattggctcacacaattatggagactcgcaagttcaaaatgtgcaaagtgggctagtaggttggagacccagagaagagctcatgttgcaagtcaagtccaagtccgctgcagaatttccctttgcttgggaggtcagtctttggctctattaaggcattcaactgattggagggcagtttactttactcagagtacatcatttaaaattttaatatcatctaagaacactctcatagaaacatttagggtaatgtttgacaacatatctgggcaccatggcccagccaaggtgatatagatatagatatagatagatatagatatagatatagatatagatatagacatagacatagatagatatagatatagatatagataatggatatatataatggatatataatggttatataattaaacattacacctgggaagttacagcactatcttctctggattaaacaacaacaacaaaaatactcagtccaattcatgatttgttgagggtctgtgtagaatatagaaattatactacaagtttggttttctttaggatggtgagcattttataaaatatgtatatataaagagaggcattctcttgtaacacttagaatagtcctgtacacatagaaggcacacagaatgtccagtgccagtgacatgagacttcataatgagtttgaagccaaagctttgtgtagtaaaaagccatgagcagttaataaatttccatttgatggcagctataaatattaaccagaagactcataactgtgttttcaactcacatacctgggttggggcagaagcaatagtttcagcagcttttatttatctgcttttaattccatctcaccattgttaaatttacctgaaataattgccattttgacaatgccctcaaaaatcatcttattgcctggggactgattttcagattcctgagcccagtattcagaatcctatatattccctcaacctatctttccatgtgtattttctgttgagcttcaaactgaactacctctttgctctcaacatattctatttgttaacttttgttcatgttattccctctaaaatgacttttctctaatttttttcattctctcattcttcttgtctttcgaggtggaactcaaatgccacaacgtcaaatgccacagtatctgctatgatccttcccctttccagctacaaattcctctttcctctaccacttctttggcacatttattaagactcgcgatttctctcatctaagtctcttgtgcaatgtcttactgtatgtggcctgaattcaggatctatgtctacagcctcccctttagcctcactccagtatcttgcaggtgggcagtcctctgtaaacacttgttaaaaaagtcaaaacacatttttcaaatcagaaagaacctaacatacaaagcctcattgtcatttttaaatttcatcgaagagctatacattgaattttttgtgtgttctctatagtacctagccatgtgctggacagtggacccacagtggacattcagtaattagtaatagatggatttattctgtatttaacaaaattttctggatgcttttagactgaaggagattggtttgatgacacaagtttcaaaagacaatgttattgctaatgcacattatgagggaactatgatatattttgaagtccaacaaatagaaaaatgaatcaatcacgagtcagatttattgatggaattgtgccaccatcaagtcctaaagcattagtagtgatgttatcagaaaatatcccactctgagatcatctgtagccagctttatactctaaaagaatagtctgagtatgttctgcctggaaaagggctcagtggtctaggaattattgtttttactttttcaaagtttataaacttggcatgactgtgcttttctgtggcttccaatctctggtgataagttttctcaaaatattcctgatttatcctgatgtaaatcacaattcataaatatcaagagagactgcctacagtaccatcttctgatttaaaaacacatttgaatcaatatttacttatatataatgcattctgctgaataaggaagttctgacttgttaagctcagtatgcttcgataagaaagcaaaatttttttgttgggtttttaaaatgtattttaaggtccttgtctcttggtgatagttctttacatattgaagtgccagggaataactgtccagtagctggacaagagagactcataatatggcagttgaagccaaagcattaagcaaaaacagttattaatattaacaggctcactgtagagagaagccatagttgtcaggggaggcagaactgcccaggaaacccatctttgtccttttgtctacacaggttggggcaaaagcagcagttatttgaactcagcaaacctgtgttccatattgaaggcctgcataagtcagggaccagggatgtaatgaagaccagacatggactttaggagcacaaagtgtagagataaaactgcactcataatgtaagctaatgggaggcaggaacgatggaagcagcaaagactcgctacagtgggaggagttatgagagacttcccagaagatatggcatctgagctgattcttaaaagttctgtaagaggccaacaggcagagaaaaaatgaaaaaatgctattaaacagtatagcccataaccgtggggatataccagaggatgatgtgttagggaaatggtaagtactttaaagtggctagatcagagaatgttcgagggcaggtgaagggaaaagtaggcagggttcttatatttatatcagtgatcttggactttgtctggggacctgcaggtagctgctaccagaatttcttatgtcagtaagtaacatgatcagatttgttattttagcaagacaacttacactataaagtatagagaggtgtttggagtgcactgattgaacagtagtgtggagatgtgttttttaataataaaccaaatgagtaataacatgtcttactcttacataattagtaagatcttgccagcatctttgttggatgaaaggaagcctagtgtttatcaccaaatcttttgagatgtcagtataacacaacactgtattccacttttgaaaacagccatccctatagtgtgtgaagagaatacttaaagtgcagacagacaagtgaacaccgcacttctttgtcacatgcagtcaagaaaccagacaagatatttaagctatgattattagtgttggcaagggttcagctccagggaaaataaatacattgagttagtggtggtgatgagattgacacgaatagagttgtattttccttttcatgctgttgcaagggaaatgaagctttaaacataatgaaattggttcttgtgaacagcaaatctgctatttcttcactttttatggctttgtcaacagtgatctaagttttgctttacttatttattttaaattttgttttattttaatagtttttggggaagaggtggtttttggttccacgaataagttctttagcggtgatgtctaagattgtggtgcacccatcacccaagcagtatacactgtacccagtgtgtagtcttttatccttcaccccctcccacccttctccctgagttgccaaagtctattatattattcttatgactttgcatcctcagagcttagttcccacttacaagtgagaacatacaatatttggttttccattcctgagttactttcagctccatccgggttgctgcaaatgccattattttgttcgtttttatggctgagtagtattccatggtatatatatatcacattttctttatccactcattggttgataggcatttaggcttgttccatatttttgcaatggcaaactgtgctgctgtacaaatgcatgtgcaagttgtgcaactgcctccctccctccatctctctctctttcctttcttccttccttccttcttttcttctttccttgttttctccctccctccctccctccctctatctctccctccctccctccctctctctctctttctttctttcctttctttctttcttttctttctctctctctctttctttcctctttctctagccctgccacccaggctggagtgtggtgccatgatctcagctcactgcaacgtccaacctctgcctcccaggttcaagcaattctcctgtctcagcctctgggattacaggtgcccacaaccatgcctagctactttttctatctttagtagagatggggtttcatcatgttggcctggctggtctcaaactcctgacctccagtgatccacccacctcagtctcccaaagtgttgggattacaagcatgagtcaccatgccccgcacaagtgtctttttcatataatgacttcttttccttcgagtagatacccagtagtgggattgctgaatcgaatggtatttctacttttagttctttaaggaatctccctactgttttccatagcggctgtactagtttacattcccaccagtagcgtaaaagggttcccttttcactaccttcatgccaacatctattatttttttattttttaataatggccattcttgcaggtgtaaggtgatatcacattgtggttttaatttgcattttcctgataattagtgatgtcaagcatttttttccatgtttgttgggcattcgtatatcttcttttgagaattgtctattcatgtcctttgcccactttttgatgggattatttgtttttttcttgctaatttgtttgagttccttgtagattctggatatcttgccgattctggatattagtactttgtcagatgcatagtttgcgaagattttctcccaatcggtgggttatctgtttactattattattattattattattattattattattattattgctgtgcagaagctttttaattaattaggtccaatttgtttatttttatttttgttgcatttgctttggggtttttgctcatgagttctttgcctaagccaatgttgagaagagtttttttgatgttatcttctagaattttaatgatttcaggttctagatttacatctttggtccatcctgaattgatttttatataaggtgagggatgaggatccagtttcatccttctacatggggcttgccaattatcccagcaccatttgttgactagggtgtcctttccccacttcatgtttttgtttgctttgttgaagatcagttggctgtaagcatttgcctttatttctgggttctctattctgttccattggcctatgtgactatttttataccagtgccatgctgttttggtgaatatggccttatagtgtagtttgaaatcaggtagtgtgatgcctccagatttgttctttttgcttagtcttgttttggctatgtgggctcttttttggttccatataaattttatgatttttgttccagttctgtgaagaatgatgatggtattttgatgggaattgcattaaatttgtagattgcttttggcagtatgttcattttcacaatattgattctacccatccacaagtgtgggatgtgtttccatttgtttgtgtcatctattatttctttcagcaatattttgtagttttccttgtagagatctttcaactccttcgttaagtatattcctaagtattttatttttatttttgcagctgttgtaaaaggaattgagttcttgatttgactctcagcttggtcattgttggtgtatagcaatgctactgatttgtgtacattgatttttgatcctgaaactttactgaattcatttatcagatctaggagctttttggaggagtctttaggattttctaggtatacaatcatgtcattggtgaacagtgacagttggacttcctcttttctgatttggatgcctttatttctttctcttgtctaatcactctggctaggacttctagaactacgctgaatagaagtggtgacagtgggcatgcttgtcttgttccagttctcaggcagaatgctttcaacttttccctattcagtacaatgtgggtttctcctagatggtttttattactttgagttatgtcccttctatgccaattttgttgagggtttttatcataaaagtatgctggattttgtcaaatgctttttctgtgtctagtgagatgatcatatgatttttgtttttaattctgtttatgtggtgtatcacatttattgactcgggtatggtaaacctacatccctggtatgaaaccactatatccctagtatgaaacccgcttgatcatgatgtgttatcttttttgaaatgctgctggattcagttagctactactttgttgaggatttttgcatgtatgttcattagggatatttgtacttttagttttctgttatgtcctttccaagtttaggtattagggtgatactggcttcatagaatgatttcctctttttctatctttttgaatagtttcagtatccaattcttctttaaatgtcagatagaattcagctgtgaatccatcgctcttggactttttttgttggcacttgtttttttattactgtttcagtctcactacttgttattggtctgtccagagttcctgtttcttcctgatttaatgtaggagggttgtatatttgcaggaatttgtccatctcctctagattttctagtttgtgtgcatataggtgtttataatagccttgaatgatcttttgtatttctgtgatatcggttgcaatatctcgtttcatttcttattgagcgtattcggatcttctctcttcttggttaatttcactaatggtttttcaatcaattttatttatattttcaaagaaccagctttttgtttcacttgtcttttgcatttttgttgttgttgttgttgtttcagtttcatttagttcttctcttatttggttatatcttttcttctgctttgtttgggtttgtttttttcttgtttccctagttccttgaggtgtgaccttagattgtctatttgtgctctttcagactttttgatttaggcatttaaaactatgaaatttcctcttagcatcacttttgttgtatcccataggttttgataagttttgtcatcattatcattttgaaagaatttttaattttcatcttgatttcattgttgacccaaagatcattcaagagcagattatttaatgtccatgtatttctatagttttgaaggtttcttttggagttaattttcatttttattccgcagttgtctgagaggatacttaatatgattttgtttttcttaaatttattgagactcgtttagtggcctatcatatggtctgtcttggagaatgttccatgtgctgatgaaaagaatgtatattctacatttttaggtagactgttctgtaagtacctattaagtcaatttgttccagggcatagtttaagcccattgtttctttgttgactttctgtcttgatgacatgtctagtgttgtcaatggagtactgaaatcccacactattattatgttactgtctatcttgtttcttaggtctagcagtaattgttttattaatttgggagctccactgttagatgcatatatatttatgattgtgatattttcctgttggactaatccttttatcattatataatgtccctctttgtctttttttttttccactgttgttgctttaaagtctgttttgtctgatataagaatagctactcctagactggccgcagtggctcacacctgtaatcccagcactttgggaggccaagatgggcagatcacaaggtcaggagttctactaaaaatacaaagaaattagccaggtgtggtggtgtgcgcctgcagtcccagctactcaagaggctgtggcaggagagtcacttgaacccaggaggtggaggtcatagtgagccaagattgcaccactgactccagcttgggcaacagagcaagactctgtcaaaaaaaaaaaaaaaaacctactcctgctcacttttagtttccatttgtgtgaaatatctttttccacttctttaccttaagtttatgtgagtccttatgtgttacgtgggtctcttgacaacagcggatacttggttgtcggatttctctccattctgtcattctgtatcttttaagtggagcatttaggccatttgctttcaatgttagtattgacatataaggtactgttctattcattatgttagctgttgcctaatactttttaaaattatgttattgctttataggccctgtgagatttatgctttaagaaggttctgtttgggtgtatttcaaggttttgtttcaagatttagaacacccttaagcagttcttgtagtgctgatttggtagtggcaaattccctcaacatttgttagtctgaaaaagactatctctccttcatatctgaagcttagttttgctggatgcaaaatttttgactgacaattattttgtttaagggggctaaagataggaccctgctcccttctgattggcaaggtttctcttgagaagtctgctgttaatctgataggtttttctttataggttacctgatgcttttgtctcacagctcttgattttttcctttgtcttgactttagataaactgatgactgagtgtctaggtgattatctttgcaatgaattttccaggagttctttgagcttcctgtatttggatatctaggtctccagcaaggccagggaagttttccttaattattcccttaaataagtttttctaatttttagatttcacttcttcctcaggaacaccatttattcttaggtttgactgtttaatatagtcccaaatttcgtggaaactttgttcatttttaaaaattcttttttctttgtctgattgggttaattcaaaagtcttatctttgagctctgaagttctttcttcttcttgttctagtttgttgctgaaactttccactgaattttatatttccctaagtgtatctttcatttccagaagttgtggatgtttttctttatgatatctatttctctggagaaaatttcgttcatattttgtactagtttttaaatttatttaaattgttttttgcctttttctggtaactccttgagtagcttaataattgaccttctgaattctttgtctggaaattcagagatttcttcctggttcggatccattgttgtggaactacagtaatctttgggggttttatagaactctgttttgtgatattaccagaattacttttctggttccttctcatttgggtagactattacttaaaattgtttttgtggactgtgttttttttttaatttcttattttttctttcttaagaatcagactctaatgtttattttagcctaattggagtcttggtgcttgtaggggtgaagactctgtacgagatccttagttacagaatcttcctgcactggttttccccaatgctgattttagtagttacatacttggtgtgtgggtgaattctctgtctcctgtgaagctggaatggcagggatcccttgacgcttatgtcctcctctcatggtatacagtttatttactggtcttttatttactgagttgatgattcaggcttcaggacaattggggaggtatcccccggcaggcaccagttgtggctaaggcaagtgggtagatgtaatacccaatggcgagccgaggtcacagccttgatgagggtggctggaggagctctcaattaggtgtgctgaaattttatcaaggtgaaaagtgggagcttcctcagctcccctgccaagtcagaaagaaaactattcacctcacagcctcactcctgtcctagcatttcagctattcagatcagacaggcatctcttttcatctataggaatgttgttgttccaagtagggaggaactgtgactctgcctctcatgcaggcctgaatctggggtttgctcctcttgtgggcgatactcaccctggagtgttccagaaaggctgtctacaggtgtatccatgtgtgttcctgtgggggaagccccagctgtgtctgcagtggagtgccagggggaacaaggactccttttccaaggcccttcatggtcacagaggctgcttgcctattggggtataggtgcagactttccctactgcacctggcactgcaattgggtctctgctgtgagaaactacccactagcagaaagatctgaaactcctactattcagattattttgtctcacttagtgattccttgatgtggtgttctcctctttcccctagggatgggcttcctgagagccagattgcagtgactgttattgttcttctgggtctagccacccaatggagttaccaggctctgggctggtgctggcgaatgtctgcaaagagaccggtgatctgatcagtcttcaggtctcctagccatgtataccagcacctgctctggtggaggtgacaggatagggatgtagactctgtgagaatccctgattgtagataggtgtagtgtgctggctttctcaaatgctagttatgctagtattgaagttgccacgtggacagactaaggacctctggttagccaggatgttgcaggcagtgatattagctgttgttttctccttcctgggagcaatattattgtcatgagtatggcctgagttggttggcctccagccaggaggtggtgtcttttgtgttcggctgccaaggcagatagaaaaataccatcaagtgggggcaggattaggcgggtctgagctgagactcttcttgggctagtcttgccacagccactatgtaggatggggaggatggttttcaggctgatggggttatgttccagaggggattatggctgcctctgtggcacagaatagttcaccagggaagtggagaatagccagtagtgaaaggcttcacccagctcccacacagttggtgagcccaatctcactcttgcaatgctgtgttaacagcaccaagtttagatccacgcctcctgcttgtggaactcagtcttactccaggccatacacttccccactgagaaagcaagcaaggctttcaggccacacccctccctgtctgcccacaaggttcctgtgctcatatctgctgcagttcccattcacccaccagattctgttcacgcaggttcatgccccctcaaaattatcacaaaattcatttggaagcttctttcaccttgtgccccctccctaattctgctggctgccttccctgagggcccctgtgagatatagtcaggcatggcttccctgggtttgagctggagactgggagtgcctacaagactcttcctgctgctgcttctacttttgtgtttcacgtggctccctaaatctgttccagctctaggtaaggttaaatccttctctcatgatctggattttcagattccccagtgaggatatgtgtttggaggcaggttttcccccattcacactttgggaactcattgctttttgcctgtctcacagagtttgcagcagcctgtcacttctttcaaaggatctgtgaattctttccattttcctgatatgatcctgtggtggttcttggaaaaaaggttcacagtctgagtctccacacactgttctgtccatccaagcaggagatgtatgttagccctgcctgctatctgccatctttcttctgtccccaatccttctctttagatagctgagataccatcttttgtttcttctgacttggttctattcactgacattcctctctatcaagtagatttttgaactttcatggaaatttattcccaatttatatggaaataattcccaatttatatgaaaagcttataaagtgattcattaaccaagtatttactgaggtgctaaaagtatactctgaagcaggagtggcaagtcctttgccttcatggagattgcattctcttgtaaatcttacatgatggtcactagatttaggaataaaggactccagcataaaacactgacacttctgctggagaaatattttacaaactatatatattgaagcccaaactctggtttattggtaaaggagtagcactgatactagaattttgtgatcaacatgttggaataagaagtcagaagacttagatctgtgttctttttctcccgctggctataggttgctttaatctctgagctgcagtttcctcatctacagaataggttagaccagattagtggtcttcaactttggctgtatattagaattatcttactcttgaccaattaggttagaaatttcgggccacacacaatggcttacgcctgtaatcccagcattttgggaggcagatacgggcagatcacaaggtcaagagatggagaacatcctggccaagatggtgaaaccccatctctactaaaaatacaaaaattagctgggtgtggtggtacacacctgtagtcccagctactcaggaggctgaggcaggagaatcgcttgaacctgggaggcggaggtggcagtgagccgagatcgtgccactgcactgcagcctggtgacagagcgagactccgtctcaaaataaataaataaataaaaattaaaattagaaatttcctggtggagaggaaagcagaggtatttttaaagctctcaggtgatatatttctgttttaaggtaggactaaaaatcatgggactacgtcagaagttctaattataaatctataggttagttttctccaggcatgggtatagtgcttaaatgccttttaaatttgttaccaacatagaaaaaaaaaggtttccggcttctcttgaaaaatggaaatattaggcaacagttgggcttatgtttctgagtggtaaaaattaaacaaagtaaacgagtctccgtttcatttgttcctgttgccttcctggctcttgaaggcattgtcatttgtgaaaactaaactagatggtctttaaaatctccaattatttgaattgcttatttccacatccagaaaagagacggtaaacaaactatacctttatctgtaagctagttggtttgtgaaatcaaagggaacttaatctttgaatatggaaaaatcccagggtccaatggaagagaaactccatctcattaatagcaggactccacagactgctatggaaaagacacccacccggggctaagagggagggaggcggaagaggacttaattcattttctgggcatttttaatgaagctttcccctctttcattatttcttatttgggagctggatcattagttgggatgtgactggctttccctggggagcaaaaaggagattaacagaggttttgctcgcttcttcctgtgatttactgtgggaagtctcccaggttcttcccttcgcttctctgtggccttcatcttcatggtttcttgctgtgtctctctgagagcaagtacctgggtgaaaaaggctgagtgtgtggttttttggcaactgcctggcattggatttaagtgggtatatttgaattactagaattttacattttataggttcaaaatatgcacttgaattctgtaggacctcttacccaaattgaataatcctttgtgccttgttaaattttaaaaagtcacactatcaacattatgacatatggcatatatgatggcaataataaaaataacacacttattgtccactttaatgtgccagcagtgttccaagtgatttgcgtaaatatcaaatttgttccacacaattatcctatgaactaaatgttattatttcctggtttataggtgaggaacacagaggctcaaagcagctatttgatttctcttatttcaaaattaggggaagtgagatacattaacctgtataaccagaccttgttaactgtttttggtaaattccaatgtgtattgattttcacaaagacaaatcacaccattgttatattaaatattaattttttcatagtccctcaaggtgcttactggctatattgttactgtcttttgatgttgtttatacatggtggattacagaattccatgaacataaaaaatcttgactttatcctagcctatttcctattcttaccccctgcaaagtaaaaagttcaaaatagcgttagtaagccaagcaaactacttactagccacatgaacctactagcctctctgcctcagtttctttgttgggaaaatggacaatacctaactcaactcataaggatatttctagaatcaggtgtaatatcaaataaaaatatatttcctttttcctagaagatacccatgtatatcttaggtactgatgtattcatagtgatgcagaacataaaatgtttattcttttgcttagcaacaactatccatagagatttttccactttagagatttaatcccattaaaggtttttagattgattggacaatgagaatgtttttgtctctctgaaactgaggctgaaagttgatttcattctctcacttcaaatcatactacaaggctacagtaaccaaaacagcatgtcactggcacaaaaacagacacatagacaaatggaacagattagagagcccagaaataatgccacacacctacaacaatctgatctttgataaagttgacaaaaacaagaaatggggaaaggactctctattcaataaatggggctgggaagctagctagccatatgcagaagattgaagctggacccctccttacaccatataaaaaaatcaacttgagatagattaaaaacttaaatgtaaaacctaaaactataaaaaaccctggaagataacctaggaaatggcattctcgacataggacctggcaaagattccatgacaaagatgtcatgacaaagatgtcaaaagcaattgcaacaaaagcaaaaattgagaaatggaaacagattaaactaaagagcttctgcacagcaaaagaactatcaacagagtaaacagcctacaggatgggagaaaatatttgcaaactatacatccgacaaaagtctggtattcagaatctataacaaacttgaacaaatcaacaagcaaaaaacaacccaattaaaaagtgagcaaaggacattaacagacatttttcaaaggaagacatacatgtggccaacaagcatatgaaaaaatgctcaatatcactaatcattatggaaatgcaaatcaaaaccacaatgagataccatctcacaagtcagaatggctattaccaaaaagtaaaagaaaaacagatgcctgtgaggttgtagagaaaagggaatgcttatacactgaaaagggaatgcttatacactgctggtgggaatgtaaattagttcagcaattgtggtaagcagtttggtaatttctcaaagaactcaaagtagaattaccattagacccaataatcccattattggatataaacccaaaggaatataaatcgttttaccataaagacacatgcatatgtattttcactgtggcactataacagagacacaataacaaagacatggaaccaaactaaatgtccttcaatagtagactggataaagaaaatgtgatacatatataccatggaataccatgcagccataaaaagaaatgagatcatgtcctttgcagcaacatggatgaagctggaggccattatcctaagtggactaacacaggaacagaaaaccaaataccacatgttctcatttataagtggaagctaaacattgggtacatatgaacacaaagaagagagcaacagacagtggggcctacttgtgggtagagggagggaagaggatgaggattaacaaactacctatcagatactatgcttattacctgagtggcaaaataatctgtacaccaaacccctctgacatgccatttacctatgtaacaaacctgcatagtacccccgaacttaaaagttaaaagaaaaaaaaatgattaatgagcgtgataccagaacaatattatgatgcagggctattttttgtgtgtttgctagctgggcttgagatttgataaataagtcccattgtcctaatccgctagtgatgatgttctagcctttgaaattcaaactactactactccactttgagagagactgcatgagaattggacccagcctggggctttagacaccatggttcaaatcttggctcttatcattttttagccacgtgtcatggactcaatgtttttgtctcccagctccccagattcacaggttgaagccctaacctccaatgtggctgaatttgagattagggcctgtgaggagctggtaaaagttaaatgaattcttaaggataggtctccaatcctatagagttggtgctcttacaagaagaggaacagacacccgagttctctctctttgctatatgaggacatggtgaggagtggccatctgcaagctcagaagagagccctcaccaggaacttaagtgtctggcaccttgatcgtggacttcccgacctccagaactgtgagaaataattttttgttgtttaaatcacccaaactgtagtattttgttgtggcagcccaagccaattattataccatgtaagcaggttacttaaatttactaaatatgtaagttacttaaaatttcaaatcctggttctaactttactagctatcacttttactagctaacacattacattttcttcaacttgccgcatgcttttgctgtgagttttaaatgaaattgcttaagtactttgcttatcatactgctgatccatagtaagcacttaaagttagtttccaggaagtttggaatggatctcacttatgcaaatggttgactttgacggtgcttgttcctctctggaaagggttcacctcccattagaatagtcctgtgactgcagtaattttgtatgttaaacttacatgtatatctgcagaatgttaaatctgcaaacaccatccatcaacccaaaagcaaaaaaagagtgtttcctaatagttaatagttggtagcttaataggaaatctagaaaaaaaatgtttaataatgaaggctatattaataccaagtctcatttgagttcctgtcagtaaggaaatagttatctttcgttgttaatcaatgaagaccagttgccataattagggctctggtgtgttttcttcacatggtcttctaggacctaatgtaatatcatttgagaggctcaaagaggatcccatattcccaaaggtatcttagagtccttagctgcccaacatcccaccattaatcatgctttgcagatgaaaaattgaagactccttgtctctgaatatctgggatatgctttcattcctaggatggacatttttcttcttccccaataaggaagaaaaagggacagaggtgatttataagagcagttctactgagtgaaatgtgggtcctagcaaaggaggacacagctgccccttgtaatagtggagggaaggaaggaggcaggctggctgtactttgccctcctcaaccctaaaccctatctgtttaccacagtggaccttttttctgaactctaacctcattatttcattcattatccacgtaatattcattaatgttctccaaggctcttagaataaatctttaacatttccccaaaaagtcacaaggtctgacacctgccttcctttttccagcttcctatcataatcctcctttttggcagtggccacactgatcttctttcaggttcccaagctcagcatttgcttttcattgggagccccttacatcatgactgtcagcctgattgtcatttctttggggaggccttccctgaaccctggaactggatcatatacccctatcatgtgctttcatagcaccatgaatgtctccttggtggcagtccccagtaggagaattctgtgtttatctgtatggctgtttcataaatgtttatcttcctcccaatagtctgtcagcactttggcagccagttgtgttttgctgttgattctacctccagcacagaatgtctcttagtatttatggaaggggacatgaaaaaagaaaaagtccactgcatgaagatttaatccagcgacactgaggcctgaacatctagctttagggaagccagcttctagcaggacagactggtagggactaggtaaggagaatggaaaaacacagggaatgagcatcactttctttaagactttgcctctggcagacccctccaagtaacagattccaaagagattgtgaatgttctccctctggtatgcagtctcctgtcctgtcagaaacatggtacccagaggccaaagctgctgcataagcaagttatcatgaaactattccaggacaggtttcagaagcagggtcttaaaaatgagtattaaatctaatgttcacccagatacatttccaacccacatatagacaccgaatttaacgatgaaagtggaagttactctgttgaggatttatttgaaatgttggttttctcttgtccatctgatacaggtcatagctctgtttctgtcattagattgattttcatgtttctcagcacagactctctgtgagtcagagataagtttaatttttcagcatggccataggaatgatgaagtcattcctcattaaaatgaagctaagcaaaatttaatagtacttgtttaagattccttatttacttttctacacaaaaagagttgcaaggggaaaacaaaaactttagctttgagtaatttccttaattcaaatatagatttaaaccactttgtcataatatgtaaatgaactattgcttttttcaccacaggtctgttttcaaatagataatgagattatataaataattaccttatataaacataaggttactcattattgaaagcaattttctttttttgtttctggtttattatggttaagagtgagcctttgttttagatatttgaaaacaaaatgtgtgtgtgcgtgtgcttttgtgtgtgtgtgtggatatgtgtatctagggaggtcctcaaattcaaaaattataatacaaggttgtaatgtcagcacttcctattgcatagttttataatggggatatatagctatgcattaaaatgcattattgaaatggaaaatcaggatgtgttaaaaatgaattagtaattatattaagatctgaatgggaactagcatacaatgtaacttaagcttttgaaaaataaaaaaaaacagaaaataattaatgataagttagtttcagtattacattgataaatatttccagaataagctataaaaaataaggaggtagatttattattttaaggttcatactaaaagattgtaatatttacttaacctttctttatttaatttagaataagattactgtcatctctctaagcatctatgtaatagtgttttatttacttttccattaaatattactgagataaataaggagtcctggtgaatgaaatataatttaataagcagagttttcttaggtgaaaactaatcatgtcctgctataaatgtatattgagagagaagctgaatagacaagctccatgatttagtcaatgatacgacttcagggaaaatgtttttatgccttgttggccatatcttttaatacttgcattgaaaataaaattacatcccaagattatgagggttgtgaaattttataattagatatttaagtcctgaattgattagcagcagtataaacatagacatggattttgggttaaatctgagaactatttttttgtactaaaatttgcgtgcagatgacaatgggaaaatcaaatgttttcctggaaaattttcaaatgggacaaatagtcatctttctggaaatatgaaataaagggagtggtagtggttggactataaacctctttgaaggccttttaatctttagctgtaattcatgttttatcaccattggattttcaaaacggaaaataccttagaaataatttagtgggccgggcgcggtggctcacgcctgtaatcccagcactttgggaggccgaggcgggtggatcacgaggtcaggagatcgagaccatcccggctaaaacggtgaaaccccgtctctactaaaaatacaaaaaattagccgggcgtagtggtgggcgcctgtagtcccagctacttgggaggctgaggcaggagaatggcgtgaacccgagaggcggagcttgcagtgagccgagatcccgccactgcactccagcctgggcgacagagcgagactccgtctcaaaaaaaaaaaaaaaaaaaaaaaagaaaaagaaataatttagtgttaccttgttgatattaccaaaaaaaaaaaaaaagtgctcagagtcacataacttgattcagtcagagctggtactagatgctcagtcttctgacttctaatttagtttgctttcattatctacttactacctgctgctgactcagagctcctcagctatctgcaagtggatgtgtttattgaacatttacgatgtacatgaactgctctcaatgcgaagctcccatggtgaatgggagcttactttctgactcaaaaattagttttctctctttgtgttctaaatgaaagtgtccttttgctttatctgaagcagaaagttgtaagtttgtttattttacttttgaaattttggagaattggcagtggggtcatgccatcagaaacacatacatgcaatgcatggatgcacggtgtgaatgagctctctggaagatggtagattatgggaaagaaggaagctcagaaagagagtggaccaagtcaagaggaaagagagaagaaacaggcaagtgtggagcagaggaaaagtaggagggtcatgaatccattctgcaggtgtgtgctgagtgactggaagaaggaaaagaaccaaggaagtctctgccatgttatcttagttttgttaagggtataaagagattgaagagagtttaactaggccatctttaaccctaggacatccctagagtccctggcagaactaataatctaaattatgaatggctgtgtgtgcacacacacaggatgcacttactaatgtctatcattatgagtatcttctgacttctccactacaaagaaaggaagggaatgtgaccctctttccaggttagaagtaactagggcatagtaacacaaatggatgaattaaactgtttaaatggtgcactggaatatatttattttggggcaaatcatgaagaaataaaaaaggaagagattctcttttgagaaaaagtttgtttcctattgtcaattgagcaactctgtgaacatcttaaagataaagaatgattattctgtaaagtgctgggatttctggtgctgtgtgacaaagtccggttccttttgtctaagttagttataataatctttaatgaaaagcagaggggtcccatggtttggaacaagtatctgagtcaagagttgacaagtagaatagctgggcgcagaggctgctgtcaagttgacaaagccagaacagtacatttggacagaaagaatttgattttcttatactgaatgtgatgatcttgaagaacagattttttttttgcatgaaaataaatctttattttcagttattacccaccagtaagagaaagttaggttaagggtataaagggattgaagaggtttctacttttgcccagtccttattttgaatagccttccactcatccaaagtcatctcttttggaccctcctcttttacctcttcaacttcattctccttattttcagtgtctgccactggatgatgttcttcaccttcaggtgtttcctcagtcacatttgattgatccaagtcactgcaattataagatatttgtttctgaatgtatttgggggactctgttaattcatctttgacaattccccagttgtgagatctgctacctccacgttacaggtcctcgtgcttcaggccactgtaatgtgaaaaaaaagatctatcacttccactatacctatcaaattcacgtttgccacgagaatcaaatccatctccttggcccatttcacgtccactgccctctcgacctcttccaagaccaccatgaccttgaataggtcggtcaataatcagtctatcaactgaaaattcgcctccttcacccctttcatcaagtggcttttcaagtcttcgttcacaaggtggtctcctttctggtcttctatcagttattttcccttcaccgtgaagttgttgagcaggtcttcttccaacttgtcttattccttcttctttttgtgttttttatttttcctctaggcaagctttattctttgattcctctatccaggaagggggctgttggttgcatcttacccaaatggaatgcaatgggaattgggagcttgagttgtgtggaggaggagttgtcaatcttaacaaatgactatagctggcgtgtggtgtccatcaatccttgagggcttggccatgcacactagggaatggtcagaacagactcaacagaggtctccagagctttacaatatctacaatatcaaggttcagggggtatagacagtaaggaaaaaggccatttcctgtttctgtccatttttggtacagtagacagttaaggttttttcttttgactagcttttaaaaaattacttagaaaatggaaagcttataaacattcataagtgaattgttgaattgctaccccaagtggtttccttacctagtcaccacttaaccagaaatactagaatacacggttcaaccagaattcaaccaggcagataacctgcctattgctcaagcaatcatcagagtttttaaaaacaaaattaagcaaaaaagacctttccccaaatacaatcattactttgtatgacccattcctaagaaagctacattccatttcagaaaacatgaccacttaaggtacagttaaaacaaagtcgttgccttcaggtgcttactttctgttttctttaaattaactgctgaaatgtttatcttgtgttttgtgctgcattcctgaaaactgtaacttttaaggacataggcctcatctttataaaggaagaagaaaacagcaaagaggtgtctcatttgggaggcagaaggttatgaccaatgctggaagtcttcctcttccttacttgttgttcaacaagatgggttctgtggtgtcgcatgaggtgtgagttggaaatgaaagctgcaccacacttcttatattcatagggcttctccccagtgtgggttctctggtgcaccgtgaggctcaacctctgtctgaaggccttcccacactcattacacatgtaaggtttttctccattatggattctctgatgaataagtaggtatgagctacatgtgaaggccttcccacattcattacacacaaaaggaagatctccactgtgaattctctggtggacaaaaaggcaagagagctgactgaaggcttgcccacattcactgcagtcataaggtttctctgcagtgtgaattatctggtacataataaggtgtgaaaaacaactaaaggttttcccaaactcacactcatatggcttctcaccagtatggcttcgctgatgtacaataagatttgcaatctgcgtaaaggctttgccagaatcgttacaggcagagggcttctccccagtgtggatcctctggtggacaatatggtttgagctcccagtaaatgttttccgacactcattacatttacagcatttttctgtaatgtggagtttctggtgccgagcaagttgtgagctataactaaaggctttctcacatttactacgcctaaaggttttttctaaggagaggtttttttgatatacagtcagatttgaactctgattgaaggctttcccacattttgagcaaacataaggtttctgtccagtgtggattctctgatgcacatcgagctttgcactctgaatgaaggccttcccacactcatgacattcaaaaggtttctccccggtgtggattctctgatgcacaacgaggtttgcactctgactaaatcctttcccacacatgctacaatgtaaaagactttcgcccaagctgggttttcggattgttaacagtgtcagaattaaggctgtattttcccacagatttcttacatttctggtcttcctcttctttgaagctttcaggtaagtgacagtcattcactatgacttatctgaaatctttcctttccctccttattctctgcctctttaacatgttttctttttcacaagcctctcttaactcaggtccttaaggatcagctttctggattcttcctaatatgatgcgggggttttcagcttcctcacgtatctcagtttttggaaccagtaactgaaggttcttggtttcagcaccttttcttcctcttctgatccatcaaggcctgtctgacgaaactcccctggggcccagactttgatgttctcagagtgcacttgttggctggatgcctgatctgggaagttttcttcttcctcctcctcctttttcaccttcactgggcggcatgggcctagggccatggcttctctcaattctgcagtcatcttctctgctcagcaggggaacgcctatagctgggagctgcccagcacaggtcaaaccccatctaagctttatgtttcaaaagcttcttcttgagtttcctcccagggccaagatgagtattgcctacgtgcgcagctgagaggcccgaccagagttcactggctctgcagcaggaggctgggggaccaggacctcagctcctactggcacgagaacaatgacccttattccttctttcttaagcaccatggacggctgcgtctcctctttcctgtcaaccacgccaacgctggagggcagcgggttcttgctgtctttctgggactccttgcgcagctagctatttgcctgccgccttggagttggtctgggtcgcagcctgagctgccgctcttggccccagagacgccgcccccgccagcttcttttttcttgttctctcctgccttcagcacctcgaaggggtccgattagttgtcaaataactggtcgaatcggttggtgaccaggcagctgaagccttcctgtaactgcccaggcatgatggttgctcggcggcacattcctccacggattgcagcgggctgcgccgagccaagagcgcgtgcttcagctcttcccagaagatcgaagaacaatttttttgaaatccgcctgtaaatgtcaggcaaggtaaatttcaaaatgaatttttaaagtctctaaaatggagttatgtttaattatgactttatgacaaattaaaagatagttctagataatactattgtagaaagaagcttctcttgttctgggaaagagagacagtttggaaacttgagacaagacccttattgtctgttttattatttactgctaacaaactgcattctctcactgttcactggaataggtgggtccagggaacttaggaaagcctaatgggaagtgagaaaagtaaattatttcttatatttttatgtatacaaatagttgataaaggaggaagtgtagtggtggggtggatcatgcagattgggatacaagagacagtataattattcacaattatagataaggagatctaggcttcacattttcacttctggaatattccactttgacagaacagtctactgtctgcctcagcctatcctggagatgtccttgtggtgggagaggacctgctttctccttgctgtgctcctacagtttgtctctgccagtcatgtccaagccccttgtcttagtgcctcacaagacctcttcctctgaccaggattcaggcaccttctcagaaccttcattcccctgacagcaggaccagccagtctcccagacccggggtagtgcgaagaggagagcagactccttagacccagagtcccaggacacttggcctcaattcccgtgacacctatatcacccagacaactgggaaatggaggtgctggtgccagaacaaaagcataagctgtgtttctcaagtttggactttacctgggctgttgctttattttctagctgtttactgatttttagaagcataaaggtttctttctgtgaagttcctagggacacttaacggagtggggacaggtattccttttgtctttcagaaaggcatgttaagagttagtctcacagtaatttaagtctcacctcctaaatggggtaagagtggggagaaatatatgtgtgtatatttgtgtgtgtatataaataatatatatatactactaatataattaataatgtgtgtataaataatatgtaaataacatattatattatatgtcaataataaaatattatattaatatatgttattacattaatatactatatattataatatataagatataattatatattatatactattatattatatctataacataatatattatatatttatatatcattatataatgtattacatgtattaatatatattatctatatagtaaatatatggggtgtgtatttgtgtatacacacacacacgcacatatatatcctgcattgtttgcttagaatcatgctttgcaattattaactgctttttcttccttcccttcatctaatacacctgaagaatatttcagttagccaaaggtgagaatccgaattcatatttgtattcccaatagatttcccgcagaatcttgggttatcatttcatcaataacagttatgcagatgttctattgctgtgtccaatgcttgcttcgttcatatgaaatttgacttttggccattcaaaaagcaatcagtgccttcttgttgattagcactaatcaccacaagatccttccaatagtaaattttccagagcaaaattctaaacttacagattagtttgccgcagcccctagccctacactgtaaggatcttgctttccatgaggtccattgttaaatggaaatgttcccctggctctatgcagtgctcaggtgtttcttactcagctgaaggactaatgaatttagtttgaatctaaatttggagtaaaaaatgccactcaggagagctgcttctgtgactgcattgccttccaacctgcttttccatttttccttattactccatgtccttgaggagtttattcctttatagcttttgtgatctggctgtaattattttgaaaaaaattttcattatactggacattttggattaagtcctccaaattttcttatttgtgagagtacaagtcactatttacactatggtaaactgcatgcaaacatctgagtacctttctgttcctgtcttcagctgggccagcactaagctggaatagcctatactttgatgtttttctgaggaagtacattttccttttccctcagattcctggtgcctggtatagcacttttttgatttgctcttgttctggcaataggtcaactggctttcatggtccttaacgtttcaggtaaataattccaacagttgtgactggaaggaattcaaatcaactcaaggcatccactctatgttcaaaatgccatgttttgagtgatttgtcctttggttagtaactttaaaaaatatgaggactggaaggagaagctactatttgaggaactaatggaaaatcaagcagtttttgatgtactaacatatacacttatgatgcaaggagtgtgatcgttgaccttcctacttatctaaacattatgctctcagagcatgtggataggtagcatagcctagtggttaacacacatagaaaagtcagactgcctagttcgaatcccagcttcatcacttgctagctatataatctttattaaattagttaactttcctgtgcctcagtctggttttcctgaggattaaatgattttatatttgttaagtgcctagaactgtagctggtctgcaacaagtactatacgtctttgtttaaataataaataaaatgacagtattgttcatatggagaaacaggggtcttaggcagcttaggagtttttctaaagtaacagaatcatttaatggcaggaacaacaatattatcactgcccagaaccctaatggagaactatagctcttaagggtgatgtggggagaaatacactgatgaaaaacaatcaacattattaaagacaggatgggagagagtgggaactcgtcattcatttatctaatggcttagtcagcaagtaactaatgcctactttgggccttgacactataccaacattgtgcagaaagtgattaaaatgcaaaagaacattcacttaggctgggataaacaagaggtcttttgcaaaatctgatgatgagcttgttgatgttgagttgacaaactatgcagcaggtcagtgggggggtgattatcataaaattccatcccttaaacatctacaggaagatgattattttaagatgctttacttctggagatgtatgctttacttctacttagagaatctggcttatgttctcatgttctggttttatatgtaattggtcatgagcttaatttgagccaagcatttgacacagttgcccccagaagttaactcatttgtggattgtataaatgctattgcacaaaaaagaagtatatatatacaaatagtcatagtagaccacatctcagttaatggcttcaagtctagatgaaatgttttaagagggatattgacaaattagagaacattagaagcatttgccagaatactggcagggcaagaaattatgccaaatagtagaaagagaattagatgcctaagtggaacatggtgtatagcccataagaatttgaaggattgtcactggtagaataagatgttattcttggctgcttccagctgaggagtggtggatgggtgactaaggcctataagagagcaaatataaggaagagtttctagatattaaaatcaatttccaaagaaacagcctggcctctaagggaaagagcttcttgtgagtagatgtgtttaggtggggccagatgaacaagctcctgagctctagggattagactccttctgctggataggaggtacaaccaggtcatcccagaggttccttgtgttccaagattctgttactctatgatttcatgacttggatgtcacctcccttaggttggttactctaaataatgttaaaagtcagtgtatgccttaagattgggtgaattgctatgacagaatgagatttaccagagaagcagttaagtctaagaatgaaactactgtttctaagtgaaagaggtatgaataacctaaagataatatttttctctgtagatagaaagaatttgtattataagtctgtgttgggtgtatagtagggcatcaccagaattcaccctaactgggtgaattcatggcagtgatcagtagaatatgtagtttaacaatgaggccttatcatttctaagtagtttctttttgagacggagtctcaccctgtcaaccagagctttgccctggaactcttggagtgcaacggcgcgatctcgggtccctgcaacctccgcctcccaggttcaaacaattctcttgactcagcctcccgatttctaagtggagagttatgaatggcccaaagataatatttttctctatagatagaaataatttgtatgctaggtatgtgttggatatatagcaggacattaccagaattcagcctaactcggtgaattcatggcagtgaacactgcaatatgtggtttaataatgaggccttattcttaaggcaaagctcagaaaagctgataagcaaattagaaaggtctattgaaaagtgtctgttggccgggcgcagtggatcacgcctgtaatcccagcactttgggaggctgaggcgggtggatcatgaggtcaagagattgagaccatcctggccaacatggtgaaaccccgtctctactacaaatacaaaaattagctgggcatggtggcatgcgcctgtagtcccagctactcgggaggctgaggcaggagaatcgcttgaaccatggatgcagaggttgcaatgagctgagattgtgccactgcactccagcctggtgacagcaagactttgtctcaaaaaaaaaaaaaaaaagaaaagtgtctgtctagccaggcgtggtggttcatgcctgtaatcctagcactttgggaggccaaggtgagtggatcacttgaggtcaggagttcaaaaccagcttggccaacatggcgaaaccttatctctactaaaaacacaaaaaattaacaggatgtggtggtgcacacctataatcccagctacttgggaggctgaggtagaagaatcgcttgaaccgaggaggcagaggtagtagtgagccaagattgtgccacagcactccaacctgagcaacagaacaagactcagtctctgaaagagagagagagatgaaagagagagagagagaaagaaaaagaaagaaagagagagaaagacagacagaaagaaagaaagaaagaaagaaagaaaaagagaaagagaaagaaagaaagaaagaaagaaagaaagaaagaaagaaagaaaagaaataaagaaagaaagcaaagtgtctgtctgccaacctgcttccacaaaggcccctcttctgattgtagaagtgcctggtttaggatggcagtgtgctctacctgctgtctggtgagtagtcaggattggacttctataagacaccctctgagaggcttgcaaataccttcagaatcaggcagaggtctttggccagttatttctgaataaagcatatctgcgtgtctgtctgacctaagcctgggaaccacgatggaagatactgtttgaacaacaacaacaacaaaaaaaggcagggaacttaagagagaaatggattttagtcactaagaacacgaagaggaacattttgataatatgtactctatacaaacagaatgcttatacaagacaatcaaagaggaatgggtagttttctaaagagtaaaacctgtatttttaggaacatatatttgtttacaatatattttttcttttttcacccttgatttttaactatttaataattttctacaacatttttttctttttttttttttgcccttttttttttttttttaaacagagtctcgctctgttgcccaggctggagtgcaatggtgctatcttggctcattgcaacttccgcctcctgggtttaagtgattctcctgcctcagcctcccgagtagcttggattataggcacctgccaccacacctggctaatttttgtatttgtagtagtgacggggtttcaccacgttggccaggcttgtctggaactcctgacctcaaggcccaccttagcctcccaaagtgctgggattacaggtgtgagccaccgcgcccagcctgcccttgatttttaactatccctcctgtgaaaatttaagtctttctgtgggttaaagggaactggtaaagagcactggatttatgcttgggctggaatttccctctaggtttggatgtaatgaaggcagtagagatttgggtttataacagaggcagatttgtgaaactataggagttgaagcctgagggtccctcacttgcagagaccccttccagggtcctggaaggaaccctgctaatgtgttattatggtcattttttttataaaaattgcaaaacataatgtgtttcagccatgactggttaagatcattgtcttcttccaattcaactttccctcctttctccttccctttctagttgggtggcattaaagtggtcatgcgcattttgtatttgtaattatgtattttttttttttcttaaaaaggacccccccaccaaattgtataagtttcaggccctaaaaacatggatcttccactgggtgtaggaatggaatgagtaacaatttggaaattgcctgtgtagcagaatcagcgaaaagtcagagtcagcagtcaaaatgtgatggggagagtgagagtaaattggaatccataatcccaacagcatttgacagtgggaaaatggagctttttcccccctctttagggttcattttaaagaattccatgcaaaggatatcatgaattgagaaatatacatcagattcatcagattaaaaattttttttttttttttgagacggagtctcgctctgtcaccaggctggagtgcagtggcgggatctcggctcactgcaagctccgcctcccaggctcacgccattctcctgcctcagcctcccgagtagctggaactacaggcgccaaccaccatgcccggctaattttttgtatttttaatagagacgcggtttcaccgtgttagccaggatggtctgatctcctgacctcgtgatttgcccgcctcagcctcccaaagtgctgggattacaggcgtgagccaccgcgcccggctttttgttgtgttttttgtttttgtttttgtttttttgagatggagccctgctctgtcgcccaggctggagtgcagtggcacaatctcggctcactgcaacctccgctcccaggttcaagtgattcccctgcctcagcctcccgagtagctgggattacaggcacgcgccaccatgcccggctaaattttttgttttttagtagagacagggtttcaccattttggccaggatgatctccatctcctgacctcgtgatgtgcctgccttggccttccaaagtgctgggattacaggcgtgagccactgcacctggcctaaattctttttaaaaatagcaaattcttaaaaataatgcaaattgatgatgaattatgaaaatcatgatgagaaactcctgactgaagagagaaattgttggaaaatgattctccttttcctctactactttatgtaattataaagcctttttctaaagttcctttctgacacagaaatactggccaacagaaattcaaaggaaagttgagacttttgaagttcaggcaatttatatggtgtttcaggtgttactacctctaatagtctatcagtaaaaccctgataggggatggtctctcctttttgccttctactccatctcttctcacacacacttgtgattctttttctttttttaaaaaattttattattataatactttaagttttagtgtacatgtgcacaacgtgcaggtttgttacatatgtatacatgtgccatgttggtgtgctgcacccattaactcgtcatttagcgttaggtgtatctcctaatgctatccctcccccctccccccaccccacaacagtccccagtgtgtgatgttccccttcctgtgtccatgtgttctcattgttcaattcccacctatgagtgagaacatgcggtgtttggttttttttccttgcgatactttgctgagaatgatggtttccagtttcatccatgtccctacaaaggacatgaactcatcatttttatggctgcatagtattccatggtgtatatgtgccacatttgcttaatccagtctatcattgttggacatttgggttggttccaagtctttgctattgcgaatagtgccacaataaacatacgtgtgcatgtgtctttatagcagcatgatttataatcctttgggtatataccccagtaatgggatggcaggttcaaatggtatttttagttctagatccctgaggaatcgccacactgacttccacagtggttgaactagtttacagtcccaccaacagtgtaaaagtgttcctatttctccacatcctctccagcacctgttgtttcctgactttttaatgatcgccattccaactggtgtgagatggtatctcatagtggttttgatttgcatttctctgatggccagtgatgatgagcattttttcatgtgttttttggctgcataaatgtcttcttttgagaagtgtctgttcatatccctcacccactttttgatggggttgtttgtttttttcttgtaaatttgtttgagttcattgtagattctgcatattagccctttgtcagatgagtacattgcaaaaattttctcccattctgtaggttgcctgttcactctgatggtagtttcttttgctgtgcagaagctcttgagtttaattagatcccatttgtcaatttttgcttttgttgccattgcttttggtgttttagacatgaagtccttgcccatgcctatgtcctgaatggtattgcctcggttttcttctagggttttcatggttttaggtctaacatgtaagtctttaatccatcttgaattaatttttgtataaggtgtaaggaagggatccagtttcagctttccacatatggctagccagtattcccagcaccatttattaaatagggaatcctttccccatttcttgtttttgtcaggtttgtcaaagatcagatagttgtagatatgcggcattatttctgagggctccgttcggttccattggtctatatatctgttttggtaccagtaccatgctgttttggttactgtagcctagtagtatagtttgaagtcaggtagcatgatgcctccagctttgttcttttggcttaggattgacttagcgatgcaggctcttttttggttccatatgaactttaaagtagttttttccaattctgtgaagaaagtcattggtagcttgatggggatggcattgaatctataaattaccttgggcagtatggccattttcacaatattgattcttcctacccatgagcatggaatgttcttccatttgtttgtatcctcttttatttccttgagcagtggtttgtagttctccttgaagatgtccttcacatcccttgtaagttggatttctaggtattttattctctttgaagcaattgtgaatgggagttcactcatgatttggctctctgtttgtctgttgttggtgtataagaatgcttgtgatttttgcatattgattttgtatcctgagactttgctgaagttgcttatcagcttgaggagattttgggctgagatgatggggttttctagatatataatcatgtcctctgcaaacagggacagtttgacttcctcttttcctaattgaataccctttatttccttctcctgcctcattgccctggccagaacttccaacactatgttgaataggagtggtgagaaagggcatccctgttttgtgcccgttttcaaagggaatgtttccagtttttgcccattcagtatgatattggctgtgagtttgtcatagatagctcttattattttgagatatgtcccatcattacctaatttactgagagtttttagcatgaagcattgttgaatttttacaaaggccttttctgcgtctattgagataatcatgtggtttttgtctttggttctgtttatatgctggattacatttattgatttgcatatgttgaaccagccttgcatcccagggatgaagccagcttgatcatggtggataagctttttgatgtgctgctggattcggtttgccagtattttattgagaatttttgcatcaatgttcatcaaggatattggtctaaaattctcttttttggttgtgtctctgccaggctttggtatcaggatgatgctagcctcataaaatgagttagggaggattccctctttttctattgattggaatagtttcagaaggaatggtaccagcttctccttgtacctctggtagaattcggctgtgaatccatctggtcctggactttttttggttcgtaagctattcattattgcctcaatttcagagcctgttattggtctattcagagattcaacttcttcctggtttagtcttgggaggatgtatgtgtcgaggaatttatccatttcttctagattttctagtttatttgcgtaaaggtgtttatagtattctctgatggtagtttgtatttctgtgggattggtggtgatatcccctttatcattttttattgcgtctatttgattattctctcttttcttctttattagtcttgctagcattctatcaattttgttgatcttttcaaaaaaccagctcctggattcattaatttttttgaatggttttttgtgtctctatttccttcagttctgctttgatcttagttatttcttgccttctgctagcttttgaatatgtttgctcttgcttttctagttcttttaattgtgatgttagggtgtcaattttggatctttcctgctttctctggtgggcatttagtgctataaatttccctctgcacactgctttgaatgtgtcccagagattctggtatgttgtgtctttgttcttgttgctttcaaagaacatctttatttctgccttcattttgttatgtacccagtagtcattcaggagcaggttgttcagtttccatgtagtagagcggttttgagtgagtttcttaatcctgagttctactttgattgcactgtggtctgagagacagtttgttataatttctgttctcttacatttgctgaggagtgctttacttccaagtatgtggtcaattttggaataggtgtggtatggtgctgaaaagaatgtatattctgttgatttggggtggagagttctgtagatgtctattaggtccacttggtgtagaactgagttcaattcctgggtatccttgttaactttctgtctcgttgatctgtctaatgttgacattggggtgttaaagtctcccattattattgtgtgggagtctaagtctcttagtacgtcactaaggacttgctttatgaatctgggtgctcctgtattaggtgcatatatatttaggatagttagctcttcttgttgaattgatccctttaccattatgtaatggcattctttgtctcatttgatctttgttggtttaaagtctgttttatcagagactaggattgcaacccctgcctttttctgttttccatttgcttggtagatcttcatgcgtccctttattttgagcctatgtgtgtctctgcatgtgagatgggtttccttaatacagcacgctgatgggtcttgactctttatccaatttgccagcctgtgtcttttaattggagcatttagcccatttacattcaaagttaatatcattatgtgtgaatttgatcctgtcattatgatgtcagctggttattttgctcattagttgatgcagtttcttcctagccttgatggtctttacaatttggcatgtttttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactctcttctggcttgtagagtttctgccgagagattagcttttagtctgatgggcttccctttctgggtaacctgacctttctctctggctgccctgaacattttttcctgcatttcaactttggtgaatctgccaattatgtgtcttggagttgctcttctcgaggagtatctttatggcgttttctgtatttcctgaatttgaatgttggcctgccttgctagattggggaagttcacctggataatatcctgcagagtgttttccaacttggttccattctccccgtcactttcaggtacaccaatcagacgtagatttggtcttttcacatagtcccatatttcttggaggctttgttcatttctttttattcttttttctctaaacttctcttctcgcttcatttcattcatcttccatcactgataccctttcttccagttgatctcatcggctactgaggcttctgcatttgtcacgtaattctcgtgccttggttttcagctccatcaggtcctttaaggacttctctgcattggttattctagttatacattcatctaattttttttcaaagtttttaacttctttgccattggctcaaacttcctcctgtagctcggattagtttgatcgtctgaagccttcttctctcaagtcatcaaagtcattctccatccatctttgttccattgctggtgaggagctgctttcctttggaggaggagaggcactctgatttttagagtttccagtttttctgctgttttttccccatcttggtggttttatctacctttggtctttgatgatggtgacgtacagatgggtttttggtgtggatgtccttcctgttcattagttttccttctaacagacaggaccctcagctgcaggtccattggagtttgctagacgtccactccagaccctgtttgcctgggtatcagcagcggtggctgaagaacagcggatattggtgaaccgcaaatgctgctgcctgatcgttcctctggaagttttgtctcagaggagtacccagccgtgtgaggtgtcagtccacccctgctggggggtgcctcccagttaggctactcaggggtcagggacccacttgaggaggcagtctgcctgttctcagatctcaagctgcgtgctgggagaaccactactttcttcaaagctgtcagacaggtacatttaagtctgcagaggttactgctgtctttttgtttgtctgtgccctgccctcagagagggagcctacagaggcaggcaggcctccttgagctgtggttggctccacccagttcgagcttcctggccgctttatttacctaatcaagtctcagcaatggtgggcgcccctcccccagcctcgctgccgccttgcagttcaatcttagactgctgtgctagcaatgagcgagactccatgggcataggaccctccgagccaggtgcgggatataatctcctggtgtgccattttttaagcccattgggaaagtgcagtattagggtgggagtgacctgattttccaggtgccgtctgtcacccctttctttgactaggaaagggaattccctgacctcttgcgcttcccaggtgaggcgatgcctcgccctgctttggctcgcactcggtgtgctgcacccactgtcctgcacccactgtctggcacaccccagtgagatgaacccggtacctcaattggtaatgcagaaatcacccgtcttctgtgtcacttatgctaggagctgtagactggagctattcctatttggccatcttggctcctcccccagatcacacacttgtgattcttgctggcattcacacttactctctctttattttttgagacagggtctcactttgtcatccaggctggagtgcagtggtgccatctcagctcactgcagcctccacctctggagctcaagggattcgagtagctaggactacaggcgtgtacctccacccctggctaatttttgtattttttgtagagctggggttttgccatgttgcccaggctgatctccaacacctgggatcaagcagtctgcccaccttggcctcccaaagtgctgaaattacaggtatgagcctccatggctgggcacttactgtctttttaattatcagcttgcaaatgagaaatctgcccaaggagcctgagcttggtgaatacaagttcatttcagccccattggtgagtttatgattctatgagactttaaagatgtattttatttggacatgttaaaaaaaaaaaaaaagaaccgtgtgtttcttcacaacatccaaaataattattttattggtattgataattattattgaggaatagggaagtcatgtatgttatcaaccacttcctaaatgatacctagttaacacgttaggggagggaatcgaatctgaaagtgatacccatttagtgaagccaagcaatgtagcaagagttgagaaaaacttataaagggacctcttagcccatgtccataacattgtcgttaacataaagataggttgccagagaaagggtaactgtatggtcaatttagccaggtctgaactctcaaaaatcaagcactctcattctgttagggtgaagtcagagaaaagaaccttcacaaggtttgaaaacacagttgtaacatactgggctgtgttccagggctagcatttgactctgatttttatcttgtgcttagaaccagcctactgttgtctctgtgcagagagagtactaagtaggtactgaataatacttgctgtccagcacatagctctgtgcagaacgagcactaagtaggtacttaataatgcttgctggccagcacatggatggatcatgtttataagtgtgtatcataaacactttgccttgaggaaattgttttctttttagagttttcatactgtggacatccttaaaaagcccagaaaatgtatctttatggattgacatgtgacttcttacatatgaagttagaagccaatgaaatgctgttctttggactgaactttcaagactcatgtgtgtggtgtctaattcattaactaaaaatatgattcatatttaccttatgtaggactacaggtatccacatatccaccattaggatattctttaaatctggtagtttggaagatttccagacattgtaaagagtaaatgcatcagaaataagcattttccagaagagggaggtatgaaattgtaatgattagcctgttgcttagtcctggaaatgtgaaatcagataaaaatgaaaaagatgctttccttgcattctcttccagaaatatgcagcctgctgctcttttgtcttcagtgtgaccatgctgccctgaggagagcccagaactgtttttaaattcaaaaggacagctgctttctgctcactcaggtccactgaggcatgctccaagacaggaaaaaggtgcttagcggggctctttgatagagattcaatatatgaattttactttgagaataaaaagctcacccacttttaaaaggttaatcaaaagctcattgtagtgtattcttcctttcctatgcagtttcctatggaaatggaatcagtttaaattctggcctcagaacagcaatatttttcacagaggcagtccttctgccaagtggctctagaagtacccgtaatatccatgtcaggagtatgaaaaatgaaagggatgaacacttccttcagaaattatacctttgattcctttactttacggccaggcaggaagaatcctgagagaggtctttactgaaagttcagtatttatgaactacatactgaaaaatgaaaaacgattcctagcactgagttgcttaccctgtcaagtttacccattattttcaggctgttgagcattgtttgaaaaatcgatctgagagctaaatgagactctgtcccttaccatggtcttgctgttataaattcacactgggctatttccattccctaagtttgctttgccctttcctaccctttacctctatggtcttccatccggtaaattttctctcacccttcctggtctagctctatttcatcttcacttatgaaggcttccttgttttccttttttagaattaattgctaattcctcactgctctctaagcattaatacccccatcatagccttcatcataatatgttttgtgctgtagttatttatgtacttacttgtttttcccccttctttgctctttgattaaatgcatgccagatccaactttacagatgagaaaaatgagctctgaagttcaataacttgcccaaggctacccagttagaagagttatggacttcactctgaatatggtgacttttgttctagtgtgttgccttctctagtcttcttaagaaaaaccttgtcttcttttcttttttccttaggttgacttattctatacattagaagtttctaaattttaatcaaactgtcattccagggtcatagtcagccacatgtaaatcagaatgcagttttacatagattcattattactgtgcatggagattagaagccagctcacaagaagacttaatttggaaagatatgtaaccaacttcacgtaagtgctagcctttcattgatttctcacctccattctatattcctcctggcacttgttttaaatctgttctactgaagtccatactctacccccttgctctcagccgatgatctgtttacctgctctgagaagatttagatcagtagttctcaaactttaatatgtataaaaatcacatgcagagctctttctaacatagtttcccgggacttttcccaggaattctgatttcagcaggtcagggtggggctcatgaatgctccattctaacaagctcccaggtgatggcaacacagctggtctgaggactacactttgagaacctctgatttaggccatcctctgcaataggatgtcttctccaatacatcttctctggatatttatccttcctctccttctatgagaattcagtcgttctattctcaggctgaaccctctcaccacgagcttttatcccatctcatttcatctatttcaggaccttgcttcaacttggctctctttgaatcttttatatcaccctctcaattgctttttattctctactgctttactaataaaactgttcctttctcagttgtactatttaagatacatctaatgattgtaagcaaaattattttctctaagaatggtcgacaatttcagattcaactcagctggctaggaactaagtttctgtaatttgggaattggcttgtagagagcaaaattaagaaaccaagtttggccgggcacggtggcttacgcctgtaatcccagcactttgggagtccgaggcaggtggatcacgatgtcaggagatcgagaccatcctggctaacacggtgaaaccccgtctctactaaaaatacaaaaaattaaccgggcgtcgtggcgggcacctgtagtcccagctactcgggaggctgaggcaggagaatggtgtgaacccaggaggcggagcttgcagtgagcggagatcgcgccactgcactccagcctgggcgacagagcgagactccgtctcaaaaaaaaaaaaaaaaagaaaccaaatttaactttttttaatggatgtgagtggaagagactaatgagataacacaaaagagttaacttcttacatttctgtagtctaatacgagatagtttctccaggaattaacacagcacatctggttcactgacctgagtttgtttcctggtgaggcattgcagtatcatccatatctcaggcaaaggtactccagcattttgtagttaagcagttggaggaggagtagggagaactgctgtactttgaaacatttcacagtggactactttgcattctaatgatgttctccttacttaaggactttgttatgtaaggatactttgtccttctgataatcacttacacttttcttctgtgttcatgtcacttcattaatcctgattacttgtaatgaatcataatcttacccacttattcttgtgtgactcattcctacttgtattcttaatagtattttctatgtctgataacacattgtcaattgactatgctatttttaacgtaagcgttggcaaaaaggtttacttagagaaaagctctacatttaattccccggtgcctcagttcccaaatttgctaataaagattatacttagctgtcactccacgtttcatcagtaggattaaaatgaatagagatcatgaaataagacaatgaaaaaagataattataatggaccagattgagaaatccctacaaatcaacagaagcgacctgccatgtcagattcctagatgcagtttatttactcagtgggccatatttcttccttattctttctttttccatgatgccttccaaaactatattttaaccaggagggaaataccatttgtcttctgatataggaagatcctactgagagattatattcatatatttcgtccatcggcctgtaggtggaattgtatttaaaatactaataaaggttattattgcttatatatctaaaaatgctccaactgtccaaacaaagcttatactgttgatgatatttatcagtggctctgaacacttgcatatcataaaattctccctcaaaatttaaccttaaactctttcaggcttgtcttggtcacagtgggaactgaggacagctgctcatgttttttgatagaacagctcttaacatgcttttgctcttgcctcccactgcccaacaccagctgcatacacacagtctacttgctgtgtgcatgctctggctcctgtctccttttccttcagcctagttagcctggttttgtttggtttcatcatacaatgtatctattagtaaaacttttatgaactctgattatagtactaaactcataataaagtaatcagaacttcatttattaaaacactgtcttgagcttattttttaatttagtacacatgacaatttggtaaggtaggaattttcattccccttttatagatgggaaaactgaggtccaggatataggtaacattttcaaagttaactcgtaagtaaatggcttagctggaatttgaacccaggtttctgcaattctaaagcccatccttttaactgctatgctatgcgcacaattactgtattcttatttgctctctgaaatacaacaccttattctcatttcatctgctctttctgccctgtacacttcagtttctgctctatagatacctgctcgtattgtgacatctcaattttttttgtaccttggcagggttttgattgatgtattggtgttctgaactctttagcatatgtattaatagggaagacctaccaaatatttcatgtaatagggattattttgtctacctattttatctttctttataatgtaagtttgtagagggcagaaactataaattgctcagttagggactccacattgagccaagcacatacatacttgacccagagaagtcatcaccatctttatcgccacagctaacatatgggtagtgctcaccatctaccaaacatgtgcatggattattttatttactcttcacaataaccctataaagtagactatgttgccatccccaaggttaaaaaactagcccaagttcatcgagttactgcatgatagagtttgagtctaaccaacaccaatctacacgtctgtcaacacagttaactatcccacacttctcagtggaatctagagttccacttatttcctattccttccattcttcactatatgtcctctttgccttcttatcctgtttctctacttctcactttctgccctatacgtatctgctcaatcttcaatcttctctgccttaccctctctttttcaattttgttctcgttctgtcctatcctgcctccccactcttcttacctcattttcctagtcctcttttcttctttttttcacctttttacctcttacatatttcttttttaaaagtaacttcaagcttgataatagattcttcaacgctcttagcaatatcgtatcctaaccataataaaatgatagtgtgctaggtgtaaacagaagtagaatatgaaattgaaatgaagaatctctttactttttctattagaaacataaataatgagtgactgtaacatcttggtctccataatttctaagtgttaaataaaacacatttctttttttatttaacacacacacatccacacacacataaacttgttttatgcattgattgccatttattgagcagcatatttttggaaatgcaacaactacaaaagaatttttaagttattatcatacagtgacattaataggctcatcactttgccttctttccttgttctatcatgtagagggttgctttagagatcattgtgtattgatatgaattatcattgaagttttattagtctggatgtctcatcttgggcattttgataaatttcttttgctccaaatccagaagttatggccattcatctttataaataagactttttaaaaaaggtaaagtcataaaataaatatttcaaagcagtgttggatatagccagctgaataaactgccctttctagttaactttgaactctaaaccttatttaaatatcctccctttttttctgtaaagaagacgagaaaaaaaaacaatttcagtagattctaaaagaaaatatagcaagaacattttcataagagatatctcacataaaaagctgtaaaaattgggcaagtatttgcacctaaccagtagaacttagaagagaaaacatgaaatgaacttcttagcttatggaatggtgtggataggtttgcattacttagatgttcacagagctctagcatttacttactgaaacactggaatggttcatatccctgtggtttccaccttatttcttccagaaggattaggttttatgctgccagagaccacattgactcttagtaatgggatcactaaattctggttcacaattttgtgcatagagagattgcactaatatctcaaaattgtagctatgattataaccctggcatagaaatctgagctatgctggcagtgtcatgctgtacaatcgaatccacctgattatctctgcatttgtgacagctgggctggccttcattggcatatgcctctttgctgtgcccagggctttgaatgcaaaatgaaagatcagcatgatattaggggcccatgatccatagatggagcttcacaagtgaacagcgtctcagctttaacatggcccccagtatcctgctttatctttctggactgaagttcctatgacagatttgttgctttaaaaaagtaattttgcagatttgtccttttttaaaagaaataaagattgccttccatttcctactgaaagtgatatggtagtatccatcttataattgcacagattcaaaaataagccacaagtatgtgtgctgaagtataactgtggactataaaatacagatatcatagcctataatatggagggtagtgtgatgttataaagccatttttctgtgttttacattatcataaaatttaactactgaagggaaagtgaaggttttaatatttaactaagcctagcacttgaagagaaacacatatattttacttggaaaaaaaggaagttccattttggacactgcaaatgacagtgccagctgttgtcataatatttctaacatccgctgaggattaattccaggcccagcaaattcactggatgagcagaaacagccaaagaagtaaacactggagcttatgctgtgatattattaaattaggcatgagacttctacagagttggatatgtagtgaacactggattatcatgcctgaggatcgtttgctttgtgtatatctgcagaaaattgaatcctgaacttgctttcttctgcctcttggccctcttcctctgtagaggtatactcagaaaatgtgatctcatttgaatataaacttttctattaatattcattaagtactcatacaatataagctgaggaaacaaagtggtgggtgtaaaacacaggcctcatgtaaagagcttactttcactacagaggcaatgtagcataatgaagcagagatgggtttcagaggcaggtagaccagaattcaaatcctacttctcctaagtatggccttgggcccatcacttaaatttctgagactcagtttccttttctatgaaaggtagatactaatcatgctacagagttctattaagaattagaaatatttaaagatacttagaccactacaaggtagctatttttctagaacaggcataccttattgtatacattctatgtttctagaacaggcataccttattgtatacattctatgaaacagaatatggaaagtgctaaatgaaaggcacaatcagagaattccccaggccctcaagaaggaaggcggaatggatgaggaagtctgctgtccaaggggtgggccagagctaaggcaagatttgtgggtgggccttcactaaccaggcacagggagagggcattccaggagcagatgtagatctggccaaggaattaagacaggaatgcaagtggcgttttccaggcaaaagattaggaagttttagatcagcctggatatggagaccttgaatagcaagccgactgaggaatgcatgaaagaatgactactagctggaataagagataaatctcaaggcctcttttctctttcacctctcctcttgcccacatcatggacagatagttctggcttttccttatactctgtttctgtaagcaattttaagaaggcagagtgcataatggtattacttttatgtctgcgtgtgtattgccaccatgaagcctatagttttgcttttcaaactactagattgtgaccttgtaatgatctggcaaaaggctgaatttttaaaagcagtaaatccatatagtggataatattgggaaaaaattagggctaatactgaggaatgagaagattaggaaagagataaataaaatatgggtggtataaataaaaattaaagtgaaaatgtggggaaaggactgcttatgattcaccttacaaaatttctaccttatggggtctgttttcactgtcagttctttctgtgaatgcatgttcatgaagatactgaaggctgtttttctataggcagctggtggttttctgctgtaggcagaagtggttgaggtaatcctagggaggtgatgctgaatggggctgtggttctactttatgtaaggttattatatgtgaaagaaagagtaatttttaaaagtaattaactagtggtagattctgaactaacattagcaaaggttgattataaatcagattttatttttactactgatttagaaaaaatctttggagaaatagatttggaatggttaaatatcactttagggagcacattttggtatcacagcttaaaggtactcttaagagaaagctttacaaatggggcaacctgaaaagacacatttcatgtgcattcaaattcaagataagacccaaagctctgttgccaaggtaaaggttttgagagttaaatgggaatttggaaaataatatgcaaaaattgacttaaaatgtagataagcctacaagtatttacagggtggagacatcagagaatgtaagaaatagtttggatcactaacaggaatgtgtaatgggaagtcaaaatctatgctgtcaggaaaaattcatattattggatagaaactgtattatttggtacatttaagataaaatgaaaattgtgttttcaaagggttacgcctcgcagtggatgagtgattggggcgttttctggtttcagtgattctgtaggcagaaaacagtttttactgccaagtgtgtcagtggaggtggggagacagagaccttgctgtgttaagtgaaatctgttgcttaagaataaagctgggatttctgtagaatggagaaggagtttggtattatcatattatcaaaaataactgctctttgaaaagtagattttttaaagtttgattatcaagtatttatttaaaatactgcctaagtatttaaacactttcaggctctgattttgttttttttacaaaggaaacctatgcctaaaaattattttaagtagttatatggatacatgagctacacagtttcagacctgtgtatatgactttctaagaggtctatggtatccaataataaatgattttatgcagggatttaacacataatgggtcatgcattatctataccttgttaatgggatctatatagagtgatagcagaaaagaaagttaattttaggatcctttaatgcctataaatttagagcaaaagaaatatttctaaaagttcaacttttgtatacatatgcccaatcacaagttttacagacatttttacacgtttaggcctgaaatatttgattccgctcttatttgtcaagatacaatataattacattagtaaaatgcaaacagggcagataagttttccttctttttcctatgctatagtcatgctgcaaaccctccattacagttttttggctgaggtaggtctagatgtctagaggccaactaatacagttttatataatcaacatagggaagtcatttcagagactggcattgagctcttggagggaagaaaatgaaccttaaagcttcttgggaatatccctcactgcagcagagtttatgtgctctaatggatgctccgtaaatgcttgagagaatataagtcccataggttagcatatacttaattctacctatcatggaaacctctccatacattctatagctgaaatattttaggagctcaaaaggagtaacagaaactaaagggaacaccagctccaagattggatttttaggctttctttctagtgtaacacttcccttcctgttgggccatcggcaaccatatcctggctaattagaagtgattttcaggggaaaggaagaggtcataagttcttgcctccctattttccttcttgttgggtgctagtaacttaccttaagaagtaatgaagtcctagtaaaactcctaatattcagaaaccaactctcattattcaaacatgttgaggaaaaaatgtctccttgcgtcctcttctgcttaaaactcccccagtaccatcaagcatggacggatatatgatagtggcagtatccagaagacacaccatctatgtaacaaaccctggaaataaagtatggtataatcctaagcattcgctcagcactcttgcttctgggaatttgctatgagtcagccacaggcatctctgtgtaccttcaagcccagattagcacgtatgggaggataagagagaaagtgtacttcctgaatacatcttgggtagagtaaactaatccttagctaggttgatgacatccttacccagaatttaaaagttcagtagagactcttcttgaaatgttgaatttttatttctgcttgttgccctctatagatgagtgaaatgcaatgaagatattcatggctactataaaaatgcattagttctttttggtgagctacttgactatcagagccaaatatgtaggtagttggaattaaatttccaatttagcatcccccttagaagggtgatggaagctcccatatcttggtatttctctttctgagtatctgctgtctcactgaggcaacatgctagcctccatgttgtattatttcacaggtatagaactaagtgacacattgccaattcccacgccccccccccattttctttgatggaggtagattacatttataaggtgtagatattgcttgaaggtacttgttctttcttataagtaagcaagaaagagagcagcaaataatagctaggaggaagatgtgcccacaccacattcaggccacttagtctatctagtaagatagagtgtttcaggcatcaagcatgtactgggagacatgcatacagaaaaagaacaagcaatagactcctttgagagtgacatggtaggtctgaagagtgaatgtaactttttgtctccatcccctcagtgattcattaattattcattagctgtttttttccaccaggattacaatcattttacctttgcttgccagcctagtgggttattaacagtggttactctatttatttacacattttccttgtgtatgttattcatcctgtattagttcacccccacccctagtcaccattcttttttcttttgtttggcctttcatggctaccatattaccatgtgatcagaaaaaaaatgcactggtgtcagaattaggccaacacagacatatgggatggtaggttcatttgggttggatagagagctgtttgaaacttgtatacacatttttcaatttcaagaagaaacatctgcagtaaaggaagaactgcatagtttgcagtggtctaatggaggtgaactcaggaatctcagatgcatttagctctacaagtctccattatacaaatgatgttgaatgtttcatctcttgctacagattagttttgggccatcatgaaaaactttcctgaagattaagtcaaacttatctatgcatgccttctttggatacatagatccacctttgacagctactctgtccactaattctgtcaagtaggactgagctttcttgaacacctctccttttgttaacaagaaggagaagaagaaaattaaacactcctggcatctgcctggctgtgatttagcccttggtaaaaagtattacaaattgagacggtgccagactgctcctgtgattcatctcttctcctgtcaagaccagttgaggcgatgcaattgggaacctctctagtttgtgaagagacactttatgttggaagcaacagcataagcacaatagtacttaggcattcaaagcagagagaattggttcctcctgattgggtgaacaatcactgcaaattaaggtcaaaagtattgtcaaccaattcagtgtactaggcttcttcatcatttcccatgacttgttctctcttaggagaaggtttagcaaattggagcaatttttttttttaaatcttggtgcagcgttagtgataaaacacaagaaagtttaaggctggatatagcatgtgcatctatatcaagatgaagatccatagagagatgtgcttgatcttgggatgctggatgaaaatccaggcactgtgttgtgggagcctgatttctgaaagttggggcatcattgtttggcttatgacgtttataagtgtcaggtacgtcttgtcccacagaatacttgttatagctgttaaaggacagattgtcttcaagacaactggtacccatgccagagtagggtatattctgacagaaaatccatttactctcatctgtaatttatccccttagttgaaacatgatcccagtgtagggcatttacttttcacactccgtttaaatcagtgtggtttcttcctaccttaatgaattttacctcatttctttgtcttgcaaaaacccagggcagaatggtaaaatttcaaaacaaatctttcacaaggctggaactagacactctgttgggtcacatgcaagttatttgcagaagaggaacactttgcatgtgaataagagaaagcaaagcacttacaccagtattcagtgctcttggggccaggagtgaggggccttccatgtttgcaggacatctgtttgggccttaagttctgctacagccccaagtccttatctcatatctgcctggtgtcctatttttctgcttaaagagtcaaagactgaaattcttatccttgtttcccattcattcctaagttactttagccttcacatggagccaccatgctgtggcccacagagtgtgctattcacttaaacttatttatcttaacctttttgtgaaatatggttgcattctttgactttccttgcttgtcacagtttacattaatcctggaacttttgagtcttaagcgctacatgatagtactctttctaatggtttctaatgttacacgaatgcctctctttcccatttcatccctttctctctgttggttttgactttaagctctctggctgtttcatggcaatgattattggtgacagtattatctattaccaagtgtttcttgttcagttttgcatagtttcaatgtccttttaagcaaggattgccaaactacaggccacctgtttttggagatgccatttaattggaacactgccatacccattcatttacatatcacctatggctcctttctcactacaagggcattgtttagtagttgaaacacagaccttatgtaccttcacctcaaaacctagaatatttactatctgactctttacagaaaaagtttgctgatctctactttgaagaagagaaagtcgtcagatacatacaatgccaaagaactgctggctatgaaagggatattgtagaattctgcaattttcttaaagaatggaaaacattggaaaagagtcacctgtttacaggtgatttgcatttctataggtatcagaataatgtgggtgcttgtaggttggggaaggaatggcaggccttctctctctgtcagtatcttcaggccctgaagtcatacaatcaatggattgcttttcctcttcacttttccattttgccataattttgccaagggggaggttggaagtgggttaatattttgcgttagaagagcatttggatacatcctgataattactttatctcagatattcttagattctctctagtgaaggccacaccttctctgtgcctcaggctggcatggcccaactgtgctacttaccttgggttcctgctgctcagcttaaagggaatctctttcatatgcctagagccttgtttactcagttcaggtctgtaccagttgacaccaagtcaaaaagcactttagacagaagcctgctttgaaagtgctagctagcagcaaataagtctggcttaattctcccttgagtctggagatctgattggaagggtaaaagggagaaagggatgatttatttgttgactggattgactactttatattagtaattatgaggcaattctacccacattatctcatttaactccccataaaaaccctacaagggaggtaatatactttggaaaactgagactcagagaaattaagtaaattgcaaagtccccatgctataagcattatagtctcataagcaaatgtcatgagcttcttctagctttttcttcatgctcacaaaatggttgaaggagatccaagcatcatgtttctagttaaaaagaaggtgcagagtaaaaggcaaaaggcaaacggacaagccaaccaagtttgttctctttcctagatgttctacttggtgacttcagcttatatctcattaatgtgcatcataggattatctctgcaagggaacctggaaaatatagaaatttgtttgtgttaagctgggcaccttgccacctccataaaaatgtgctctataggtacagagcaggagataatcattattaataggcaacttatagtctctgtttcaagaggtcattctggtacctgagaaaattgacaatctctggtctaaactcttacaggcctctcttgccttcatttaagatgaacttgatagaataaagattattgttgttctctaatctcctgggtatgagacagagaggtaacagatggaatgatttctttctggcttccatagcaaaccaaagcatgtgccagtgaagagtggcaactgctacaaatacttagccaaacgtggggaagagtgttgatgctgtaagtctcctagctatgtcgaggcagcaggtgtctctgtagatcagggcagcaatccctttggtaagggcatgaagagggcacttgggactactggattgcatcatcttggcagagaaaaatgtagcatatactggaactctagctgggtagggaattgacaagttgaaccacaagttgactactgttcagtcagcactagcttttatcttccagtcaccattccctgtggctcttcattgatcgtccacaagctccaggcctgggtggtgcctgttgtgatataagaagggaagagtgatggtttccaaaatgtgaacactcatgtgtacagttttcatgttgataatgaaatgctagaaggggaacagctagctgatgcctatgtctttgtccatacctggctacccatgacaaagttgttgttgttgtggttgttgtttcactccaggcacaggcacagagccgcaagagtagaaaacaagaattccatcctgcaaaagaaaactgaatcccccttgcttggtcacttagggaatcaagttcaggagggctggacatgttttctgttgctctgtaataggggctgaaacttagttcaattatggtgcttagctgaagcaccatgactgaatctttttttgagaaggagaaaggagaagattttaaaatgaaatgccataagtgtaacatagtacatatagaggtcacaaacttggaaagcctgtggtgtcttggaaggtcacataaatgtgtgaaacacgccagttgcacacaggcaagcatatgtcccttctagagaaattattgccactgaggaatgctggttctaatctccaccctcccttcccctcccctccactcctgtaaaaaccagaggtttggaattttgcgtgaataactcagtttgttagtgttgacaaccaggcatgacagtagctcatttggaccctttgtccaaatcaggaaacagcagcccttccttcatggcagccctgtagctacgccagtcgagtgtgggctggatttcagcccttactctcctccttagctgagactttgtgccagacacaagctgcccagctgtagacagtgggcccagaagttatcagtgttacatgagcaaaacaaaacatatctacgggccatactcagcccatggattattattttgcagcttctgtagctgcggttaaaacaaagctctggggccagatcacctgggtttaaatctgggttctgcccttcaggcaaatgactcagtatttcttggcctcagcctcctctatctgtaaaatgaagataaatacttgtacttacttaacagggttgttacgaggataaaatcaatactgtggggcaaacacttagctctacagagggtgacacatagcacttaatgttatataataccaaaatcatgtgaaaatctgattttttcacacttagagaatatacagcatataaaatgatgggagagtgcatgtcagaccttcatgattattttctgcttcttggggaaatgcttatgcctctttggtcactgtgaagacagagaactcaaaatagtaagcatcacttactagctggcctactaaggccacaagaacaaatgaagtaaacactctgcttgaaccactgattttgtttgcctgcatgaaacacttgcacaggttgacagctgacatccgtaacaatgacatcctaaaaccattaagaaatgattaaattaagttcagtattatctgttgcaaaagacaaagatgtgtgaggtacgttttagaataacttacaatgaaaacaactaaaaagtgaggaagtttaaagtggtgagtattcaattgcttgagttcatcttctacactggctcattatctggaagctgggccacagagttaatactccatctttaaagactgtcacaggtgtttgcacctaagatgcatcaggttctgcagtaaaaatttggttcctggcactgagacaatgctaggaggagggtgttaacttagtactgaccataatgaaatctgtggttgactgcaaggacctgggttgaaataagactaaatccagtagtattgctccggtaggttcaatcatattcaagtgttcaataatgattataaagaagtgtcaagctgtcatgcttactttaaaacatatccagaaaagagaatccaaggaagtgtatttagttctacctgcatttaaattagcttttttttttatcattacatcaatgtcattaggccctaaatgatattaagagtgtctatgagaccccaaagacaaagattgtcccctaaacttctattcttatttgtttaacatggacttggcccagctacctccaatctaaagcttctttctctagagtaaggtatctcaatctatgcactgttgacattttgggccagataattctttgttcttggggctaccctgtgcattttaggatgtttagcagcatctctggtctctacccactagatgctagtgacttccttcccctcaactcatgacaaccaaaaatatctgtatacattgctgtaatgtcacctggggagaaaatcttcctggtgagaaacactactctagactaagaaaagtagccagatttttaaacacaaaagtgtttttcctcccagaggcaaaaagtgccctagagatggaagaattttgaaaataagctcttccacaaactatactgccaaaatggttagagaaagatcctataatcaccatgcttgacaaatggtgtttttgctaagcctcacagcagctttgttcatgtattgtgttaattgcaattaaataaactagtctagaagtgcgggtcatcatccagcccattcatatccctcctttacagtacacatccagacttctttcagagttttgcttgcccattggtgctcacatataaaaactccgtgggtgggagttagggattcatagagcagagagggacctcagctcttcatgtccacttttcttgttttaaaggacaaggcactgaggtccagaaagtggaatttgcagcacaaattgctatgataaacctcagtgattcagcccctgggatcttcaatgatataggcacagaacatataactattactgagtaaaatgtttaaaattatgttcttatggcaatgttcaaggttttaggcataagtaagacaaagcagagaaaaaataaaaaatatttttcaaattgaaggcttaaaaaattaaggataccctctatgtgccttctgctttaggatccagaatcttatgtttgtttgctctttataacacatgactgtgtaatatcagtcaattgtgactggtaaatttccattaatttgcctaatcatatttagaaattatgcctactaaataaattatggttggaacttgaaaggaataatggcttaaataagtgatttgttctttagtcagaaaaatattctcacgctctctctcataccctcatgaagcactgtcatctccatctagtttataattaaggcaatgggaccaaagtcatcctgttggcacaggatggccatctctgcatccaaatttcttttactaattggagaaaaccactaattgtacattttaaactcaaaatgtctttatgtatatatatatttaaaatatattttattatttttattaatttattaattataattatatttattaaaataataattatttttattaatttatacatatgtataatttatgttttctccatgtggctagctgttgatctaaaggagaaggagcaaggcaggaaaattatcaggttcagtgtttaactgggagatgaggacatcactaaaagaaaggtacagcaggttctactggtatgtacaagttttgattacaaggtgtactcttgccacctggtgtggtgtctcagctaactttagtttctgattaccggggtctctgagacaactctccagggtcaggtatagagctccttttgcccttggcatgttccaaatcgcttccttatgctcaaccttctgagcaatacaaggaaaaattccttgtattggcatgttatgaaggttattgaaatactttaggaaatgcctttgaccttgttttgtacttagaggatgatctcattcagaaatgggtagtgtcaaaatatggaatgtgctagtaaaataagcacacaattcacttaaagaaacaaaaacaagacaagacaaaacaaaacaaaacttgtttgggatgggtgaaaggcatggggctgcaattcatcctggattttaaggttagaagtggttgaaagaaatgtgatatttttacctaaaccgtggtcaactatacttttactttttagcaatgatgtgaatgaagaatggctttgaagactgttggtggatttgacaaatatttatcaagagcctgctatgagtgtcaccattataggtggtagagattccacaatgaacaaaacagagtcctttcttacattttgtgaagggagaccacctctaaacaaatatatatcatgtcaggtagagataagtgccatggggaaaaacaaaatagggtaaggggctaggtggggcaggatcagaccaaggaatttatattttatataagattgtcagggaatgcctctctaattagatgactttttttttaatagaactgaaggacataaaaggacgaggcttatggatatctgggggaagatgtcagaggctgttataaaagttgcaacaggaaactgattaggactcttagcagacttatatgtgcttagaatgaaagggattgggataaaagaaaagaggggagctttgggaaagcattaaactgtggccatagcactgattggataaaccataacattggattatgggtctgcaaatttcttacattttttttaaagtgtcagacccatagccctagtaataagcaacatggtcttttctttgagcatagctgtaatgaacatgttattcttttggagttatcctgcaaagcttatcaaactcaagaagcaatagtttatatgcattgcccaggttgaatattattaatttgggttgggaagtgatatgaccacattctgactgactataggccctagttcagtttacctgattttatgcccaatttttaatgagaagggagcttgctaggccaggcaggaagaaagaaatggggacagtgtcaagcaggaaatgcagaagagttgagtgtaggtaaatcccatctttcctggctttacgttgccttcacatccctcataatgatcttctacctcagtcttcagtataagcagtatgttgttctaaaggtatgaagtcttggccaggcaccgtggctcacgcctgtaatcccagcactttgggaggccgaggtgggtagatcacgaggtcaggagattgagatcatcctggccaacatgatgaaaccccatctctactaaaaatacaaaaattagctgggagtggtggtgcacacctgtagtcccagctactcgggaggctgaggcaggagaatcgcttgaacccaggaggcggaggttgcagtgagccgagatcgcaccactgcactccagcctgagaacggagcgagattccgtctcaaaataaaataaaataaaataaaagtaaaggtatgaagtcttttccaagctaaggcaagaatgctgaaacctcaatcatagcacttttccaaaagagtcttaccttatattctggatctcttcattatctcaagaggggcttctttctctttaaatgtgaaaagaagagaggcatcagctagccctattagcccagggctaagaattgctccagatttttgaatgcttaaccttaaacaaagtcacatgtaccagtggaaagtggctcccctgttttcaaggacaggtcagattttaactacgtgcctcttaggcttgccctgtcttcggagttgttaaacatgcatgttgggagctgttgactgtttttttttttttttctttctttctttttttgccttataatttacttttattttaaatctattatactttgaactgttgactgttagagaaagcagtactggcttaggatcagcagagaatatggttgaattctatttcttaaactgaggagaatttctgtttgagcccagtccaagtcattacttgagcaattttttgcgcattttgctgcttaagtgtttattttttttttgcttttacaagtaattttttttaaaaaagttatcatacactcagcaaacattttttgagcacgtacacaatgcccagccctgtgccatgcatgttcaaaaaaaaaaataggtaacattatatctgtgcttgtgaaattaatacatttgttagaaagataagacttcaatcagtaaagcaatccaagaaggaacaagtacaaatccaggaaggagacattagctcagtggaaagagtccactgaggtaggtagacttgggtttgagtcagaagcaagagattgcttttgtgagatttcgcttatcctgtgtgggcctcagcttcctgttatgtaaaatgggataatagtacctattacattgtcacattggattgctgtgatgacttgataatatttatatacaaagcaaccagtataatgcgtgctcatagtaagcacttattatattattattatttattggacatataattagaaggtctgggttataatcttgattctacaattatttagttttggtaagtcacttaactttatcataccattcatgcatattacctataaagtgaaaggaacagaggttctacaatttatctcccaaattccatggtattttgaaccaaaatgtattgaataagtatttgatgtttgcttccccttcttgttagtgatatttacaatagcaataaaacatcaatatttatttaggacttgctctggagccacgagccgtggtgtgttcttgacattatgttatttactccatgctgcatactcagtgagacagataaccttgtcttgtttcctagatcctaggccatattttatccagtttaatatttctgaaatcagaatgtattatgtagtattatgtagttaataaatatatttaatgtggaatttttttcccaaaagccctttctaagtgagatggaccctcttatgatttaatgaggatgtcttccaagggaaataaatattttttctatatttctgatggtaaagttgaagcatagagaggataatttacatgaccaagattaatgaactaacaaaagcaaattcaggacttgaacttaggtttgttttatttaacaatgctcaccctaccgtacttcttgggagcaaaaaatttaaaaagtttctaacatatattcattagttctttccattttttatagcaaaatatatttgatctgtctctagaatcaatgatagattcactatttgttaacttttaacaggaatatattttagtccctctagcctgactttataggctatgtacccagtacatgaaaatatatagtagcctcagtttaatgttgatgtttatttgatgtcgacatcactagtgacactggtcaagcgtatccttttagataagagcctattagaattatatattccctgtagaaatcttaccttgaccatagtacatttaacagcagatttttctcagactttcaaaatcctgaaagtctgggtcattacaagaaaacaaggatgtggtcataaacagttgattattaagcaaattcattgaaaattaacagcagtattctttgacctcactctttatagccaaactgctaatcttgggtaaattataagattatattactaatccattgacatttagcacaaattagctatcaaatgggtcagttgttactgttggaaacttatgaaaatacattaaagttcttcccatttcctgtatgtttctttctctgacacagaatcttagaggcttttattaggctgggagaacttcccaaataatctaatgactagttgaataattgtttatgatataaaatcagctttgttgtcagaatgattacagtttcagggtcatagttaatagaaaaatatttcagtgaaggttaccattagtcgttgtaagtatcccttgattcaagaagtgaaacttttattgaaaaaactatttgcagagctggagccctgatgggcctttctgaagtttttaaaattaagaaatcctatctctacttttaacaagacatgaatgttagtatattcacccagactaaatgaatgaatgaatgatcacattacacatgcttgggatttgatttccttcctctggtgttcactggactagcagcttcagtactcaagtgcgattgtaaaattacacatggtggaattcaaaatggtgtacatcagtcaggtcctggaaagacacacaatctaactcagaagtttcaagagacttcaaggggaaatgtacagaagtatgggtaggattaaagtagctagcaaggaatgctgagtcactcggaccctagctgccatgagaagctattatctcttctggacctggagctgcagaagaaggaaaccgtgttactctagtcctgagagggccggagccatggaggaggggtcttgtgacagaagctaaagttctggagagacataggctaggccagagcataggaatgtggggaagacatccctgacctctctgtcaaccttctaatctccattgttcaaacccagtaggaagttatccagcattgagcctggagagtcagcccgcagcagtcagcctcctgagtgcagagcagaggaagacctggaatggatatgctataggaggagggccaaacagagagtaactagtccagatgggaaatgctattttagacctcatacactgccaaaaaagaatggcatattcaaggaatccaggaccttgacctcatttgatcttggatttgcatccattttctgatactttcttccaaatactcttgtaagcatctgacagcagccaggagaattgctggtcagttcagcctgtcccagcttcattgctgaggtacatatgtggttaaggagctgagagaactggtctgatagctcaccaaagggggcctttcccaaggaaaataaaataaagagaaaattcattgagaatctgtccagaaaggacagtaagtaggcatggaatcatagtagtaaggaagcatggaggaggcaggtgcataaaaatgacttgtgatatttttgaagctatatgataatgttctgacccacactcttgccagcctctgcaatcttctggaggcttcatatgaaagcaggattggtatgctgtttattataaatagtgagacctgagagatgattactgtcagcataaatggatattacacattgcacctatctcccagcaggaagtttgtttgtttgtttgtttgttttagacggagtcttgctctgtcgcccaggctggagtgcagtggcacgatctcggctcactgcaagctgcgcctcccgagttcacgccattctcctgcctcagcctgccaagtagctaggactacaagcgcccgccaccacgcccggctaattttttgtattttttagtagagacggggtttcactgtgttggccaggatggtcttgatctcctgaccttgtgatccacccggctcggcctcccaaagtgctgggattacaggcgtgagccaccgcgcccaaccagaagtttgtgtttgatgtcactgttgtttcaccaatttaaaagaaaatgaatatttttaaaggaaaagaaaaaagttatcacactatgtgatgaaatttgtatctatgggtggttatttgctacttggtaaataattaaagcctgtactggttacctttcctttagcagctgacaacaaataaacatcctcacctcacaccttatacactttactccatggttcattttcagtattattttgtacttctcttgcttcatcatactattgcctggcaaaattccaacccagatttaatcctgctttccatctataccctgcctacacctgagagttcaatgttactgtggaaaatgcacactgtggtgacttgtttcactttaaatgcatgggccctaacctcactgagccatttattagtaatgattggcaactctccatatttcttgaatccactcactttcctagtctcctggacaactatgtgacaactcctctatcctcaagcctccaacaattacttctcataccctaactctgcgcagataaccttttttcctatttcactgcaaaaagcccagaagtaatcaaaagtgaatctacaagcttccaccaccacatctactcctcccagtctcagtgaccatatggtttgccttccttctgttaacagagagcttctatcaaagatgaacctctccacttggcactttatttccctcttgcatattcaaggacattagctcagcaattttctttctttctcctttcttgcattatttattttctccctccaccagaagttgtcaccccaacttctattagaatgacttaggaagtgcaggcctcaaaccttttttttttttttttacacgtctacctctattagcactccctgctcctattttaggaatccaggctttaacgctaacagttacaaattaagccacaagctttgtaagtatttgcctgtgctctagctgctagtgggtttttggaaaatcagtatctgatgggcatttgaatacatttgctcttgtggctttaaacaatgtctgtacaataaaaacttgagaatttatctcctctgaattctagacatttctattcaactacctagctggcatttccacttgcatgccttaaaggccctcaatcttatctgtactgaatcgatcacccccctaactgcctcatccgtcagttatccccattgcagttggtgacattccatcctttggttgcttgggttaaaaaatgttggagtcccccttgactcctttctttctctcatttcccaaagccaattctttggcaaatagtaaccatttatcacattttccactgctactgttctggtccaagccaccatcctcattcacttggattattgcaaagacctttacctgttctatatgcttttatatttgctcatttttctcccttcacccctattttgctttcagcacagtatatcatctcatgcatctactcaaagccttctaatgccttcccatttcatgatggcctataaagccctttgtgatctggttccctgaaatccttgacttcatttgggcagatgtttctgctataacgctatttatgtgttctgtaaaactttttggtctgcaagatgtactttgaaaaataacaggtcttatggtaaaattacgattggaatagaacactcatatcttatacaacataaaaaactgtagcaataaccaaagcaataatagataccttgggagataacaggaaggcaggcagctcagattgactgaaggcgactcaaggaatattaaaaatgcacaaaaacagtagcatggagatgccggctggggagctgagatgagacagatgaatggagctctgagccagagggcctaccacaaaagtggtcataggaagaagttcagcctgccttgagcagatagctttgcctggtgggagagggcgtatttcttgggagacacctctgggtgcaggcgctcatctttaattcccttaagagagctgaaatcactgcagtctgtgcagcagccaacttcagggatttttcctttcctgctaaggttataattctgttcttgctattcttactcctcttgcctaagaaaaatcttgtttccatgtaataccaatattatcccactatttaccagtagcatatgagctgcttgctgttacagaaacacatgctgtaatagaacagactgcactccttgggtcatctttgttatttcccatgtgtcaggtgagcacccaccttgtgacttttgctactggtctttccctgcctggaatgctttccctccagaagtcctcacggatttcttcttctatttcagttctttatttaaaaatatttttcatagtttgaacctctctaaccagctgatttaaaagaacaacaccaccccaacaacgttctctactttacatcatagtttaattttctccatagtatttatcatcatctgatatattataatactcatgtattggctgaaccacatccataagtattaagatccgtgagggcaagacttgtgggtttttaaacttgttttcctcctttgtttttctctattatatctttagtgtctggaataaggttcagcacatacaaggcatttactaaatgttgaatgaatgaatgaatgaagctcaagctccatctacaaacagtcctctgttttttgttttttgtttgtttgtttgttttttgtttttgttagctgttatctggctgttttttattagataataatttgtcttcctttacttactgattttgtttatgtgtttgcaggtgtgtgtgtgtgtgtttgtgtgaaagaggagaatgacttttatcaaacctggttttatgtcttccttaggatgcatcagagtttcatgctgttcacactacccttcggggtattcagacatttaaagtcttaatatttcagcaataaagtcttaatatttctggcctggaaaaatactgtgatatgggttgaattcatctttttgcacccctctatcatcataaccactccctgctcccattctaggaatccaagctcttatgctaacaattaaaaattaagtccacagactgcagatagaccctacgcttgagctgccggtgggttgctgaaaaattaatatttgatggaaatttgaattaattgcctctttaccccctaccaatccctgtgtatggtcaaaaaataggacattccaatactccacagtgatggccacagtgctggtttgtgctgatgttataaaggagcaggaagatggtaatgaactccctctggtgctggacaaggcttcacaagggtgctgatgaaaacaatgtgagaaaatggactcaggggttctcaaggcagagaatggtggggggatccaggaatccacatattcaaagacacaaagaagtacagatttctgaggtgttcagggaatggtgattcattaggtatggggctgggggtggggcacagggtaggcagaggagagagcagtaggtgtatatgccatgaagattttggaatcgatccaactatacagctatcaaaggtttttggtgatacaaccagattcgtcttctcactccttacctttctcacctgatccctccctggcttttccaaactgtcaactataaggctgtgtgaccagagagcatgcccctgtccccagtactcagataagtgcctgacatatatatatatacatagacaacctacttgtttatgtgtctgaacaaactatcaatattcatttctgcattttcttttcagcaatgcttacactgtcttcaaatcctttagggccctacacttgactatcaggctgcctattgaaaactaactttacaggttgttcattggttaccatgatggcacaagtaaccattcagtaactttttttttttttttaactagaattgaaagctttgatccattctctttttctggtctcatttcccttctaccagatctgattcatggtgcaacttttggtggcatcaccccttaatccagcaacatttttgtataccctgaggttattactttgatgtcctgaacttatggctctgggggatatttttttaaaggggtcagagaaataaggttgaattagagagattcttagaagtttatgattaaaacactatcccctctgatctgagtcccagctctgccattgacaggttgtgtatcattagcaatagcaagctacttcacatttctgaatctcagttgattgagcaaaatttagataatcaaagactactggagatgtgatgctttgacacaaagaaatctacctctttggtgaaatttcaattgtgtaggagcagttatttgggagaaaagtgccctctcaccttcttaaatcatctcctagggctataataggaaatacgcagcttttgctgagaacccaaatgacattgtggattatccagctctagtcttctctctcccatatagaggccggttatctttgtcacttcacagctcattagcagccccactcagggccatggagaggaaatagatgagatgaagcttaaatatgtcacattggttatttcttagcagctctgataaaaggcttagcaggggccaggcgcggtactgtacgtctgtaatcccagcactttgggaggccgaggtgggccgatcacctgaggagttccagcccagcctgaccaacatggagaaaccttgtcgctactgaaaatacaaaattagccaggcgtggtggtgcatgcctgtaatcccagctactcgggatgctgaggcaggagaatcgcttgaactcgggaggcggaggttgtggtgagccaagatcgcgccattgcactccagtctgggcaacaaaagcaaaactccgtctcaaaaaaaaaaagcttcagcagggtgaggttaaaactcaaataaagaggtctgaggattatctgtgatgttagctcatgtgtgttaccttcctgtcttcccttctttgttcttatttctagggattagttgactgcaaacattaatgggttaaatataaaaatgactgcaaacattaatgggttaaatataaaaaatcttttctatcctgaaggtctttgaaaaaatgattttattacttactggaaaagaaaaataaaacaaagcttgcttcacccagaatttattttttcttctagttaaaatgagcaacttctttaaccagaactgaccttgaagacaaatggctaaaataaaacatttgctgaattcactgggcgcatcttacaagtaatttttggattctgcattgactacctacaagtgccttctgggtgcaagtccacaggcaagatttgttctgcaaatcttccatgaccaaggtcacctctttggattggcagacccagggagtccatattgggaagataaattcacacttcaccccttgttgagatctccagccttgctcctctgataaccaggtctctcttctgtcctattataatttatgacctttgaaaagttacttatatctggggctattcaaactcccagctatctatgaccatatgcataaatggttctagatttaaaaaaaaaaagaagctattcagagatattgggataccctataaccaatataaatgggtaattcagcagaaccagatgctggggttgagaaatagatgtggacaattggggcagggcctaagaaagatcggaggcaaagacagtgactagatggggagctctgataaggtaatgcccaggcctgtgcttggaattctgccacagtggggacattagtgggggtctgtagtcattgcagggtgagaggaggatagaaagaaaagattgtgtgaaggtcagtggaaggtcccccatttcattgctaagagaactatgtatgcacgttttcctgtgtttagtctcacacataattgtacctttaagaactgatcacacactgcatttccctggcagtttttggcatctcagatgaggaagagtgatgggcgacaggtgatggtgacaactattaataagatctgaaagtaaacagtctcatgaaaggtggccaggagagggcagtcaccttttatcaggagcacagactgaatttgcaaagggtacttaagctacaagactataaagcatgatgcaggcttaaccaaaatgcagtgtcttgagcatagtagactcttagtgtatgtttgctaaatataccttagctgctgctgttccccagagctcatcagagttccatagaaacctggtcccttccagaaaaccaaagaatgactaaagaaaagtgattgcaaatccagaaagcagctttgccttactggttggtaacagcaggattttcttttccttgtagtttattttggcttaggctagtgtctctttcatgaagacagctactatttacaattgttgttaacatgtttttcctttttcatctcccaatatactctcttcctgtcgttaaacacagtcaatttaccaatggaatctgctttataagctcctgcattttctttttccacagatgggattaatgccattatgttctatgtcatccacatagtcttggcttctaggcaccaaggtgttgttctagaggaaagaagagtaatggtcgacacaggcaggctgagggctaacctaatgatttcatgcatttagtggtaattcttaattaagatcccaattttattctgttggatttagtctataacccgctgaaaatcattcttgaattaacactgggtggatataaaagcagaaagccaaggactttgcactgttctcagctgtagctgtttatttagctggagaaaatttagtgggtggtccaaccttcataaccaggaagaataaaatagaggtgtaaaggccttggtggaaggagggcagtagcaacctttccatttcttcagttttatcgcagcctatgaaattagttccttaggtatgttgatcttgtaggagctagtattttaacatttgctccatcaagttgtttggtttaaatctaagaataagcccactgaaaactattcctaatttgtgaaacgaataacaataatagatgttaatagaaacaaagacttcatttggttagtttttagagggggcacagagaatgtagtaacataataagttagatttttgttgttttctttttcttagttctttgtagtctttataatctctaattggcatttgctcctgacttttctcagtgtacttccacatggaagagacaaaagtctcaaagctggtgtagaaaaacccttaataaattgcccattaattagccaccttgatttccacctttaaagcagttaattgaagtaagaatttgttagatttttctcaagcatagcagaaattaagattaatttcttaggtgtcattgctacttgcctacttaaaccaccagttcatctttatcataaatacttaagccaaaagtcacattagaggcaatatggcacagtgattgtggaccccggagtcaggtgagctggttgaaatcctggcttggctacttcccagctatgtgatcctgggcttcagggttcccttttgcaacatgacatgattgctgagctgcttcttagggttgtgtgtggctccggtaagataatacaggaaaagagctgaaagcagtatctgaccctggagagaaagtagggaagagacaatagaggaaagaggacaaggaagtgggagatgaagagaaagttcaagaaggaaagtggaagaatctcaaatagaaagttaattttcagtttttcctgagaagagatatatagacatcttcatgtggctttggagagccttggagcccatcagcaagacggttggaaattatactgaaacagaagtgtagacctatgtgacttatgtcctggccagttgcctcatgtcctctgtggtcaggttgatctctactggcactgtcaaaagattttttatggacagctggttggggtaaactttgaaacctgattgtttgcacttgagtgccagagtgtgtaattatttaccggtgttcactaaggatgtcagtgtagatttttagggggagaaaaaacttaaatttaaaatttggaggcatctttttcagtctgcctgccctggtgtttgttataacacttagtttggcatgtaacagctgaagctactggttaaatcattaagcatttattattttaaaactcctcttctcaaagcaaaaaataactatcatgttgaagttctttcctctaagaatgacatttactgtgagttttataccaatggactaattggagggttgagaaaataaattttggaaagacaacaataacttcagaattttccttggatggaggtttcctttttaaaacctgaactgagctttatcaaaacagtaactgaactttgaaacgaaacaagagtgctgaattgaaagctccaggaaggcagggatgtgtctgtgttgtttatgactataacctctgggcctaaatcagtacctatcccatggtaggcactcggtaaatactgaaggaatgagtacagtatgaaaattagcatggctgatccttggaaaaaatataagtcaaaagggaatagcatgcatgtgtaactaaaacatcagtccacatgcttgaaatgtcatcacttttttatggtcaggacctgtttttttctgctccaattaaagaagaaaattgtaatgtgaaagaagcaagaagtgaagtatttggtattcatgtgttttgacatctgcagtaagtttaaaataaatttctaaatcttattgtattgaaattgtatgagtttcttaagtggtattattcattcagacttaaagtgaagttaggttgctgtcactcatagtggacttttttttttttggcattattaaaacaacatgtcttctgggtgttgtcttgtattacaaaagcttgcgtgttttctcttgatgctgtgccctgtctgttgccattgaggggtctaaggaccaaatgaggtcttgtttccttcctgatattcttttgaccagtttagaatatgccaggtccattcacacaactaagcggctcagttctctcagttccctggtcttctcatattagattgttatctatgagcttgaagtttagacatgaaaaagaatggttgtaatcctcttccttctctcaccctcttccctttttttcttaagttagccttttgaattcatgattctaataattaatatatattattatataatatagtatatattcataataatgattaatgatagtattaataattctgtgtgtgtgtgggcagctactcatacagaggaaaacagattgattagtggaaattacattaatttcataacttcttattaaaagagtttgtgtgtgtgttgttggttgtttgttccctttgcaactcaacatggtcttcttgaggtgtagggaaaacatatgcttaggaaacagagccttcttttctccttttggtatggaagacatatgcaaaaagaatgaaggaactaattgtctctagccagggctctgcaaaaatagtactggtagagaaaaagctctaaaagaagtaaaagtttatagtgctttctcctggcagagttaacctcatcttcatcagcttttcccctgcctcagagaggcagttttggaatgaccaaagcagagtgcccaacctctctgttcagagttagcgagcatttggatcactctctctctctgcctcagtatgagtggaatattgcatgaccatttctgatttctgccatgagcgcactcggcctagatgaataaatcctccttgaagaaggcggggcattttggcattcacaagaaaccatgttgatatctgatcctcccactggagaaatgtggcaaagtgagaaagactcactctttgggactccaaaaatgtaaacacaagtaagcatgcaagctgaagaagtcacttgaaatagaaaaaaaaagtgttaaactctctgttagtcatgtgactttttcttggtattcgagagccaggaggctcttgtggtctaatctggaaagagtcgctaatcgctgtgtcaccttggcaaattggttgatctccctgtgctggagtgtttagtccagctgctggatgggatgaaagcaagacctcactgaaaccagatgctgtctctctgaaaagatttcagcaataaataatatcgtatatactttgttcctggcagcaaatactgaactgctataaccctctgttttcacttgcttctaaatttctggaaatatctcctttgggcttgaatttttccatgcttgtcttcagcccaaaactttttggaaagtttgaccaaaatttcacttagctgtttttcctgaattatgggagaataagggcaatgcattgtttttcagctcataaattctcatttttcccattattcctcagaaaaatagctgctacatttaaagtgtttagaactagtaaaagaatcttggtatggtaaagaatactggcagaagacaaatttaagtctctcagtatttccttctaactttaaacatgactgcacacaatcagggcacacataaaaagctctgatgtagttttatagatggccaaagagaagattctgcaaattctctcagtaactcatcccaagttaccaagaggcaactttagctaccatcagttgttacctttctcaaccacttgctctgtctgtggatctgatttctaaaaaaatgtcatggttatatgttggcattgaccccttatctacattttaaataaagttgaccatttcttttaggtagccttcatgtgtgatgacctcagtcatatctgctgacctactagactcaaaattcctttacagcagggcctaggtctgtctacctcaccattgacactgtagtgctcagcagggtatgacacatgtagtaaaaactgattgttgaatgaattaaatgaacataagtacagttgtttttgctgcaatttgttcattgatttgtccactaagacatgcatgcatgtattcagtgagtatcactgagtctctactttatgccaggtattggtatgaatgttgtgaatatttctttgctttgatggataacacagaagttttgctgatacacaacaaaataattatattatttgagtacaattactatgcctatagttggaatattagtccaatatagctaaaggcaatcccagggaatttatcacttactgagcgtccatgatgtgcctggccctgtgttaggtactgagaagagatcaattagacagtttctgcaggaagtcacacataggttaacagtgccaagacaaatcctaaagtacctattatacaaggggaactataataaagagccaggtgagttgaaggcaggagaggtatcattgtaccacaagataccttgtgatcttgtgtaaatcccctgaacaatcaggaaaagctttatggcatagctttatggtcagagatctcatggggacaggcagttagttgcaatgccttttatagccacatccttcactccttaaccctgcactgtctgccattcattctctctgtgctttcagccttgagaagctggccaaatttctcaggactggaaaataaactggaatgacactcaggcacttgatatcaagattattagggtcatgattgtgtttaagaccctaagacctcttgatgcttttacaagaatgggtactttttttgtccctgttttcttcttttgccccaagtttcaagagcatgttacagcagcagtataagcatacacaatcaaaggtgattgaagtgaggacaactggctcaatgagctccagccacttcaactctcctcctagtccctgtccccttgcccggaatgcttcaccctcagactttgacatagcaggcttctttttgtcattcagatctcagctcaactgcaaggatttctctgacctgaagttacatatgtgtcaccccttctggtctccgttgctctctatcacatcacctattggactacctttatagcatttatctccacctgattgtgtccttttcactgtttttctttaaactttttattgtcaattttctttcactagatgccagttccatgaagtaggaaacctttaccactggtcttgagtgctcttgaaagtgtacgtgtgcaataggcactcaaaaatgtttatggaatgatcagctggatgcgtatatggcaagtggcgagaagccaagggaataggacaagagtcctattgtgctccttgcctgaagaaaacctcttgcaagaatcataggctgttcttgagggtgcctttgccttggattcgccaaaaattcttctgtttcttttgtgtgaaaattttcccctcatacacagcaatgggcactaagaatgcatatatccagacttttcaggttacaggatggcatctcagatatagtcttcctttgatctatatactatgaagccataattgcttagccagtatctttttcaggatttactccatatttcttattctaggcctttcaggtggcagctgcactggctttcagatataatttagaatttagtttcggatttgtaaagctactcatgctgcagatcttctctgaaacatttctgtcacattttagaaagctttacattttcatctgctaacgattttcatctgccaaagagcccatctacttaaaaagcagatcactgaagccacacttggcacatattactttggcttattttcttttgatttttttgctttgctgggattacttatttatgaagaaagagagaatattgacttcttattttagaagagaggatattacttgggttgagagttctagttatataaaatgtatttatctaagttgttaactatatcaaaaatggagcagtcaatctttggaaatagttcagggtgaaatgtttttagcatgttcacatattctctttgctgtttttaaataatttggcaaagcttatttgcatttcccaaattaacaattttggccaagaggaaaagctaaagtgttggtttttctcagctcaactttttgggtgtaattaatttataagcaagattttatgaagggagaacagataggacctttctacaaagtccctgagccaaaataaacaccccattgttccatcgttttgtattgcacataggaaaacatccatccctatcattattctgttaaagggacacagattaccagatttgtaattttaaaaaaggccatttgttgattgagccactttgcgtataaagggtggtatatgttgcctgccgaatttctgtacaagaaaaaaatcatatatcaaaaaaatttttctcattcatcatataagaaatttatgcattttagtatgtaccagaagaaatggctttggcattttctgtttttagcagtctgttgaaatttcttcattaaagacattttctgtttgaaggttaaaatgaccatataaatacagattaattcagttttaataggtgcatcttcctgtcatttaccactttctctcctcaatatcagctacagtgatcaacatatatttagcagtgaaactgatatattctgtttatcttcaaatcataagctttttgtttaaatacaaaggaaaatcttatacctctgattttaatatgacaaatcaaaaagtccacaccaaactcccaactcatcccaaaaaagagattgctatctactcatcactgttctctgcttctaagatttgtttcccttggggttactgtttgagcaacttttcttacttccaagattgtttttgtggttttaagaaagaatctgaattccaagattatttttctggttttaagaaagagtctgaaaatctagagattacttaccttgtggtgaggtggttgtctatgcttctgttcaacaaaggcctcatgtactgaatggaaaaaaagcatcaggacctataattttctaggcattatgcaagataatagaggagacaaaaatgatgtcttgcttcaaagtcttagatctatttccctttgggggttgaggaatgagaaagagatttttagatgaaaaacaggaagcccaatgaggacgtgtggcaatagttcctaaaatgagcaaagagataaatttactcttttatatgattacaaccaaatcacacactggtgagtttcaaaacagtagttttcatttagaaagcaaattaagtggaataattcaactgagtttcactgcaatgggattcattctagatggttcaactctggaattagaaacaatatctaaggatgttgctgatagtagtcagcagataaataccagtaagtcgtatacaggtatacatcattttattgtgatttgctttattgtgttttgtagataattgtgtttttacaaattgaaggtttgttgcaaccctgtaacgagcaagtcttctggctccatttttccaatgacttgtgctcattttgagtctctgtgttacatattggtaatccttgcaatgtttcaaacttttttattattattatatctgttttggtgatctgtgatgagtgacgtttgatgctattattatgttgttttggcacaccatgaattgcacccatataaggtggggaacttaatcactaaatgttgtgtgtgttctgactgcttcactgaatggctcttcccctatctctctccctctcctctggcttccctattccctgaaacacaacaatattgaaattaggagcgttaataatgctacaatgacctctacgtgtctgatatggtttggttgtgtccccaaccaaatctcaacttgaattgtatttcccagaatttccatgtgttatgggaggcacccagggggtggtaattgaatcatgggagccagtctttcccatgctattctcatgattgtgagtaagtctcactagatctgatgggtttatcaggggtttccacttttgcttcttcctcatttttctcttgccaccaccatgtaaaaagggccttttgcccccagccatgattctgaggcctcccaaggcatgtggaactgtaagtcccattaaagctatttttgttcccagtttctggtacgtctttatctgcagcatgaaaacaaactaatacagtaaattggtaccagtagagtggggtattgctgaaaagatacccaaaaatgtggaagtgactttggaactgggtaactggcagagtttggaagagtttggagggctcagaagaagacaggaaaatgtgggaaagtttggaacttcctagggacttattgaataactttgacccaacagcctgataacgatatggacaataaagtccaggctgaggtggtttcagatggagatgaggaacttgttgggaactggagaaaatatgactcttgttatgttttagcaaaaagactggcagcattttgccctagagattcatggaactttgaaagtgagagatgatttagggtaactggcagaagaaatttctaaacaacaaagcattcaagaggtgaatgcttgggtgccattaaaagcatttcattgtgaaagggaaacagagcataaaagttcagaaaatttgcagcatgacaatgcagtagaaaaggaaaacccattttttgaggagaaattcaagccggctgcagaaatttgcatgagtagcaaggagcctaatgttaatcccctagaccatggggaaaatgtctccaggccatgtcggagaccttcatggcagacctcccatcacagacccagaggcccaggaggaaaaattgtttttctgggccaggcccagggtccctgtgctgtatgcagcctaaggacttggtgctctatgtcccacctgctccagctgtggctgaaaagggccaacacagagctcaggctgtggcttcagagggtggaagccccaagccttggcagcttccatatggtattgagcctgtgggtgcacaaaagtcaagaactgaggtttgggaacctccgcctagatttcggaagatgtacggaaatgcctggatgcccaggcaaaagtttgctgcagagttggggccctcatggagaacctgtgctagggcagtgcagaaaggaaatgtggggtcagagcccccacacagagtccctgctggggcactgcctagtgaagctgtgagaagagggccactgtcctccagaccccagaatggtagatccaccaacagcttgcactgtgctgctggaaaagccgcagtcactcaatgccagcccatgaaagcagacaggagggagactgtactctgcaaagcctcagagtagagccgcccaagaccatgggaacccacctcttccatcagcgtgacctggatgtgagacatggagtcaaaggagatcatttttgagctttaaagtttgactgccctgcggcatttcagacttgcatggaccctgtaatcctaatcctattgttttgtccaatttcttccatttggaacagctgtatttacccaatacctgttgtatctaggaagtaactagcttgcttctgattttacaggcttataggcagaaaagatttgccttgtctaaggtaagactttggactgtggacttttgggttaatgctgaaatgaattaagactttgggggactgctgagaaggcattattggttttaaaatgtgaagacatgagatttggaggggccagggccagaatgatatggtttggctgtgtccccacccaaatctcaccttgaattgtatctcccagaattcccacaggttgtgggagggacccagggggaggtaattgaatcatgggggccagtctttcctgtgctgttctcatgatagtgcataagtctcctgagatctgaggggtttatcagaggtttctgctttcgcttcttcctcatttttctcttgccgccaccatgtaagaagagtcttttgcctcctgccatgatttggagggctcccatacatgtggaactgtaagtccaattaaacctctttttgtttccagtttcagatatgtctttatcagcagcatgaaaacaaactaatacagtgtccaagggaaaggaaaagtcacatgtctctcactttaaattaattaagcttagtgaggaaggcatgttgaaagccaatataggctaaaagctaggcctcttgcaccaaagagttatccaagttgtgaatgcaaaggaaaagttattgaaggaaattaaaagtctactccagtgaatacataagttattaaaaaaaaaaaagtgacacagccttagtgctgatatggagaaagtttgagtggtctggatagaaaatcaaaccagccacaacattttcttaagccaaagcctaatccagagcaaggccctgactctcttcagttttatgtaagctgagagagaaagctacagaagaaatgttggaagctagcagaggttggaaatttaagaagccatctgtgtaataacataaaagtacaagatgaaccagcaggtgctaatttagaaggtgcagaaagttatccagaagatatagctaagatcagtgatgaagattactaaacaacagattttcagtatagataaaatagccttctattggaagaatacgtcaatagaagatctaagactttcatagttagaaagaaaaagtcaatgctgggctttaagacttcaaaacttcaaagggaaggctgatcctttttttatgagttgatgaagttggtgactttaagttgaagccattctccccagccttgctagagaaaccaaaagtcaaattcaggaaatacagagaacccctgcaagattctacacaagaagatcataccccagacacataatcatcagattttccaaggtcaaaataaaagaaagaatgttaaaatcagctagagagcaagggcaggtcacctacaaaaggaaccccatcgggccaacaacagacctctcagctaaaaccctataagccagaagagattgggggcctatattcaacattcttaaagaaacaaatcttcaaccaagaatttcatatccagctgaactaagtttcctatgtgaaggagaaagaagattcagagaagcaaatgttgtgggagtttgttagtaccagacctcccttataagagatcttgaaaggagcactaaatatagaaaggaaagacagctaccatctaatactaaaacacacttaaatacacagaccagtgacactataaagcaaccacaaaagcaagccagcataaccagctaacaacacaatgacactatcaagttcacacatatcaatactaaccctgaatgtaaatgggctaaatgcctcacttaaaaggcacagagtggcaagctggataaaaaagaaagacccaatggtatcctgtcttcaatagacccatctcacatagcctcaaaataaaggggtggaggaaaatctaccaggcaaatggaaaacaggaaaaagcaggggttgcaatcctaatttcagacaaacagactttaaaccaacaaagatcaaaaaagacaaagaagggcattacataatggtaaacggttcaattcaacaagaagacctaactaccctaaatgtatatgtacccaacacaagagcactgtattcataaggcaaggtcttagatacctacaaagagacatagactccctcacaatattagtgggagacttcaacactccactgacagtattagatcatcaaggcagaaaattaacaaagacatttaggacctgaactcaacattggactaaatggatctgatagacctttacagaactctccacctaaaaataacaaaatatacattcttctcatcaccacgtggcacatactctaagattgatcacataattggaaacaaaacaatcctcagcaaatgcaaaagagctgaaatcatacaatttcaaaaatcagagggcccttaagaattatgctaaatctactctgtctatactctataaatggaacacaatacatgtgtaatagtacacctgtttacagtatggcttgctgaatattttaaggccacagttgagacctcctgcacagaaaaaaaagatttttttctaaatattagtcctcattgagaaagcacccagtgaccaaagggctctgatggagatgtacaaggaggttaatgtagttttcgtgcctgttaacacaatgtccattctgcagcctatgtatcaaggagtaattttggcctttaagtcttattatttaagaaatacatcttgtaaggctatagttgccatagatagtcattcttctgatggatctaagaaaaatacattaaaaaccttatggaaaggatttaccatcctagataccattaaaaacatttatgattcataggaggaggtcaaaatatcaaccttaacagcagtttagaagaagttgattccaattctcatagattactttgaattgattcaagacttcagtggagaaagccgctgcaagtgtagtggaaatagcaagaaaacttgaattagaagtggagcctgaagatgtgactgaattgctacagtctcatgataaaacttgaacagatgaggaatcacttcttatggatgaacaaaaaaatagtttcttgagatggaatctactcctggtgaagatgccatgaacactgttgaaatggcaaaagatttagaatatgacataaacttagttgataaagcagcagccagatttgagaagattgactccaattttaaaagaagttctgtgggtaaaatgctgtcaaggagtatcacatgctacacagaaatcttttatgaaaggaagaatcaatcagtgtgtcaaactttactgttgccttattttaagaaattatcacagccaccccagacttcagcaaccaccaccatgatcactcagaaggtgtcaacattgagacaagactctccaccggcaaaaagattatgactcactaaaggctcagatgatgattagcatttttagcaataaagtatttttaaattaaagtatatacattgtgctctttttagacataatgctcttgcacacttactagactacaacagattatacacgtaacttttttttttttttttgagacagagtcttgctctgtagcccagtctggtgtgcagtggtgcaatcttggctcactgcaagctctgcctcccgggttcacgccattctcctgcctcagcctcccgagtagctggaactacaggtgcccaccacaatgcccagctaattttttgtattttcagtagaaacggggtttcaccatattagccaggatggtcttcatctcctgaccacgtgatccaccctcctcagcatcccaaagtgctggtattacaggtgtgagccaccgcgcctggccagacataacttttatatacagtaggaaaccaaaaaattgtgtggcttgctttattgagatatttgcttcattgcagtggtccggaactgaactgcagtatcttcaaggtatgtctgtattcaagtttatattttgacatacattcttctttacttgttaaaatcatggtcacctcattattatatgactgatcagaatttgcagggttgctttgaccatataccattgttctacaactacgcagatgtctgagtcctaaaggtgaatctgtctggccagttctgggtttaacggcctatataaaaagtagatgttacacaccttgtataactgaagcgccctatcacggacacagcttaactcttgggtgggtcacttagtctgcttggttgaggtttcagtgcttttcacatctacagaaatgtcctatttgtctaaggcaattttatgaagtaaatttactcttgtcatcctttccaacctgaaaatagaggatatataatttttagcattccattattacctaggggatggtcttcagtcattcttccctgaatttattacactggccctatcttcttcacctgaaataagttaaatgtagaattagcactaaagagaaatagaatgaacttcttccggaatgggaataggaaatgaaagagagtaaatcagaagtgaatcacttcttttttttttttttttttttttttgctttgcaaatctatatttttttccagctttatttaggtatgatcagcaaataaaagttgtatatattcaaggtgtatgacatgatgatttgatatatgtgtacattttataatgatcaccatgatcaaattaattaacacatccttcaccacacagttaccatttgtgtgtgtgtgtgcaagaggaggtaagggagtttaatcatttttgaacactagctacaacataattcaattaaaattctgagaaagaagaaaaattgtcatgcagctgtttaattttagaagcattaactgacaaaatccaagtcttatgatgaatactcagtcaaattttcatgaatgaatgggagcctttacctctgaaattgttgtcatggaagaaaacactaacactgtcttacacagtaattcaagttaccaattgagttaaagtagcaagatgagccatggttgtaattgagaatggcaactatggtgttcttatctaatctgctacctagtttgcctttttgctctaaaatggtgactatgttagaattcaaagaataaaaggcctttatcctttcaggggaaatacaagtaacaagcttaattttttttttcttaacactgatgaaactcatttggggctgtggaaattgctgctagcattgaacctcttattaacattcaaggtgtgccagttttgcacaagctgtgtcatattcagagatagattgttggcacaaactaaggcacttattctcttgttttttcacttctttcaataagaacagataaatatactatttctagataagcagttgaaactgttctgctcatctctttggaataggtttgtgggggtatcactgtatgacatgccgaagaaatatacaagggaaatgctcccgcatacattgagatataaatgaatgcctattttagaatacgtcatttcttaaaagtaaaataagttttggctgggcgcagtggctcacgcctgtaatcccagcactttggaggccaaggtgggtggatcacctgaggtcaagagttcaagactagcctcgccaaaacagtgaaaccccatctctactaaaaatacaaaaattagccagacatggtggtgtgcgcctgtaatcccagctactcagaggatgaggcaggagaattgcttgaacccaggtgatggaggttgcagtgagctgagatagcaccattgcactccagcctgggcaacagagtgagagtccatctccaaaaaaaaaaccaaaaagtaaaataagtttttaaagtcactgattctgtttctaaggaattctcagctggggcttctgagtcaattctcgatggttagaacttatgagtagcagaaaaagaaaactactatggattttctctacaatgatttgagacagtgaatggggctttctggcaggttagcagttaggaactcagatgaccatagacttttttttttttagagtgggtctcggtctcactctatcacccaagctggagtgccgtggtgtaatcatagctccctgaagcctcgacctgggctcaagcaatccacagatttttgaagttcaccctggattgttgtgttctacacagaggttccaccttttgctgccttttatggttactatattattattttgatgtttcttaaccagctgaatcacattgtagtatatgaaatatgttttggctcttgttttaatggttatttgctagcagatttcacaatggcccaatgaaacaacccattcattgctatttgttgcaattcatggtgactaaacatgactccatggtacggctcaccaaagtcttggtttatgtgtgacttccaggggagagagattgagaaccatctgttaatcattttgtccctaaactagagtttttcaatggagtacttgggcagttgaattagtatgtttctcgtaggctagtgagaaaaatagctttttttttttttggcattaatcagactgctgacccacatctctgggaatacttgtgacaagatccagcctgacaatatcacatatgatttgcttttcttcttggaagggacacattgtggcttttctctggaatctgtgaagaaaatgctcctgagcctagaaactggaactgagaaagctcttcctgatcatataacaataagtcttgtgagggtcaacccttgagccatgagggcagcttgaaggaacatggggttgagagtcaagtcatcagaacttctgtttatttttctgtgtaatatttagggacttgttatgtttaactctaggcaaaggtatagatttggaggtctttgatatagatgatagatagatagatagatagatagatgaaatatattttagcatacaaaggaggctacaatacacactcatgtacctgtcactccaatgaattcatcaaatgtaaacattttccccaaatctgcttcttagctgttattcgtaaagaaacaaattgtacagaaaaatttgaaggcccccgttttaccttccccagtctcattattttctctgccaccccagagaaaacaactgtcttgcataggtatttatataattctgttttatactttgccacttttactacatatatgaagcatgcttgttacatacatgaacataaaatatacatgttttactgtaagtgtggaatgtattctagaatttgctacttttactacaaatattttattttcagaatttacccttgttattatataaccctagttcattttttaattgccatatattactccatcttatgaaaataccacaatttatttattcccatactaatcagaatttgaattgatacaatttttaattaaaattaataatgctgaaagaaatgttctttttatacatttccctcagggtgcatgtgatagagttcttctcacatatatatcagtgtacttgctgtgtcttaggatatgtacaattgcatgtctattagatatgccaaattgctctgcaaagtactcataccagtttccactcctaccagcaatgaatgagaactttgtttcgcaggtcattgccaacacttgattattatcagatttaattatttgccagttgatggatgtgaattgctctatcactgttttaatattcattactttgattatttataacattaggtatacttttcatagggccatttaaatttcctctcatctgaattgcctatttctcctcttcgttgattcttctattatcttttcttctctttattaatttatagaaatgtatgtgtgatcctaatatgtgtcataatatctatgttcatatttcatatataaatataatgaaatacttgtctctgttatatataggttgaaaagtttgctccctatctgctgattgcattttaattttgttcatggcatcttttaacacacgtgatttttaattttgatatagttaatattttttattactctagattttgagaattgctcaagaaatgactttattttgcatagtcatatgctctaatttttttaatctacttacaatagttttatgttaaatatgtcaacctttgtttcacccggaattttttatatgtatggtataaagcataaatcaattttttttactattgagaatgcttttattatattatatcttattctattctatttttatttttccataagttattggggtacaggtggtatttggttactttagtggtgatttgtgagattctagtgcacccatcacccaagcagtatacactgcaccatatttgttttcttttatccctcatccccctcccacccttcccccaaagtccccaaattccattgtatcattcttatgcctttgcatcctcatagcttagcccccacatatcagtgagaacatatcatgtttggttttccattcctgagttacttcacttagaataatagtctccagtctcatccaagtcactgccattaattcattcctttctatggttgagtagtattccatcatatatatatagtatatgtatgtatatatatgtacgtatgtatatatgtatatatgtaagtatatatgtacgtatgtatatatgtatgtatatatatgtacatatgtatatatgtatgtatatatatgtacatatgtatatatgtatgtatatatgtacatgtgtatatatgtatatatgtatatatgtacatgtgtatatgtgtatatatgtatatatgtacatgtgtatatgtgtatatatgtatatatgtacatgtgtatatgtgtatatatgtatgtatatatgtacatgtgtatatgtgtatatatgtatgtatatatgtacatgtgtatatgtgtatatatgtatgtatatatgtacatgtgtatatgtgtatatatgtatgtatatatgtacatgtgtatatgtgtatatatgtatgtatatatgtacatatgtatatgtgtatatatgtatgtatatatgtacatatgtatatgtgtatatatgtatgtatatatactatagtttctttatccactcgttgattgatgagcatttgggttggttccatgatttttcaattgcaaattgtgctgctataaatgtgtgcaagtatctttttcttataatgacttctttcctctgggtagatacccagtagtgagattgctgaatcaaatcgtagttctacttttagttctttaaggaatctccacgctcttttccatagtggctgtactagtttacattcccaccagcagtgtagaagtgttccctgatcaccgcattcatgccaacatctactgttttattattattttttttattatggccatccttgcaggagcaacatggtatcacattgtggttttgattgcatttcccttatcattagtgatattgagcattttttcacatatttcttggccatttgtatatcttcttttgagaattgccttagcccactttttgatgagattgcttgtttttttattttcttattgatttgtttgagtttgttatagattccagatattagtcctttttcagacgtatagattgtgaagatttttctcctactctgtgggttgcccatttactctgctgactgttccttttgctgtccaaaagctctttagtttaagtcccaactatttatcttttgtttttatttcatttgcttttgcgttcttggtcatgaaatccttgcctaagccaatgtctagaagagtttttccaatgttatcttctagtatttttatagtttcacgttttagatttaagtccttaatccatcctgagtagattttttgtatgaggtaagagatgaggatccagttttattctcgtatatgtgactagccaattatccaagcaccatttgttgaaaaggtgtcctttccccactttatgtttttgtttgctttgtctaaaatcagttagctgtaatatttggatttatttctgggttcaatattctgttccattggtctatgtgcctattttcataccaataccatgctgttttggtgactatggccttagagtatagtttgaaatcaggcagtgtgattcctccagatttgttctttttccttatttcttgctttggatatgcaggctcttttttggttccataagaattttagaattgttttttctaattctgtgaagaatgatggtggtattttgaaggagaaggttttgaatttgtaggttgcttttggcagtgtgatcgttttcacaatattgattctacctatccatgagcatgggatgtgtttccatttgtttggtcatctacgatttctttcagcagtgttttgtagttttccttgtcaaggtctttcaactcttttgttaagtatattcctaagtattttattttttatttttttggcagcaattgtaaaaggggttgagttcttgatttgattctctgcttggtcgctgctggtgtatagaagagctactgatttgtgtacattaatcttgtatctggacatgttgctgaattcttttatcagttctgggaactttctggaggattcttcagggttttcaagttaaatgatcatatcatcagcagacagtgacagtttgacttcctttttaccaatttggatgctctttatttctttctctcatctgattgctctggctaggactcccagtactatgttgaagaggagtggcgagagtgggcatccttgtcctgtcccagtttccagagggaatgctttcaacttttccccattcagtattatgttggttgtgggtttgtcataaatggcttttattacattgaggtatgccccttgtatgccaattttgctgagagttttaatctgaaagggatgctggattttgtcaaatgctttttctgcatcttttgagatgatcatgtgatttttgtttttaattctgtttatgtggtgtatcacatttattgacttgcatatgttaaaccatctctgtgcccctggtatgaaacccacttggtcatggtggattatctttttgatatgttgtcagattcagttagctagtattttgttaaagagtttagcatctatgtttatcaaggatatcggtctgtagttttcttttttggttatgtcctttcctggttttggtattagggtgatgctggcttcatagaatggattagggagggttccctctttctctatcttgtggaatagcatcaaaaggattggtatcaattcttctttgaatgtctggtcaaattctgctgtgaatccatctggtcctgggctttttgtcggtaagcctttaattaccatttccatctcactgcttgctattggtctgttcaggttatctaatttttcctgatttaagctaggagagttgtatttttctaggaatttatccatctcttctaggttttctagtttacgtgcacaaaggtgttcatagtactcttgaatgatcttttatatttcagtggtgtcagttgtagtatcccccattttgtttcttaatgaggttatttggattttctctcttctattcttggttaatcttactaatggtctattgattttatttatcttttaaaataaccagctttttgttttatttatcatttgtattttttcttttaattttatttagttcttctctgttcttggttatgtcctctcttctcctcggtttgggtttggtttgtccttgtttctctagttccttgaggtttgaccttagaaagtcactttgtgttctttcagtctttttgacataggtgttagggctatgaactttcctcttagcactgcctttgctgtatcccaaaggttttgataggttgtgtctttactgttgttcagttcaaagaattttttaacttccatcttgacttcatttttgacccaatactcattcaggagtaacttatttagtttctatgtatttgcatggttttgacggttccttctggagttgatttccaggtttattcaatgtggtctgagagagtacttgatataatttcaattttcttaaatttattgaggcttattttatggcctatcatatggtctattcttggagaaagttccatgcactgttgaatagaatgtgtattctgcagttgttggatgaaatgttctgtatatatttgttaagtccatttgctccaagtacagtttaaatccattgtttctttgttgtctttttgtctggatgacctgtctagtgctgtcagtggaatattgaagtccccactattattgtgttgctgtttctctcatttcttaggtctattagtaattgttttataaatttggaacctccagtgttaggcgcatatatgtttaggattgtgatattttcctgttgcacaaggctttttaccattatatagtgtccctgtttgtctcttttaactgctgttgcttcaaagtttgttttgtctgatacaagaattgctacccctgctggcttttggtgtccatttgcatgaaatgcctttttccacccctttactttaagtttatgtgagttcttatgtgttaggtgagtctcctgaaggcagcagatacttggttggtgagttcttatctattctgctgttctgtatcttttaagtggagcatttagggcatttacattcaatgtcagtatgagatgtgtggtactgttgcattcatcatgctgtttgctgcctgtgtaccttggttttttgtttttggtgtttggtttttaacttgtatttttgtttataagtcctatgtgatttaggctttaaagaggttctgttttaatgtttccaggatttgtttcaagatttagagctccttttagcagctcttgtagtgctggcttggcaggggccaattctctcagcatttgttcgtctgaaaatgactgtatctttccttcatatatgatgcttagcttgctggatagaaaattttggactaataattgttttgtttgaggaggctgaagataggggcccaatcttatctagcttgcagggtttctgatgagaaatctgctgctaatctgatagattttcctttataggttacccagtgcttttgcctcacagctcttagaattctttcttttgtcttaactttagataacctggtaacaatgtgcctaggtgatgatttctttgcgatgaatttcccaggtgttctttgtgcttcttatatttagatatctaggtctctagcaaggctggggaagttttcctcaattattccctcaaatatgttttcccaaacttttagatttctcttcttcctcaggaacaccaattattcttaggtttggtcgtttaacataatcccagacttcttggaacctttgttcatattttcttatttttttctttgtctttgttgaattgggttaattcaaagaccttgtcttcaagttctgcatttctttcttctacttgttcaattttattgctgagactttccagagcgttttgcatttctataagcttgtccaatgtttcctgaagttttgattttttttctttatgctacctatttccttaaatttttctcctttccctgcttgtatcatttcgttgtatcagatttccttgcgttgggcttcacctttctctagtgcctccctgattagcttaataactaacctcctgaattctttctcaggtaaatcagagatttttttcttggtttggatccattgctagtggactagtattacttttggggggtgttaaagagccttgctttgtcatattaccagagtttgttttctggttccttctcatttggaagctctgtcagagggaaggtccagtgctgaaggctgttgttcagattcttttgtcccttaatgtagtactctccctattttcctatggatgtggtttcctgtgagctgagctgaagtgattgttatctctcttctgggtctagccacacaaccagtctacctggctctgagctggtactgagggttgtctccacagagtcctgtgatgtgaaccatctatgggtctctcagccatggataccagcacagtatttggggtgtctcctgcatcctgcaggagcagtccacttccttctgtgggtcctctcgggattcctgtttcattcttgaagtctagatctattttttgacagtctaatcctaacaccatttactgaggaacactctttttttcattgttctgtaatgcctcctctgttgtaaattaagatcccataaatgccttggtatttgctagactttctttttcttctgttgttttaaaattttctctcccaacaagataaaatattgtgtaaatattatatgtttatactaagcatttttatcttgtactgaataatagtgagaatgcttcaaaatttcactgtttttgctattaagtatgatattaagtacgctattaagtactgtataggtttttggctgacttatttttgtcaggttaagaaaactgctctctatttctagtttattaagacagtttatcacaagtattagcctataaataatggtttttctgcacattcgaataatcatttgattcccacttttaaattattaatgctgtagattatattgatagatctgcctgatattaaactatccttgcattcttgatctaaatcttacttgaatgggatgtgttactgtattctctctctctctctctctctctctctctctctctctgtatctctcttcctctcttcatctctcttctgcaacatcttaaagcatattttggtaaatttgctttttatagttattgattttcagaaatatttctttgagaagctaaaaatgcaaaggttttatttcaccttgtttcaaatatagtaattatctaggaataagaattgtccattttctacctattgagaatcaaaacattcacagaacataaacctacttgtttcaaatatggtagttatctaggaataaggattgtccattttctacatattgagaaaaaaacattcaaagaacataagcctaaaacctctctttcttttgtttctaacctacgggaagcctgtcacttttctaaaagttatgatcaggctgagcttcactcccccttcctgggctctctggtagaatatgccctcccaagtcctccctagtgtgagtccgcccctgtccccacccatcccctctatccaccaccgcccccgctctcaggctgccctgcagttgtttcttaatgcagcagaaggctgcaacaaccacaaactacattgcccatgatcaacccatgcccatgtccttctgcaccccccagtcagactacccactcccacaacaaccaatatcagtgttcccatatttcatgcattatctatccttctctcaaataaagcagatctagcacattttaattatcctttgtgacagtctctagtattttccttgtttttttttttttgtctagaatttactttcatcttctgattcacaggaaatttgttccatattgtttttttacaagcaatatctagttgaattacccaccatgttttacttttttcctcaccattagttcattcacctaataaattcttattgcatgccttgtgttttcctgctattgtacatgcctggaaatataggagtcaaccaaatcgtctctgagctcatgtagttgacaatctagttagagaacagagatgataaacaagtaaatatatatcaaaaataattgccatggagaaaaattaagtagtataaggattattatttatctaggttgtcaggcaagagcttacagatgggtgacatttgaatgcatacttgaaagaagtctgggagaaaagtatcccaggtagagggaatagcatatactatttgggatcttcaaggaacatcaaagaggccagtttgttggagcaggatgagcaagaagaacgtagtggtaaatggaggcagagatagtgggtgagagtggggttgggaaaaaatcagataggactttcagaccactgtaaatacttggtcatttactctaagtgagataggataccatgacagtgtcctggaaaaaaaaaagggacatgttcttattttagtgagaccaatttgggtgttgggaataaggagattcaaaagcaaaagcaggtaggccattaagaaactgttataataatccagataaatgttggtgccttggttaagggagataaagatggagatggtaagaagtgatcgcattctggatgtaatttgaaggcatgtctgagaggattagttgatggagtgttacttatggggtatcagtgaaagaatagaggaaaggcctgagaatctggaaagatgaaggtgatatttactgaaatggcctacactcttgaatgaatagattaggaagtaaaattgaaagtctggttatgggttttataagtttgagacgcctataaaacattcaaagaaattattaaatagtgaactggatatatgagcctgtagttcaagaaagaggtctggattaaagttatgatttggacaacatcatcatatatgtggcattagtgtcatgattccaaatgagataatccagggaataactatagagaaaagaggagaggaggataatttctggtgatatttcaatgctaagtggttgggaaaatgaagagaacacagtgaagttgaccaggatgaagtacttactgaggtggaagaatcaatggagaagggtgttcaagatacaaaattaagacagtgtgtcagagaagtggggagtgatccattgtggcaagtgttattcattggttaaataagatgattaagaatttgccacaatgtggaagtcattggtgactagagcaaaagctattccattgatgtagtggagattaaagcctgatttcaataagtttaagaaattgggcaaggaggaattaaagaaaggagaataagacaatttcttcaagaagttttgatttagaggggagcagagaaatgggtcagtaacttcatgagcagtaactgaaataggagaaattatcctttttctaaaaggagataattttagtgcacacttaaggtgattcttatcttcctgcaaaaatagctcctttaggtatttttcaaaattttatacatgtatatttctattccaatcatttttggggtacaagtgatttttggttacaaggttgaattgtatggtggtagtgaagtctgagattttagttcatccatcacccaagtaatgtacattgcacccaatatacacctttttttatccctcagccacccctaccccctcctcagtctccagtgtccattatatcactctgtatgcctttgcatacccatagcttacctcccacttacaagcaagaacttcatggtatttggttttccattcctgagttacttcttttagaatagtggcctccagctccatccaagttgctgcaaaagacattatttccttcttttttatggctgagtagtattccatggtgtgtatatatcacattttatttatccactcattgtttgatgggcatttaagttgtttctacatctttgcaattgtgagctgtgctgtgataaacatacatgagcaggtatctttttgatataatgacttattttcctttaggtcgattcccagtagtgagattgctggattgaatggtagatctacttttagttctttgaggaatttccatattgttttccatggaggttgtactaattgacatcactaccagcagtgtataagtaatcctttttcactacctctacaccagcatttattgtttgtttttgggatttttttgtttttgtctttttataatggccattctggctaggaaaaggtggcatatcattatggttttaatttgcatttccctcctttaggtattatttaatgagagtcttttggtggtaaagtatcttagttttcatgtgtgctcacacacacatacacagagtctttagtgacaggctagttgggtatcaaattctgaattgatgtttttttctctaatacttttaaagtttatttgtgttctggcatctgttgttactaaataaaaatcttccaccagtccatttgagttcattagcaggtaatctgcctcttattttaagcacttttaaagatttttctgtatcttgatgccatatgatagatctaccttttattatactttactcagtaattactgtgggcttttaatctgcaaactcaatcaattattcgattttataaaattatcagtaataaccttttctataactgattatttgcagttgaattaaatcctctctttctggaattccaatcatatgtgtgttggagcttctcaatctgccctccaaggctcgtaactgctcttttaaatttttcagtactactctcaattttttttttaaaaaaacaacctaatattgcagtgtttggcacagaagaagttcaaagtacaactttgcactgccacgttgaccagctattctggcactggttattctttaaagttatttttaaggttaacgtaccttatcaggcagcaggtctcaaaacctagggaagcttaaaagcctaaaggcagcctggcaaaaatcaagctgattaaaatgctctttcccattttcttgtcctcctatgccctcatccctaaagaatagtgagagggccttccttaaaaagatatgtataaaatagcagaaagaaaaaggggatccagcaagcgtgagaagacatacttagataattcacagtaaatgttccaaataatattcagcctcactaattctcaaataaatgtaaaacaatggcagatcatttttatccattaaattagtgaaaataggaggaaaagaacattttgctgacaattgttaacagtgaaactgaaattctcttcttgtctagtttgaatctaaattaggacagtttgaaagcaattgggtgatatctatgaaaaatctcataaacattctacccttccatgtagcaacattgcttctgtgaatcaaccattaggcaaataaatggaaataacaaaccaaatttccccccacctcccaagagatgtttattgtaacattactgataatattgaaaaactagaagcgatctatatcagtgatccacccttgttttgactgtcactcaccgtaagaaaatattaggtatacaaagtaacccaacagacacacccatgcatcaaaaagttccatataaggaaaccgttcaatccattccatttatttaaacaagccaatgaacaaagctggctttgatccactaaattgatcctacaacctaagagtaggttatgactcagtttgaaaagcaccaatctgaatgtcctataaaagatatatgatggaatatgaattaaatttgatattcacaattttttacttttttttgtttgagggtagttggaggggtactatgtttcttcagccagcaaggaagataatgtttctagataactccatataatggagatttactgtaatgataccagatctgttctactatgcccagccattcttatgtatctgtctctcaatgcatcatgggtcctttatggattcttttgtgatgtcctcaagcttcctgtccactccctagcaacttgcccaaactgatagaaccggcctgaatcagtcaacatctgatttcaagcattttctcttggtcagcctttggtattaggactttattctcaatctaatcaattaatattagctgagctaggttgatttcatttgaatcaacaaagaattgctaaaagctgcatttcctagaaaatgtggcaatataattggcaggtacttgagagtctttaatgttaaatggaaaaaaaataaaaaataataagagacaactttttatacggagcatgttttcggttttctttagatattttgttagagacaaaaaaggaatccagaatttattttatactacattagtacttaacagatttctacataagcaagtattatgcatttgtaatcagaaaaaaatatcaaaattagctctgtggaaaatgatcatcttgcaagcaagcatcatgtacccctacttttgatttagctcatcttcttgatgtaaatatgaagtgtctgcgcttgaaattctgtttgaagtggaaatcttcatgtttgtcttacaaataccatctcagagtacattgctcagtataaaacttgttttggggggttgggtacaaaaacctgcaaagatatagtccaggctccttttcccaaagtccttcactttcctactcttagtataaccattattttgtaaaatttaataaggcccctaataacttggggtttgggaatttgatttgaggtaacatgcctcagagtatcacctattttttattaaaccaacaaatttctatctgacaaagatgtgcatttatgtgggccttaataattcccccaaataaaactattcgtaagttctaacagttccaaatacttttggtttcagcacactaataggatttatagctgtcttagataaggagcagtatcttctaaagctcatgaaaaagccatatcagaatgccatgtgttcaggtatatttccttttctttatggtatcaagaataaaatctcagcttatgttttcactcaagtgttgtgtgattactttttcccattactctttcgattgagcctgaaaaatgaggtgaaaaaatctttctctttcaaggatgaactagaaggatctaggctggctggtcaccaaaccactgactagttggccctttgtctttttataacccctcattgtctgggatccaacatcatagtgagtctcagacatgttccacaagtctagatagccctcatccatgtgttcagtggtccagcccatcagcatccaagccagcagggtgaggaggggaagtgtaggggatgctcattgccctgaaggatgcatatgccacttccattcaggtcctgcttgccagaacatagtcatgtgaccacagttagctgcaaggttggctgagaaatgcctttcactgggttctattactaactgaaaatgggaagagtgaaagttggggataactagtaaatattagttagtccaagtcatggattgtggtattaattccatgtgctaggaaggtcatttaaatgttttatgcagaaggatgccatgatgataattatgtttcaaagcatatttgtgtgtgagagagagagactgaaagagaaagtgagataaatggattggagagaatttgtctgagtgttaagaggccattctcaaacccaagtgggaaatggtggctagtaacagtagtgaggataaagggggatggaatggactcaaaagatacagaagagataacatcaaaagatgaaacaggggcagaggaggaagaaaagacatccagataactcctaggtttctgatttatactgcaaattctggggatcaggtgtttatggaccactgagtttagttttagaaacgtgatttagaggtatttgtcagataggtggtttctacacattcaaaataagatttcaaaacatattagccacaattcacaatcagcaaaattctcaaatctagtcattgtcaactaaactattaaaatgaattttcccctctaagtgtttctcatcttaaagggtttgtatgtattacatgtcacagtatggtttattgcatataaacatgggaaagcaagccaggcagaaggagtcttgtaaccagctaaaggcccagctaattcttgaagcagtcataaatcatgaacggtcttcttgtgttaatagtgtggacaggactgttggtcacacacaggaaaatgagtcacacagtcttgtgtgtacagcaactcactccacactcaatgatgggaatggtcatgattgttctaactgtgtgagcagctacaagaattatggcaaagctccagagctagaaagctggttttttttttatgtcacccgagtatgtaattcactaaatgtttagtattttataccttttagttgacttgtgagccctttctaaaggagatctatttccctctactagaaggtaatcagaaaaaccctaaactacgttttctaaatgctgtgttcttctgcccaattgaccaaaatatacttagttgattaggactttgaagggatgagatgaggggactaaattaagatgcaggaatttcagttttctaggggttttctgtaaactactttatactgctgacaaatggttaaatgtttccaatgaaactaagtatgctaggatttctaatgagcaatgaaattttagaattcatttactcattaatttcttcatttacaagatgtacaatgtgctatcttctgggcatttggggtactttaatgaggtagcagtgagtaccacaaatggtcacttctgcctttgttcttatactccttagagaagggaaaggaccagattcagataccctatcactgctttctacccatccagatcagagcctttgctgagttctaacgcttagccctcttctcagctgatttggctgcctccattgtaataggcctcatgagactccagcctaggcctggccttcagttcagcaggcagagcccagagatgtactgggcaaaggtcaggggatttattatatgagacaatggtctgatgtgatttaatttactcctctggtaccagatatgtgtgtgtgtgcatgagagagagagattgagaatgactgatttgggagggattttgtgaaggtttatatatcaaagcagaaagaccaagaatttagagattaatacatgccaagtggtaaccaagaaacttctgtgggatcccacctccaacccctccctctctgtcagattttaaccaaatcagtgtgatgtgatctgcttgcatatatgagtgaaagaaaaaggaaatttaaaaagttcttgatataaagcctggaggaaacaatacgaaaatccagcctctatttcagcaatatctgccggactattggttagtattcccttactgttacttattgtttgattaaaaggctgatagtcagggttttttttttcttacttttgcattttttagatataaatctttaatatatggctgtggccagatgttttcctttctcctcccacttcgttcttccctcttctgggttaatttctcattgttctctcttccccttacttctctgcccttttcctttctactctaagcgaaacttctttttttctgtgctggagtttataaagtattcttttaggcaaagaaagcctttggctgccttcctccttgtctggtcaccatcaagatataattttggttttcaaaggttgttctctgaaggaaggactagttttctgagcatttagagagcagatacattttgagaaagtcaacagagatagtaatttgcactcaggaaatacttaagggttttaattctgttccatgtgttacatttcaacagtttacattaagaaaagtattgtaaagagaagtgataccacaattgcatgtttattttgcatctttagtctgagagatggtcagtactttgaaggaaagagaaatagggctttgtctccttctgcttcttgctatacctcttttcagattaactctgatgctttgggtttcttactgcatgcctgattaaaacccatcccataatgcctgatgtgatgggaaccaccacttattctatctcaatggaaagtattcacatgagctttcaacagaaggacattctcccacctcttccaaacacctctttgaaaaccgtgtccatgggcctttattcatgtcttcaacaatttgtttaaaactggttgtgctaggtagtgggcaatataaagatgagccacaggagagagatgacaatatcactgattccttatagtgctgtaataagggtttattaaggctgtgatagaagtagagaggagaggcacctgacttcacttgggagtggggttgttgctaaggtgtttctaagttgaaatgtccttgagctgaggtttaggggaatgagtagcaaagatggattaagtgagaagagtataggaggcagcagggccagaggtgtgaatagcccagaaccttctgagaagattcctttgtggacggaagaaaggggaggtttgtggaaatggtggaagataaggtaggaagaggccacatcagatcacacatggctggatgtacctctctaaaagtactggggggtttgaaacagaggctataaattggcagtttaagaaaatcactgtggtgtcagtgtgaagaatacatttttgcaagattctaacgaggattattttcagaaatttaggcccaatttagtccagatgtcagggctagtttggagtaaatttctttctttaattactccagggctcttgtattgcttcaaagaaagtagaaagtggaactcaccctcattcagggagggtgggcaagcgaccagccagctggggaaggccaaagagccaggtcaccttgtgcccgcacttgttatgatttgtttgtattgtctgcctgatgatcaatgatattagctatgacagcacgtatgagcctggggtaagtgtgtcttcttgctacttgaagtgcttcttgaaaatagtggcaggctgaagacaacaaggaatactgaaaaagcccattggactggggacaggagacctggtgctgctcccagcttggccggcaccagctccgggggcttagacacattacttcacctctctgggcttaacttaccccatttgtaaaatgcaacctttagactaacactgttctcggggccatgttcagcctctggcttctgtcattgtgatcctgcctccccaaggttcccctgggccccatcactactaaccctaggcttctagacattctgattcatagagaaataggaaagcccatttatcttaagttaatgtcagccagaagtacagttgtgtcttaaggaatctaatctagtgaacatggaaaataattttctaaggaaaaaaattgtgattggtgttctgtcctgaactgatggcaaaagggaagcagaaccacttcacacatctcaatctctctgttttttcctttttatcctcttgaatttttctgcctgtttgtctttcaaaagtagagaggagtttgaatggggatgctgaggagactgagggtagccaccgatgggggaagctggactgtgggaagccgagttctgccacctgacaaaggggcacgtgtttagtgtttatttggcatagcagctgttcaggtggagcccaggcagaattttgatgtcgttgggaccttccatacctttctgaaattctcttgcaccaacacccggcaccctcaggttatgttctgctgcccaaagcctgaggctcaacttctagccctctcttttctcttttaccggaactaacttctaaaaatccagaaatgacaagtagatggtggtctggatgttcctgaggtggaaagagaacctctagtgcctctggctgacattatatccactgacagatcccctcccgcacgcatacatgtcacatgtttctgctcatttatcaaatacagcccatgctttggtgattgagagcagagtggggattataagttgatgcagtaggcctgtgtcttgcccttagaagtttacaaacagcaacacaggcaccaagagctcatctgttacacccacagggatttatcatcttgtgacttggatattgtggaatgttttatagtaaaggttaaaaaaaaacaatgtaggcacagaggagttaacagctaagttgcggtggggagtctggaaggcttcatggacgtggtgatatttgaacgtgactttgaagggtaggtagagtcctgatttgtctaacagtagccttgaaagtaaaggaaacttgaccatgaagaaggctgttgaaagtctggagaaaagagaaggtaggagactaagactctaggagaaggtactacgttccagggagaatgcagaggtagaatcctccctcatggtgacaagttaaatgtgagaagggatggagtaaccaactgggtgaaccctgatctcattaagcaaaataagaaatagaagaaatgaatctgcatgctcataatgtagggatcagaagcaggtaggaaatgctgactttattttagacagaggttattttaggtacctgtggacatccaggtgtattatttccctatgtctgaagcacatgtcctttggttctttagcattttgatgatgatgctccatgtaaactgccccctaggattttctataagttttcttcctcatttgagagtaaagttttaactggtaacatgatcacaagtggttgaaaagttaaaatgttattcatatagctttccaatgaggggagcatgaatggtttggtactgttttacaagatgtgaaaactgatttcacttaagtagactgtaacataaagtttatgtgtctgtccctttggcttcctggtaggtggacagtctctctgaatcaatagtggctcaggcttctgatttcaaacctctttggccagccaactggtttaggagaaacatggccaggtcattgaattataatttcctgagttatgttgtggtggtcccgtaggacagtaaacataagcctcctgggaactgaacttttaattcaggaggactgaaaacaagctcttctgagccaagatttgcaaggacatgttacaaagatagactggccttcctgcttccacaccattttttcctccataaatacatgctccttttccgtatttttcttctaccctagtctgttgtagattttgaccttggctgttactttcctaccaacacattgcctatttttaagtttcctggtttgacctgatgttaagatggaaagcaaagctagcaaactgatggagatagggccttccagcctttctaactttccctgggatcatcttatgttgatttacatgttcaaaaaatttttaaaaataaataaattgtatcagttgatccagaagtgattagactctaggggcctgatttatcttagccaaacttaagagatgagccaatacaccaaaatgccaatatatttgtttgttctctatggcactgtcaagcaatttcatttcatctgattactgtgttcattttcctgaaagatagtgaacccagaaaacaagaatcagaaggtcatttgacaactgtggagttggaatagagggaactgaatgaccctctattgggtcatgagggagagcatcatcaagctttgagaaattattgcacctgtctctgtgttgggacatttttttggtcccaggtagttggaagagacaaagctgtaaattatttactagtttttcaacatttccttatcacttatcgttaactgatggaactaagttttctctaaagtcccttatgaataaaattgctagacattgcaaaaatgcccctctcaatattgacatgcttcagtggtgattatcttcctgattaatgtttacagtcaatctcaagctctataatggactcttaaaggctgtagtagttttctattgcttccataacatattaccacaaacttagtggcttaaacaatacccatttattgtcccacagttccatatgtgagaagtctgggcacaccatggcccaactgggctcttgcttagagtttgcaaggcagaaatcagtgttgttagggcctctagggatgaattttcctccaagctcattccagttgttttcatgaactgagttccttgtcattgttggaccatgttccccatttccttgctggctgtcagctgggagccagtttttgctcctagaggctatctgcattgcatctcatggtttctgtgtgcccccttccagcaacaagattctatgtacccccttccagcaacaatattctatgtaccctcttccagcaacagaagatcaagtccttttcaagtttctagtctctctgacttccccttctgccatatctcattctgcttttacaggctcaggtgattacatcggtttgtgcagataatccaagataatctccctgttttaaagccagtgggttagccatcttaattacatctgcaaaattccttcacagcagtacctagattagtgtttgaataacccaggatggtaatcttgcgggggatcttttagcattccatctacccagtctcatcagcaacactttgaaatattgtcgttgagtgatcatttctgtggccggctgatttcatctatacaagtgtattctttttatttgccattttataggataatattttctgatcttaattccatatttcagtattaaaattacttgacatagatccataaatcatcatctgttgcaaaaaagcacattaattgattggttgaatggggagattgagatatttcttttctcttcttctgctcaggtgggggcaacttttgggggcagatgagttctgttgccacaaaagttatatagcacatttggtttgcactgaatcagcgattctcaatcctggccatgctttagaattatacaagaaaaatcttcaagtatcaatactcagtccctatcctactgatccaattcatctatgataaagccagagcattgatttttaagttctgcaagtgattctaatatacagccaaggctaagaactactgatatgttccaaacactctattttggagataaagaagttgaggctgaggatgagaacttagtcacataaagttccataactagtaacagacagaagttctgtcctacaaaaaaaaaaaaatttgatgctttaattgtatgtagagttcagtgctcagtaattatgtacaaagtgagtgttgagacgatctggaacaccctacttcttgctttagtaggaagactatttctttctactactttaaaaaattatcagatcttgcaaaataactgtatgaaggtctcttctcagcagctttggcctgccttgtgagtaataataaacacagatctattctacactaactagggagctggccgcttggacttctactacctctctgtgttccagagcttcatggtacaatgcagtagccactagccacatgtagctattaaacacttgaaatggaactagtttcaactgagatgtatgtgagtgtaaaaggcatactagaatcaaagatccagtatgagaaaaaaggtgcaaaatatctcattaatacttacattgattacatgatgaaataatatttgaatatattgagttaaataagatacattattaaaattaatatatcaatttttaacttttttaatgcagttgctagagaatttacaactatgtatgtggttggcatttgtggctcacattatatttctgttagcacttttctagggagtattttctattaaagctattaacaatgaatggtccaagtccaagctattacacctcctttgatcctgaagagtgaaggggtacactgtaaacttcctggagatgagacatgatattgatctgccctgtgtttgccatctatctggcagccagtcagtctggccaaatagacttctatttttacatagaagcttaaaggaggcaggataatgccccatgtcatggagagagcacactgcatagctcttgagtaatgtacccaaaagtagaccaggtgctattggaggttctaaggcatagcgataaatattacatcccttgagcaatgtaatacagcccttgaagaaactgccatgtcagcacttatgaattatcactgtctttgacaggccctatgcactgaaaatattatggtgtctacctctctttataattcacatccaaatattactctgtctttttcttgctccctgtagtttgttctgattcactgctaccctgattgtgtgtttagtttgcctagttcacaattgaagaagcatgggaaagtaaaggcaggccttggaaagatcaagcacagttcgaaaccctacccagaattattctgtctgtgtgagcttgggagatttacttaacctctctgagctcctctaaacttccattttctcatttgtgaaatgagcctttctcttgcaaggtctgtctgagggttgaatgaaataagaaggtacctggcacacttattttttgggtagatgttgtagtgaacatctactctgtggcaagcctatggctaattgttaggatgtaatcgtgagtgagacacagctactgcttccagctaagagaagagaaagacaaggagcctggtaacgtcgggacatgaatagccgtcaatgaaaggcagctattattacactgcacagtgcaggatttggcttataacaaaattttagaagggtgttcaggtgagggaattgagacccatagtgattaaatgactacctgagtcaccagctcggacaatgctgggctgatgtcaggttacgggattgctgactcctcctctagtaatgcctttcctgggagatcacattgcctcactcttggtttcccaacttgtttaccttcaaagaataactttaccatgttggactcgataaaaggaaagaggggtttcctccaatttttgctccatttgttattagggcatgctagtaactaactgtctttgaaaacctacgcttctgttaactccaaagaaggcaggaatacatgcacttctttaagatataaaaagtatttagtatactataaattattatagtaatcattgttagattatatctcaccaagataatgaatgtttttgtttgaagacttcactgtatgagaaattgtctcctataccttatttatctccttttagattaggtaaaacaaaattttcaaatttgagtctgaagaaaattccaacatctttaaatttgtttaaggaacattttccatgatctatatgatctatcatagtaatttaaaaaatcagattttagaatgagccacgtgtagaaagagaaaaaaagtagaaagtcaataagaggtttcatttttcaaattttgttttggaaaaaactacttggtagggacaatggtgtaaagtaagatataagaaggaatatactgttcaaataagcggccatgcaattgattttctctttcatgtaacaatcacatctgcattgtgaatccgttagtgcaccaagtgaatcaagcttagtgagttgacaaacatccacagggatagttgcggggaggcattataaagtgcaatgtggtcctagtgaaacagaatgcttcgttctttgagaaagttccactctgaatagaataacggtgcataccaatatcggagtatggccaagcatttggctactgacatgccccttcttctttcactcctccataaaggaagagacagagactcaggttcttgtaactcagttgccttttttgagttctcccaagaaaagttctaacttcaagccaagcgtcttgtcactgggatttctgtatctaatttttagttctagaaatccatgatttcacaaaacaaattatccaaacctaacgacaaccacatagaactttcttaaagtagacgagggaggaattagcccctaaagtatttcctgcacaattggaactcactatagaagatgtacaattgcctgtacacccaagcacaaataggctgtattattgccttatcctaggagatatacactttacattatgatggtccttccctttcctggaccttcatatgatgtaagtgcttgatttaggaatagggtcttacatattgtggctggcgaagagcacatttgctgattgctctaccacatgcctagatgtcctcttcatgatatataaatgagggtccctactctcaatataccccataggaacataataaaacataaatagtctatttgttactactaccaagaagacttcagtaagtgtaataactaacccttttggatacatgcagagggaatgccaaatgctttaaataaattatctcatctaatcctgatttttttattaaaaagggaaaatcttatcatatgaatattagagatgagtaaactgaggtttggtagagctgggatttgaacctagccctctgtgactccaaagcacattcacttaaccccaagcccaccctctctgtaaatgaagattaatgatagcatctgtggtagaagctaatgtctcctgacctgggaaaatatctttcaatgattattaactaaatgtgatcagctgccagtggatcagatgtcatcaaataaaatcgagtgtccagggtttactcaacagtactgtctcttacattttttatcaatgttagtagattgcttaatctttgtacctgttacctcacatgaagcctagatagcatcagtcccttccccagccagtttgtgctgggttcagcttctggcttgtgaatccagtcagtgaattaatgttggtagcttaaaaacagccctgagagaggtatttacatcacagaaattggcaaatgatacaaatcatgaccctttttttaaattccagggagacaggtgttaaacatttaccagtacaccactgtctatgattcaaatcgggacataataattgtatttctgaaggtaaacaaatgcacactgagtacccttggaaaaaagcaaccttccacagatacaatcacacctaagtcacctaagtctttagtgaattttttgtccccatcattctgcatttgggaggaccttttacaacataaccataatgattttatatgtcatttgaaattttaaaaaattactttatttgttcatttttgttatgaaagcaaatatgcccatagtaagcatttaatgtttttgaatgtaagtgcagacatataaaccataaaatgtatatacgaatgctaccagtagaaataaaatgcaagccacatatgtaatttaaaattttcaactatagtcatgcaccacgtaatgacttttcaatgatggactggtcccataaaattataaaatcatgtttttatgacatcttttctatgtttagatatgtctagatacataaatacttaatattgtggtaaaattgcttatactattcaatagagcagtaacctgctgcacaggtctgtagcccagagcaataggctatcccatatagcctaggtgtgtagtaggctataccatctaggtttgtgtaaatacactctgtggtgttcacagaaccatggaattgcctaatgatgcatttttcagaatgtattcctgtcattaagtgatgcatgactgtaatcacatttaaaaaataagaaatatttgttttaataatggattttatttaattcagcagttaaaaatatgatttcaacttgtagtcaacgtgaacattatcaagatattttgcatcttttcttcttgtactaagctttcaattctgtgtatattttatacttatagcacatatgaatttagatgctaaattttaatcataaatacttgatctgcatttacatttcataaaatgtaaagcttaaaaagtgggttcatatatccaatctgttatagacttacatatttaattaaattaaatttaaattgtcattgaattcctcaattgcattagccacattttaagtgctcaatagccacatgtgacttattgtaacataattggtcattgcaggtacataccatatatccttattttataaaattggaaacctaggctggatgtggtggcttatggctataatcccagcactttgggaggccgagacggaaggatcaggtgaggccaggaattagagaccagcctgggcaacacaccaagaccttgtgtataaaataaacaaataaataaaaatagctaggtgtgttggcacatgcctatggtacaagctatttgggaggctgacgaaggaggatcccttgagccaaagagttggagactgcagtgagctatgattatgccactgcactcccaacctgggtggcagagtgagacccatgtctcttcaaaaagtaaaaatacaaataatataacaaataaataaataaaattggaggcctactatatatacaactcccaaaagtcttttcccccctcacacgttacacatttaaaattcccatcctgcattccctgctggatctccaagaggagagaaatctcagcaaaagtagttatatcaaaactgtctgtgagctttttcttcctcactcataggaaggaaataaattcacataaggcattttggatctgaccattttccaaattatcatcaccataaaaagttggtaacaacatgaactctgaaagcaagctgtttcaatgcatgcctggtgctaatgaaaaccagcagttttaaatgcccttttgggttagcttcttcctttttctgtgctgtattattagaaaagcttcaccaaggagatcaactagatataatttcacaatatttcttagtaatcaatgttggcatttactcttcccatatattaatttattaacatcatgcttctaaggatgctttaatcacttttttaaaaaaaatacttgatacaaattagagggtgttagttattttaggtggtgatttgttttgtttctgcaaaattacaaaccagatatgagcatattattccctgtgtggcttaataaactgttttttcttttttgagacagagtctcgctctgttgccaggctggagtgcaagggcataatctcggctcactgcaacctccgcctcctgggttcaagcgattctcctgcctcagtctcccgatcagctgggactacaggtgtgcgccaccacacccagctaatttttgtatttttggtagagacggggtttcaccatgttggccaggatggtctcaatctcttgaccttgtgatccacctgcctcggcctcccaaaatgctgggattacaggtgtaagccaccacgcctggccaatacacttttaatataatttttgataaaggtgttatggagacttgtcaccaaatagtctagtcttcacattaaattcacatgatactcctcatctctatttagctctctctcacctccagtaatgacctcccttgtctctcagtctttggtctcttaccttcagcttcccactagccgtttctcacatttccaaaagtcttgtaattgccttaaaacaccaagtatccaaagcagtcctatgaccttctcctcctgctaaccaactcagatccccaaatcctgatttctttcactagcactatctctcatccacacatactcagttatttgtgatagacatgtctctatcatctctcatatccaatcatcaccaaatcttatcaatacttctcagtgatattaagttaagaagtcatgaagggcggctgtaccctaaggaaaacccacttttgcacaaatctgagtttctgatcaatctgagttcagaatgctgttttaatctggtcctacctcgccaatctaattttaggcccttttattcgtgaatttgaaccttgttctctattcaccagcttcctcagaatattgtccaaaacatactcagaattcatactcatatccagaacatttgctctgagcttttaccatacaagttcaccacagtttctctcccttttccatatccaccaaagccttatctgtcatttagttttaattttaagcccttcagtttgatagctgatttttccctagtctgaccttctattttcgggtatgctccttcttttcacagtttcatgtgtttgtactgccttattcttgaagaaccattattttgattgcttttgcattaatctccatagtgccttgctcagtgttagcaggaactagtagtttaacaaatacttgctaattctaaattaaagagcatgaaacatattgttttctttgcctggagttggttatagcatgctggaaaaagtattatatctaaccttcatcttttctcatgtgtttatgaactgttttatagccaaagaataagttagtatatcatgggcctaattatgtaatttggaggcctcctctgctgggcagtctacagatttaaaattcatgccagctgcattacgctggttttgaacttgctttttcttgagaaagatggggagcagacaaaatgcctcaggctttgagggtagaaatggtgtgagttccattatgcaagaatagaaccccattttttaatccctcctgctgaaaatcttgccatgaggctatagccaaagaatgtgtaaatatcaaaagaaatttagagagggattttccctaggaaaatattgcaagcttaaaaaacccagtgggctaaggtccaatttagtagattcctccgaacaatgccatcctctacttagattgttacagaacttcttatgacagcatttgagtagactcctgtacctctgggttaaaaggtacatgtaataagtttaggtacctgggcaaaaagggcttggcagaggggaatagagggactttcttattctcacatctagtatatcattacattgtaatgttagataacattaaagttccaaacttcatgtgtccgcactctgacgtttcctagggacattttgtctcagctagaatctaatagagaaggattccctcatctagaagcttccatatggggctctgtgaagatgatgtggacagtgtacaatccaattgaatgtcacgtctcgtggcctggctcatgtgagggcactagagagagttctccagaggagtgcagatggggctacttttggaatcattcccactgagccaacatcagtggaagagaaggggaggagttagattctaataaagcccttatcttctgctgaatccatccacatttttttatcctcctcctggcccctgcacttagttagagtcgggtccctatgcagtgttccaggcggcagtgaactgcattcacctcctgtttgggagcatggcaattttaaatacttttttctgctgtaagagtatgcaaacagatttctggttaattttgtgttgaggattcttgtttgttttttgttttgatagagcacattctatggacatatgttcagcttgtaaaggaagtgttatagttccttttttttttttttttttttttttggagatggagtcttgctctgtcaccaggctggagtgcagtggcgcgatctcgactcacttcaacctccacctccctggttcaagcgattctcctgcctcagcctcccgagtagctgggattacaggcatgcgctgccatgcccagctaatttttgtatttttagtagagacggggtttcaccatgttggccaggatggtctcaatctcctgacctcacgatctgcctgcctcggccccccaaagtgctgggattacaggcatgagccaccacgccccacctagttctttatttggaagaagtgaagttcatttgcaggcagctgctttcaaaagtttggggattggaggaaggtcatcttctattcaactgaagcaaatgccacttgtttgtggcatctgccaggcatccttgagatgtctgaagaggtgacttccaaaccagaggatgcagccttccgagaaatgcaaacctgttcacattcttgctcagatgggaagcagaaaaggctgcgtgggaattggggatttactgttatactctggcattggaatagcaggtgctactggaaacttctttacctgacactaagtgtcttgggagataacaagtaaaattaacacagcatccagttcttcagtgctttctccacttaaaaagaatcaggctgggcacggtggctcatacctgtaatcccagcactttggaaggccaaggcgggtgggtcacttgaggtcaggagtttgagacaagcctggccaacatggtgaaaccccgtctctactaaaaatacaaaaaaaattagccgggcgcggtggcgggcgcctgtagtcccagctactcgggaggctgaggcaggagaatggcgtgaacccgggaagcggagcttgcagtgagccgagattgcgccactgcagtccgcagtcccgcctgggcgacagagcgagactccgtctcaaaaaaaaaaaaaaaaaaaaaaaaaatacaaaaattagctgggcatggtggtgcacacctatagtcccagctacttggaaggctcaagcaggagaatcgcttaaacctgggaggcggaagttgcagtgagctgagatcgtgccactgcactccaggctgggcaacagagtgaaacaaaaaaagaaaagagacagaatcaaatgcaaagtaaatatttagttaccaacaggatggcatttttagcctataactttttttcagccttttaatatatttctgctggaggtttccagctttgattacatagcctgttcacctaggagtaaaggacattgggagggagagatgctcagtggttctcatttgcaaagtagacgaggatgatgaaaggccatcagctcaaggccttccaggttaggaattaaaaacatgaatgttgtaaaaaccacaactcatatttatttgaaatctcacaaagtgtgagatttatttgaaatctcacaaagtgtgagatttatttgaaatctcacaaagtgtgagatttatttgaaatctcacaatgtgtgagatttatttgaaatctcacaaagtgtgagatttatttgaaatctcacaaagtgtgagatttatttgaaatctcacaaagtgtgagatttatttgaaatctcacaaagtgtgagatttatttgaaatctcacaatgtgtgagatttatttgaaatctcacaatgtgtgagatttatttgaaatctcacaaagtgtgttcatctgcatgtttctcacgtgaaatctcacaaagtgtgttcatctgcatgtttacactcaatcctatgaacgactccatgaagtagtgtatgaaggagagttcctcatgcatgtggatttgcacatggggattcagatacaagaagacaatttagtttacatagagatgtgcttttttaaagaaatttttaagaatacaaaattatatggaacaaaaaagataggtcctctgctgtctagaaattaaagtacgtcaagaattttatccctatgtagaattacacagccattgccgggggccacatctgtaggcccatggaaaaaaacatctttgctcattatttcagcctgattagggataccatgaagggctattccattaggtcaggtttgcacagtaataaaaatgaagccagtagaggatctcgtggagctcctggtatgatgataagtctctgagtaacttgtaaatagtgcaattttatggaaatgttgcagctaagctttaaagtagttggcattagttgtcagacacagcaacagctctacaaaaggcaatacgctgagttcattttcaaccagcccaaacttgcctcagaagatccgggatgtggacaccctggtatattttttctagaaaagcttatttccttcctccagataaaggtgtatggtcactgaggtgttgtgctgacagaagtgttgatctactctctccgttagactgaagggctccaggtgtggccacactgggcttctaaatggctagcaaagccacagacgcatccctcttggtgtctgaggtgttcacattcctgggtctttcagatctgtattcctcatgaaaataaaacctctctacgacacactgtgtccttgtgggtttttagttttactagggagtttttgtttccttttgcttccctccttctttctgcttcccttctagttaaacctctttaggatggctcattagcaactcgttttgagtggtttgagctcttttgttcactgggaaacagatttatgaaatgttactattaccatgattgttatgtttttccttttatggcctgtccagctcaaggccccatgctttctgatactgctgataaggttttctatttccagatcaaattaaagcaaaccttactggccctgttactgaagctgtgcatgggggtcgtttgctgtgaggtgtttctatggctttgagccagggtatgaacatctctagtgttcatgttatttcctgagactagcactcacgggaagtagaatttattacaacctgctgtttgagttcatgaaaagtaggacaatatgagactctggggcagtgaaagacttaccaggattccttctggaactgactcgtcagctcattcatgtcttacccagtctttaaacagtatttcatgataatggtctgcttttaattgctgggctttaccttaccctttttgtgattgcaggtcctacaggtatggatctctggcagctgctgttgaccttggcactggcaggatcaagtgatgctttttctggaagtgagggtgagttctgcttttccatttccaccctcagtgttttgaaacaacactgaactgtattcgctacatccaagttttttggatgattttattaaaagatgcaagttttacatagcagcaaaaaggaaacttgacttagctttaaaatcagaaactagtaggacttttctgtggatgtttaggaggaatgcagtagtcagtcaactttggcatctgatgttttcatatcaaaaattaatactacaaatcatgctgaggacatttatgttgaagacaagccaggtctcttgttctcaggctttgggagagatattgaaattacactgaagggttattagcttactgttcactcagctcatctgtgactaaggatatctaatctatttccagagctcagaattcaggcttgttaatcatattctcagagaaaagaaattgcaggtttcaaatgaatttcacttctcactctctgggtgattaccatttggctaagttgaggaaagagacacctgaaatagttgaatgatatacccagaaattatgagcttccttccccatctctataattctccctcccttttttatatccctctccttgtagagaagtctcaatatgtttaaactatgtttcatagcagacctaactaaaacaaggaagagtaatagaagggaaagggaagaggaacttttctgtcagaaagaaaactgtgctctctaacgggtgggagacttttttttttttaatgagtacttgatgtttttccttgcctgggcttctacagaagaaagaaagaatatatttctcccatgctatgacactgaatttagttgttgctttaagagtgtcagactccccttctcaccattcagctcatgttggaaaacacagtttaacagcagacttagcgccttaagatgtcctccctgaccttctagccaaaaataaatccgtagtagtgagctgctgagggtgaccacagtcacttagaaaatgagaagagtaaaatatgttattttatctcttaaagcaatttaaaaatatttatagaaaagagtcataattgttggaaatattttttggtctctctggcgttataatgtcaacattatgcaagtcaaacatggagagaattgcaggctccatttcagcagcttttcccatggctggttttagaccttggttctgagccaaagaattgcagctgagatcctctgctgttccaaagtcatggtggcttaatctctcgtttcttcattaaggtgactttcactccactgggcaagatttgaggaatttaaaaaacttgtgaaatgaaaagtatggcataggaaatctttaaagaaaattaaaaatgcatccccagctgagagattagagctcaaattacattttagaactagaaagtctgcaaggagcatctgtttcagctgcttcgacattttactaaaactttgagttcctgagtgaagagaaaacatcactagttgcttttaatgtttgctttttgtttttctttttaatagttttgtttgattcatttatttgttcagggagagcagaatataagcaaatgcaatagtttatactaaacacaaatcacatatcctaccagtacttacgcataagaagtaatttaacaaagaagaacatttttgtctcttttttttttgtcttattgaactaaccaatatttctttttcctttggaatatgtgcatattccagaatcctttcttaaaatggtctaaggattaaggatggggcatgatgtttatgtaagaaggcatatgtaagcacgttccagtgtgtgtgtgcatgcttggctctgtgtgtgtgtgtgtgtgtgtgtgtgtgtgtgtgtgtgtgtgtgtgttctagttctggccacttatctaatgaatgggttcatgggttcagccaaagttactgcataacatgacatgggtcagtctcagataatatttatggaccatgtgtttgtttttctgccaggtctggattgtagccaaatcattttatttttattgtgtctcctattgaataaggcagactaaaaatatagattaaatttttaaaaagaaaagatactactattgaattcagtttgttcagtgaaagatgtggcattgatgggtaagtgatcttggaagcatcacctggagaaaagtcacccaggagctggtagaagatgacagacctgtatgcgtagggaagggtagcacttgagcagggattttcttgcttgggcagatgagcaattagaaatatactggccctgaaaggatttttttttattaaatctaattgccctgtgggaaatttaatgagaactaaatttgaacagtgccgttattgtgttagctaaagtgttgtaatagatgttttctgtctctcatccttaatatgaagttctcatccttaatatgaagctctatatctgctcctcaaagccagttacatagtctagaggagaattttttattccaaaatcaggaatgatccacaatgccttgttttcaaagggcttcacatggttgacctatcaactgattgtatcaaaattgctgctgctggaataatgttgctaatgagaaatgtgcataaagatctaatggatataagtattcttccaaggagtgcctgttataaattaggtcgtatatctctactatttcaatcagtctacccttgaatataccctttgacctcagtaacctaaggtggaagtaagcaagcccctgccttgtagttcagtctagctgggacatgaggaatgtcttgaaattaatgagagcctgtatacctttaaagtctagattgtgtgatgaagagaaatggtcaagatgccctgaaaaagaatagatcaaggtggactagaatagttaattcaacaaattcagtgtactgataattcttaagagcttcctattttcaaagcctgcacctatggctatgaggaatacattgattcttccctcaaggaacttttcatgggttaataaatcaggcatgtacaccaagaattacaatatcaggcattgtatattaactatcaaaatggcttgaatcacactttatagaagtgatgatgacgtgagggatacctcagctgtggtgaattacagcttcatgaaggaggttgacattgtttctctagagactagaatgtcaggtttaagattttaaaaggctgagaagaacagaaggctattacaggaataacttatgtgataaagcaacaacataaacagaagtgtacagatgtagatatgagatgtctatggacaacaattcattcacttactgtgctagtcaatggatggttctattttatgcatttaacattcaacaagcatttcttgagcacttacttcgtggaaggcataggattaatttggccagggtgtgtggtacataggtgctatatttgtaattattccctttggaagcaaacttaggtcagtaggtttgagtcaaattatagaaggcccagagatagcaaaggcattatggaaaaggcaagacttgctgggcccttgaaaaatcggtagcatttggagaggaagaaaagaaagaggaagtgtatgccatatccagccagtaatagtcctcaatattggaggccagacaaaagcgctacctgcatgatggaatagtgtgtgtgtgtgcatatgtgtgatattcatatgtaacatatatagtatctacatgtaatattgatatataatatttacatacaacatatttatatttgtatgtgtgtaatacatacactatatgtacacatatacatatacatgtatatatatgtacactatatgtatatagtatatgtatgtgcacaccagtgaggtgtggcttgcaggcaaagcacataattgacatcactcaaattctgcaaaaggtgttatatcattctgtaccattcaaagtaagagacttaggaatgagatgccacatcctaagggaaccaagagccccaaaataattttttctgtatattttgaacatttttcataaacctatgcacactgacaaaacacttacttgaaaggaaagacacccctgttctcattgctatcagacagcaacaatttattttttaaaataaactctattccaccacagttgaggttccacagagctctgagaggatgtcaagacatgtcagatatatttcacacaagtattagagtcatggtttcagttagtaaacagtaatgaatgcatctgttaaatgtgttcaagaatgaacacttcaaggctttccattcacagtgaaggtggggaaaaaagccacagagcttttgattgctgctgtcttcaccataatccagaggcaagaagaaatcttatggtgtgttctagtgcaatggcctgcgtccatgtacatcagcaatcctctgtccccttgtcctcctgatattgcagaatttatttgatgttggagttcagcaggtcacagcaagctggattaatctagatggtgccaatgtagataatgacacataaaaagtctttcaagaagcttttattaagtcattttacagattcaaggaggaatttcatgtatttatttatttattcattcaattttgcatgcatgcatttattcatttttttgttttagagataggaacttgctatgttgtgcaggccccaaacagttctactagcttcaaacaatccttcttcagcctgcagagtagttggcattataggtatgagccactgtgcccagcccaaggaagaattttgaatgtatattcctgcttttaaggagctcacagtctttagaagagaaaacagagaaataaacataatttaattgtgatcctcttagattattaaagggttttaatctaggtaataatactgttagatttttactttgtcagtaatactagtaataggataaaagtgaatttgaaagggatgaattagaggaggaagttgatgacaataggtcaggagagagataatctaagtgtgacagggatgataaaaaatagatggatcacaaacacggggatgttaagaagacagaattaccagtactcagagtctaattaacctgtggatttttgactcggggaactatcagtgccttcttttccatccatttctaagtttctgcatttttaattaatgtgatcatcagcaatgactcacgtttaatgcagtgaagtcctggtgcacagttcagcctattagcactaaagtggcacttgcacagaacaactctgtaggggaggaaacatgctgaggctggatgacagcagagtgtctaagctacgcttcttttgtactatttctctgaactcctcatgcctgtgtctaccctgggtcctgcagctgtctgctcagctctgcagtatggctgtggtatggctcaggctactatgcagtgagggtctacagcaaggacaaaggtctgaactccctcctcattgtagtctctggacatgtgtgactctatcccaaaaccttgacaatcccccagatattttgtcattgctagagtatgtacttactcatgggatacaataaaatatatgcaggatgagttgagaacagcagagccatgtgctgggcagagtctgggaggttggttaggctcccacggaaaatgagtgacctacccctacaaagaagctggcagtgtgagtgattagatttgtgccacagctaattagtaaattgaaggagtgggaccacccaagaatactcagaaccctgaatgttagttaaattcacacatgccagtgatagagtatatttctggtcttccgccttagatgccagctcttacgggaacagagccagtcctggttatataatagaatgtttccacaccactttggttcagtatcctaaattgtggctcttgttatggggtagacaggaatgaggttgacataacgtatttggtgtttggtgatggcaaagagtacctgttcatagacacacctggttgtccacctctggctagagaccaacccaagttcaactgtgcagaagtccatgttggcctttactggcccagccagcctctacctgagatcattccctacaacaaggggcccaggattcctcagtcaccccagcagcttttcccaaggaaaaccatctcatgaagaatttgccattgatgattttctcctcactgtgcatcgaagtcaatgggtttattactgagagttggttccttttaaaccttaaccttacactgtatatgatatagaactgtaggcaggccagggtcatcaataaagacatttttggggcctctacttggcttgtaaccacctgcttatccacagtactgtgcacctagcttgtcatcaggcagagtcaccagcagccacaacaaaagggtgcaccttcgtcttttccaagcagcaggcaatgtggctccattttaacttttctggcaatactcacatggattgttaaataatgctgtcaacagtgtcatcttcaaacccaaagcaaacttcctcatcatctgtagttagcagcatgaagacggtgatgatgtgtaacataaacacactttgaaatctgatgcaattgaccctacgaagagagtattccttagtgccctgtctggcaacttctggacagaccaggaggccttggggcttagagcacttcttcagcctcagctgcaaatccattttttcttgtcccttgttcccaggatgaagccacagtgtttcatcaggtacatttatcaggaatctctgtttctgtttatataacaatttaacttaagcctcaaccttcacagtgtacgcatcacatttccatggaaggattgcaggtattagaagatggtggatcatgtcttaaccacaggggaaatgtttcaggatgtttttatagaaactttcactaacaagcaggacacaggattggcagagaggtgggggtaggaggcaggtgaagggtggcatttgttgtgtttccctcttctaaatgaagttataatgacatctgtgtttcaagagtgtggcaagtttggactgagcttgaaataaatacagtttaattggtttcaaataactgaacaaaatgaccattccatgccctgtgtaataaaatgttatagaattaaaacttattagacgttaaaatccatgaaggatattttgctggatgcccatccttcagcattctgatgaggatcttcgtgtatttgttcaatgaataagtgaatcagcagctaaatcctgacctttgatttcctcagttctctcctgcaattgtcactgatgctctcatctccagtcctgagcaaggcaggagttgaattagtatccccttatagtgggaggggtctagaaatagctgtgccactttagaagctaggctttgtgggcttttccgggggatggaatgatttcattttcctgctttctactccacataccaccaagatcagaattctgccctaaacactaatgtgtgggagcctgatgtcctgcctaagtcttgtcaacctctttccaggtgactgaactccgaaccccatgcaccagtcactggccaacattctgcattaagtgacccggtcacccagcaccatccccctgacaccacctttatctctacaccacctgcctcctgcctgattaaatctcctcaaatattgacagacataatgatacctgaagatcccaaatccaaattttctttgcccctttggacattgaactttagattacaaaagaccctgactagggatcctgtggatagctgagtcaattttcttagccccattccttaaatatcaagtctttctaattttccaatgagagcacatgaaactctcaaggttaaaagtcaatttatattaataaaatctttaatttcttgatttctgaatatgaaaaaatgatactttgtgtattttttaattttttggcaaaaccttccaaatttgtggaaagagaaataatattgactactggataaccatgtgctatgtgtaaatattaacggattcaccttagtgggcactgacttgatgatgtttgccacattatattttccagagccttggctctcccaaaaaatgagaggtcatttttcaggggaggaccattttgtgtttggctaacatttaggacatataatttcttctcctctacatgccactgacccactgcatccctggttggagcaagaagagccatgctttccttaataatagctaatggtgaaaggatgtgttgtaacaagagcagaggaatagggaaacaggagaaagacagtcagttgaagagtcctgccctgtgtcagggcaccgtttggccagctgggcttgctaggagtagaatatagaaagtacatgaagtgccatactcagacagctctggctacgttgacaaactggtatatcatggtgcccaactttctttgttagctgggccagcatcataccctctagtatttgctctgaacttcgtaagcacggttgactagctttcttttcctctgcagttatcattcagactgaatagtttctaagaggctcttaatgagaaatagaaggaagtaagttaacttctgtgcataccttggccatatttgcttgacaaactgatgtgtatactaaagccattatgggtgtgaaaggcaaaagtataagtgctccccagtatgacctggctattttgtcttacttctatatttgattgctaaaaatatatgttcttgggtcaaaaaactcactttaagggaaaaaaatggaagaatattaataaccaaaatagaagaatattaagaactttaacatgagatgtatttagatcaaaaccatctctttttggatttttgcgggtgatttctccaacatgtttagaactgggttgctattcacccaaaggtggaaacttttgatgttggggaataccactgatgccttaaagcagagggtaaaaggaaaagactgaaattccaggctaaaatgaggagagcatggccaccactgagcccaaggtagcattcaataaatactatataaattactgatttatttctacagttggttgatagaagcttactatgatctgcctaagggtgcatcaaattcctctggtacttatcctattcttgactatcacttccttgggggcagcagttaatcaggtagaggcttatcctgtcaagagagtaaagggagctatggaggaactcgctgggaggagaagctggtcctcagagatgcttagggtttaggaccagtaagaggcagtctccacaccacccacatctgattcttgtctccttcttctctgctgtggtcaggagaaacagtttagattagggatttcagagcagtggtgttgaactttgtcaaaactgcatttgaatcccatttatgaattgtgtgatttttttaaggttgagttccccagaagtaggatgctgagacaaggattcctatgaaagtgaattattagaaaatggtccagggagaaagcgataggagagtcagaaaatgagacggggaaggtaaagaaaccagacaaggatacaatatcaagtagaatccaacagtggtgtgggtgggtagaagtatctgtctcagcagattttgagttgtccagattatcctcagttggtggttaaggttaaatttgcatcctcacgaggatgcaaatttctacacactatcagttgtccaagtgcaggtaaagctggctccagcagcctgagggcagccgacagagagacacgggtcctgggtgtgggagtgaaaccacacatgaagcctgcatgtaaaaaaaaaaaaggtaaagaggggctgggcgcgatggctcatgcctgtaatcccagcactttgggaggccaaggcgggtggatcgagaggtcaagagtttgagaccagcctggccaacatggtgaaaccctatctctactaagaatacaaaaattagctgggcagggtggcgggcacctgtagtcccagctgctcgggaggctgaggcaggggaattgcttgaacccaggaggcagaagttgcagtgagctgaggtggtgccactgcactccagcctggtcaacagagcaacactctgtctcagaaaattaaaataataaaataaaataaaataaaataaaataaaataaaataaaataaaataaaataaataaaataaaataaaataaaataaaataaaataaaataaaatagtaaagtaaaataaaataaaggcaaagagatcaatctacatcaccaaagcactgacagcatctgctacagtgactttggtagtttcttacattctctgagcctcagttttcttatctcttaagtcagaggaaaatgacttgtttaaaaaggcttcaatgaggtaacacaagtaaagcatgtattgagattactacacaggaaaagcagttgctgaatacaattagtcaactggtaattggtaataattatgtaaaattcctataattatagggagcgctatacaattattatatataattcctataattggaattaccaataggctaattgtattcagtaactactcttattgtcctcaagttgagttattattgcaagccctgagggctgaataaacatgcaaactaaactgacatgtagaattttatttataacaatatatgcctaaaagaagcggtttatttgcacaaggaaattttggaagctacagataattttaataatgactacagaaaactatcttgaagatgtttctaatgtttaagacataatagcataagcctttataaaatgggatactgttatgtagttatagttgtaagaatcagtgtttaaaggatgggtttgatgaaattgtactactctagttcctgtgcttctaataaaattaaatctgattaatacagcaagtaggtctttggtgagttgattctgatgctgggagtgattttcttaattcttgctcagaaagccatccatgagaattaaatgagatagcatgtacaatacctggtatagttactggtaagaggttttcagtagagaccaatctcctctttgtttaccttctcatcaagagaggaagaacaaggaaaattaggttgcttttttgagaaaatactttaggccaattacaattatctgaaagtagaatgaatttctaggttaggcaagactagagttaaaacgtgggtgtgcagggctgacctgccagggtactctgtatggaagtacatggaaatgtatgcccaaatacagcttcatataattgttttgatcatacacagtttccacatgagattatatttgaatgactaattcagcaaatataaaaaaggagaaaaccagtggacaagatgattcctaaggttcctttcttcctggtctatgccctagtgtattatgaattgatattcactggaacacacagttactgctggagattgagttataaaaacattcaaatgggttactccattatatctacttaggaaatttttttttaaaataactgatagatgttcagttatgcgaaacgaaaggtatttctggctacccctttatagttgtgtacatgactgcagagccatcatttcatgcttacttccccacattcatgtaccattttctcaaaggaaaattattgaatgaacttgctagttttgattctggggtttgttttaaacaactgatatttaaatccacctagtcctctttagctgttctcctaggaactttaatattaacaaacagctgaacttatacattttgtaaaagagttcagacaatgaattcattcttcttgaaatgcatggaagtacccaggtgctagctacacccaagagccttttctaaatacaaaaaggattgacaaaccaagcattcatcctgtctgcgtccaacagttcggaatcaaaccatgaacttgctgttcctctgtttgtggttagcttgtttgtatatttttaaggaagatgattcaatgcaagaagtagttttatatagtacgttaagtaaatttcctatacgatatacttaatcagaaaaatatttttgaactagagctcacagaacatatgattacaatagttttcagaaagcaaggggctaaatgaggatttctcaaccttggcactattgagattttaggttaatttatctatggtgggaggcgtgtcctgtgcattgtagcatatttatcagcagttgtgacctcgtacccactagataccagtagtcccccttctcagttgcaacaaccaaaacaactatagacattgctaagtgttctctaggggtcaaaatggctcctgcttgagaaccacagtctagatctggtagttgcatattgaactgacagtccccaggattgttgtggggatcaaattagataaaacttgtttatattttttaaaaagtaaaactaatacatatagttacattacacctcttcttttcatttgttactcatctaagattttttgagccagatgatggagacccataaataaattaaccttaagaggctcaaaggtttgccaggtaaacaaagagttagaagaaaaagagagatcatgtcagatgtgccttaatgaatgtgtgtgtaacatgtacaaaaagttatgggaaccccaagaaagaaaagactccttttgaatgaaatcagagaaaaccaactggaccatacagttgaagctctataacaggaattaccaattaactaattgtaactaaatactcttttatacaatgtcatatattcatgtagtttttaaatctagaagtagttaaggttcataattgtcatttctcagggacactactgaagtggtatcaaatctaaatgagcaacttaagaattgaagttgtcagacagctgttaattcccctttttcatacctgctccaatgatagccaacaatcaaacaaaaataataaaataaaaacgaaagcaaaaaatacaactcagatttcactacgtacagcaataaatatcagagacattagggaataataataggtcaaagcagaaattcattcctcagcatgttcttcaagtggaagaattaggtctgttttagttctgttgattctaaaagaaacattcaggctatcaagaaaacctgttttaaactctaaatctgacactatagatagatagatagatagatagatagatagatagatagatagatagatagatagatagatagatgatagatagatatagatagatagatagatagatagatagatagatagatagatagatagacagatagatagatataattctgcctaagtaattatctgctggtaccaaagagattgacaaagagattcactaacctaccagaatttcccaaccttgttccagggtattctacattaaatactcattaccaaggaaattccacataaaagctgtcatgcttgatggagccatatttacatgaaacgttgcagcattttcttctttaaacctcttctacaatttgaccaattccatgttccagggagtactcagaggctgattaggacatgagttgttagcatgtgctgcactaatggttatgagtcacatttgttttggaagatcacccttaaagcctgtcactcatgcttgtttatgggaaatacaacaacttaaacatcagttaacaaatccccatgaatgcatggtcatatttgagtgcttctaacaaatgcttcctttcatttctcccttgacagccctaagaattaaaggctggtagagcaaactgggagacatccatgaacatttattaaaggaagcataggagagtatgataactgcaaagccagctgtttatattattggtgtgagattaaatttcatcagtcttaaaacctgctttttaccactagagaaatcaatctgccatatttaaggttacattaacgtggaacattccacgtactgaactgtcacatgcctttaaaataaccatgccatgctgttttttttttttaaaatcattacacatgaaacaaacagctgacaggtggggatctattggtatattcaagtttttcatgtgaaaatttcccccaatattagtggtaatcacaatttgattatgagaaacaaacataccatatataggcagaactatatatcagtagcctttatatttgacagctcactgtaaaatccatactatgattcagtgaacatatttatgtcttatatctgggttgatctggttgccttcagctttcctcacttgaaaaaactatacttaaaaaactgtaatttaatgttaaagttaattaacacagcaaatacttattgatgacctattatttactgggtactattttcggtgcttgcaatgcctcaatgaacaaaagagataaaaacctctatggtcatgctgcttgctttagtgagatatatgtgtgtttgtggggtggaggacatgaatgtgaggcagacaataggctacaaaaataataaattatctagtattttataaggtggaaagagctatggaaaactgccccatttgttcctcatctgagtatacccaaaagttgatctttaatattttatatgagtctcctaggttctaaatgttagaaactaattaaaaataaattgaaactaaactaaatatctttgtgatctctctggctagaagcctcaggaccagtcctcactgtttactgatgaggaagccgaggcccagagaattaaacgatgtagccaagatttcaagcagttactgtcagaggtaggaccaagacacacaacctccttctctagtgtgtttttctcaatcggttggcatttaacagcaagtgttttagttgaaaaaatttatttgaaaatctgtttgaaacatgacaaaataggaaatacctgcttattccctcactgcagagtggtcctcagcagaaagaagattttgaagtttatgaattatgttcagacaagacccttataaaatcactctcctctctccagtggcagaagcgtggcccctgactcctcacccaccttcattcatctttcgtattccttgaaaattaccactgagtattttccttctgcttcctgcagcaccagcagaaaagatgaggatgcgtctcttgattgccattacaaatctctttcttatgcttgtttccattcttattctgcacataacttggacttggccatcattcttagagctcctctaaattgtttgattaaaagattgtttataagtccagagtcagaacggaattgaaaaggcactgcacattatgatggagaggaataaactccagtcaaaagtcatggcttctggactcaccaccctaaggcagcctcactggaacttgcttttccaactgtcagtggagttttagaattttcctacttgcaagcttgttgtgaggattaaacggttaagagagattgtgtctgttatggaattgtgaaaactgtaagttgcagtccacactgtagaaatcttagttacctctgccctttctttctctagagacaggttgctagtggaatagacaagtttgccattaatttgaaggttgcattaagcatatattatgttagtgaagttggtcttctgaaagttggaagggacctcagaggtcctgtattagaccaactgtggctgttccttagaataagctggaagttttctgaaaaatacaaattctgaagcctcatacatagagattctgatgtggaagatctggaattgatggcagcagcggcccatctggagccgctgctgtgaagatgccggctgtagtgggggaggtgcggctgtggttgtgccctccacagagctgccaggtgggaagcctgacccttctgagttggcaggtctgaagcccagtgctcttcaggcacagttgcagctgcccatctgtgcctctagacctgggcatccccgtgctctcgggggcccaggaagcaccccctgctcctgcaggcttggaagtgcctgctatcactccctggcctctccctgcacctgcacccagcacccgctccggggtgaagcaaagtcatggccaagcctggatgctgtcatgacctggtcaggtgtgcacacactcggagcagtgctgacacaccagccccctggcacataggcactctctggactttggacaccaaccagcatgggagggagactgagagggcactaaggggtggttcagcgcaggcctgcaggcgccccttggcatgaacagcctgggtgctgtggatgacatgtagatggtggcagaaggcagacaggctcctgggcagaaagaggccagtccccagtgaagctccaccttcaagccagggatggccggaagccttgtggctgagctatcagttccaggtggagtccttggctgggagtgagaacttatggtgctttatccaggccttcccatagccacccatggaccaataagcacacccttcctcccttctgatctcataaaatccctggacttatccaaactcgggcagatgtcgggatgacctgcctatggataagagctacccacttcaggtctcctgagaactgtactgtcactcagtaaagtatttcttcaccttgctcaccttccagttgtctgtgtatctcattcttcctggatgtgggacaagaactcaggacccacttaatagcaggactgaaagagctgtaacacgaacagggctgagacatgccttccctgcccaccacattgtaggtgacaagaacagaagagctacagccctttggggagcccagacctgtgtgacaccctctttgggggctctgcggtttctgtcatctccatgctcccaggcgtcaccacattcccctcgtccagatgcagttgcccacggtggaagccatttgcgtacatcagatgcagccgcaggcttgcatggagctggtgcctgtgctggtgcctggagctgctcaccccaccacggcagctggtgtacctggctgtacacagtggctgaaccccatgcttacccactcacgtatccctcattgctccacgcctggcttgcccttggcaggcatggggtccaggctggtagcgcaacccgagcatagcctaccaggccgttggcagaacaagcccattgggcccgagcaaaacttgggcaaatgtgccaccagccacaaaaaggaaacacaaaagtttccagctggaaaagcaagacctgaagaatcctgcaacagaatgatgctctggagtgttttctgtgttaggtgtgcttgtttgtttgactaaacctccaaacatgagtctgaagattaaccagtttgggaagccttgcttcagctttctactgacattaaactccttctcctctcccatttctgtcttcacttagaaatggaaacccactaattactcaagatcttaccttttccattcagtcaactaggcccttgcacccccattactttgcgttccaccttgacaattgctattgccaaacatcggcattaatctattttgacatcttctttccacctgctgccctctagtggaagtgctgacaagcagcaaaatatttaactgggaacagcaggaaagtgaccagtttgagctggccagttcacacaagtcagcgcaggtccccagcatgatgtctacagactacagctatgccagaaatcgttaggatggcctccagctgtttggacactatttgcacacaagttacatttagagcagaactttgtaaagaccctggcatttattcaagggctttttaaaggtttcaaaaatctacctggaaaacattacccttgggatatttttgtttctttgtccctcattttcttcttttgtcatttacccaaattcttcttcttgcaaaagaaggtggttctttcctgccttccctaacctttgaattttccaaatcttgcaaaaaataaagatatatatatctttaaataaagatatatatatatatatataaattcttacagtttagaagcttccagtcaccaggtgaaaggaattcacatgaactgaaaattgacaatgtaaaggacactgtgttctcctactgttcctccaagtctctttgcggtccgttagtagtcttcttttttccaggagacactgaagttaagagagtttaagaagattgtagtatgtcacaaagcaagtggaaaagctagcactagaactcaggtctggctgatggaaaacccttatgtattttttttaatgtgcttctttggtgtttagtgattatttagtcttccgtgaagtaataaataataacttgcatggtaaatgttattaaggctcgaggtactaaatttatagcaaaagtcattcagcttttttttaaatgaatgtttaataatcagtgtgtctctgcataatctccaattactccttttagcagaggaacatggcaggaatgcaggtaagtttgggtgggaggaaaagacagcaaaagccacagcactgatgcaaagttgagactagatttcacagggcagatgccgtatactccctcaagctttgaagaaactaaatagttatctatgttaaccaatagggcagaactcgtactccaaacaccgacataaaccgtgtgtgtgttttgtgtatgtgtgtgtcttcccccacagcattctgcacaattattaaccctttttgtgtagtggtttttcataattttatccttgattgttaatatcatggtaagtgatgtgttataaatatatttttccttaagtatcataaacaatctaagatttcatttggctgatttttcttttcttagtattgcatatcattattgctgttagaacactcatacagattattcagcttcttaactagaatgtatacacacacacacacacacacacacacacacgtgcatgtacagaactgccttctttctctttgatggtagaaaatacagctctctatagtaagcaaatttgctttcagtctcagacatacccttcattctctgcatgactggtaaagagcggaaagagtaatacttaggatctggattccagttccctgttctctgaccatttaaaaattttgttaccttggccaggtaaatacagttctatgaacgtcagttgtgcctcaattgagcaggcttgtccaaaggattcctcaaggatgaggtatcctttcagctgtatgagctgaaccttgatttgtgcaatagtttaagcccctgaatagtcagataaaaatcatgttaattaaaattaaatagctattggtaggatctggttttccactggcttgcatgaatgatgttttgccctcctttctgatactcagctcagaggattccttccattgggttttctttcttgtagtttttctggttcataaatagcctatagacaaacactaaactgttacaggtaaaaggaccctagattaagccttttataaaacaaatagtcctgtgtaaataatgacatcttattttatgtgtgtgaatttgagttttaggatgtagggcatgtctgactagatagctaaaggctgagctccaggcagccagctgctatccaatctccacacctggaatgttccaaaaaacctcctgtgttttctttctgcagctaagcactgatgagcaggatttaagaagtacagccacacactttttgctgcacgttttttaaagtttgttatttttgtcatagattacttgttttgaatcaaaaatttttaaagaaaacttaatctcccaaattttaacccccttgaagtttcaggattccaaggaatatttttattttaagatgcataaaatactcagtacatgtacaaaggtaatgcttataagaaacttagaaaaaaaaaaggagctagtaagattgagaaggggaagaatatctaagctaacattactaacctggcaactattataggtggctggatagcatgaaggcataaagctgaaggcagttaagaaaatagactggatttgaatcctggctctacctggattagttttgtgacctcagagaagttgcttcccttctctgtgcctcagtttcttcatatgtaaaaggagataactatagtgtctaacacacagaattattgtgaggattaaataagttaatacatataaagaaagtccaaaactatggcacacaaatgtttaatatatgtaagctattattgttataaaactaaagaaagagaacccagaagacattcagtttggtgggattcagatatatgttttcctttcctcctcctcctcctcctctccttctctaaccccactatgcttgcctcccaatctatccctgactcctatttttcttcctcccaacttaagaattgtcactaaaaatatttagaagaaaagaaaatgtgcatacttcagggggtgccaagcttttgggtaaagtacacttttcagctaacatgactgtatccaacagtaatgggctttatggcaagaaaaagcttttttctcaataaatgggttttaactttgtaatggattattctctttgcatgggtaattcttctggaagatggaaattggctcgatgataagataggacagttggatttagggatctagattaagggactatcatgtatgcttttaggagagaagtttaatctgcaaaacctacttgtcttatttaattaattgttgctcttagctgctcaattttgtacaggtgacttgcatgaaagcaaaatgtatgtcaaaatccaaaagcagagtgaagcctcgggacttcagtgcttttgggtgtctttccagacctctgctcttcccccaccctcaccaaggccccactgacctcaaagggcccttcttgccaggccgtgaattacgtctgagccagagggctgggactacagccaaagccaaatgaaggtgcagaatttaggactaaaaaaagcctgagcacgtggcactgggtatagcagataaatttgttggagaaatggtttataaataacatgaaaagggaaaggggatagagggtcaaaatattgagctgttgagagttgttcaatatttgaggtcagtctcaccatttttaatactgaacccaaaagtaatacacactgaaaaaaaaaaaaaactcactgaataaaattaactacagctgggcttattttttcttatcaagacatttgtaagtttggcagcaagcatttttaaacaggatctctattatatgaaataaatttaaaaacatgtgtctacagtcaggacaaacaagtgaacaaaaacaaagcaaaagcaataaagaagccccatgaaggcattatgcttttctgaggacagtataaggctaggatactgcagaaactgaaatacttagggatcttattgaaatagttttcttttcctccaaacaaagcaaccatctcagagggatagatgggctaaaagacaaggaataaagtaaacagaagattggtaacttgggaggttttcttttcccctttctctttttggttttgatttgcttttcccttgttaaagccagaaaggataaattttggtccagaactcccaagaccagagggtcagggaaagccaccccgaggctggaagctatgaacttatcgctagtctaaactccacctccttcttccctgggagtcctgcacaaatataactgcctgatctttctgtttactggcaaaggttttgctcccttctctttcgtatcggaatgtgaacttggggaaagatttggggttttttttgttttttttttgtttttttaagaaacagagacttgacttattcctcccacaaactcttaccctggcacagggagaccacaaactaagtgaaaacaaggtaagaagcttagagaaatgggaccatatgccctccccggagctgaaccgtgttccctgtccaccatcaccttgtcttcccatgctactactccactcctgtctcttccacactctgggtcacatgtctaccccttactgtgagttataatcgcccaggaagggtaacccattgactgagggccaagcttctgataagtgaatgaacttgtcttttctcctggccagatatctgtctttgccagagagggctgagtcagggagactaagattttcaaggtcaaattgtatattgtttaaaattgtgaaaatttgctttgtgcattgaatctcattttcaaaataaaattatgccttaagtcagatcatactgatgcagattctgcagatgttaagaggcttccatgattgtatttgccagctgcaggtcaggcagtggtggatggtggtaagaagtaacctatacttttggctgggagctgtggttcatgcctgtaatcccagcgctttaggaggctcaggcgggcagatcacgagatcaggagattgagaccatcctggctaacacagtgaaaccccgtctctactaaaaatacaaaaaaattagccaggcttggtggcacacgcctgtagtcccagctacttgggagactgaagcaggagaatcgcttgaacctgggaggcagaggttgctgtgagcgagatcgcgccattgcactccacactccagcctgggcagcaaaagcgaaactccatctcaaaaaaaaaaaaaaaaaaaaaaaaagtgacctatagttttgcagtagaattttgaattcaaactcaggctttatattttctccaaagtaaattgtattttgttcattttaatccattggttgactctaatgagatctttctgactggaaattctgccctttttttcctccataactgtattaccagttatctctcatccatgtgtttgataaatccatatgaatgtctttttttgttttctaccaaaacctttataacaaaacaaaattcatagctttgtcaactacacttgaaaattatgccccaggcttttcaggattctgtaattaacttattgagtcatttgtttaaccattggtgaattcatttatctttactcgggccacagtaatgtattttacttacaacatattatgagaaactacatcacctgcttcaccgaaattgaaaaacattagatgaacaacactgccctaaaccatatttcaataatcctttcatgaaaggaaaggaagtacatttcctataatgatttgttcttagtgaagccatgttgactccaagtgacctgttgtttcctttctgggctcatagaaataatctaaccattctaaaatattgatggggattcaggtcaaaggtatagttttaaaaattcaccatatttaacctgttaaacattcagtatctcctaccttctgtcttccaaaaatccaaagaaataaccatttattgttccgtttatgctttcagtgtctaggacatagctaatctgatactgaacatttgaacttatcgttagctttgaaaatatgccctattgtcctattggctttatactaaagttttattaatacattccctcaatagtctccagtctttgcccaagaagaagaaaattctgtaagagtttctttttaccttcctttcttctctgagtggaataatcttttttgttgtcttcatagtattttagagttttgtgagatcagacaaaatttacctcagcttataactttatcttttaagtggaaaaactctgaactattgattattgtgtcatcttgaaaaaatagtctatggaatatatataagtagttgtgttatttttttcagtgttaagttgacctttttcttttagtgcattgtgaatatttaaaaggtcatttgtgcaacatataagaggattgacaggtttccatgcatgatgcttaatgtggagatgatttctttccatcaagttattatgcttggaataagtaacacatcttaaaattacaaccttgatgtagcaaatcatcagatgggttaccattacatggaaagagccagtgaaataaagaccattaagttcaggtagacagagatggcggtgagaaattcacagccaaagagggccatatggaggtgaaaacactggtaaatggctctgggaccctaggagtctacagtaagtcattgggaagttggagtggagaaaggcaacattagctaggtatttcattcattcctccataaatgcttattgggagcatgttgtgtgcctggcatcatcctagcttcactgaaaagaatgaggaacatataaaatgtgaaggtgagaataagtgagaagtaattgctctttactctcaattatagctgggcaagtacatatatgaatatgcttttgtgttctgaacacacactaagcagttggtcaaagtattaagctagagacaacttctactttcaaatgtagtgtttcaaaataataataataataaagatttcaggacagtttacatataaccatttagagatttaaggattaaaatcaggagggaaggagaaatgtctctgctggggaaatttttttaaactagtgttttctactcagctactcaatgtgatttcttttattttcttccttccattgcttattggcatttattgtggggaagactgctgtgttggcagcatgagagagatgggaatcaagaaaatggaaacaccattcaatattcaaaagccactatccccttaaaagcaaccacagatcattcagttttgccacatactcagattgcacactaactggaggatgttaaaaagtgttctattacaaccagttatccagtttttgccacttaaactctgctgtgagaaatgtgactgtagagcagccttaaaaagagatcatcttgatattaagcagtgttactcatacatgcttgttgacattctaacaggtgactttgaatggatcttcaggctcagaaacatggttgtgtccctagaactggtgaggctggaacaaggtgtacagaagtgaaatgaccacttgctttctctattggatttctttatccagctgtgcaattgtttcagggactacagttgattttcctgatgcaagcctagcaacttgtttttcagttcagcacagtaaaatatgaacaggagagaactccctgttggccacccacctcacaatctttaaaagggaactctgtacagaagcattctgcattaggcaaatgtacacttctgcaatcaaaatgaaaaacacttgagctgaatcgtttttcgttagctttagtttccagccctgattaaaaagaacacagggaaccctgcaagtttaagcggttttggcagccgaggaaacagctgtgacattgtcaagggttgtctgtaggagctgtgcaggctgctgacagcactgataatgcccagaaatggggcagacgcttttcgcatttggtcatcaaaggagtggcagcagctaggttcaagaagtgaacttttgaccctgtctgagacaactggctctcgtggatcttgttctgtcattctccagtctgattttctctttcagaacaagtgggtaggatctttggtttttaaactgtttgactgttattaaaagtaagctagttcttatagctgcgattggaagggatggaaggtgaggaagaagagctggtatttcccactatcctgcaggggtggggaaatctatcaacgactgttccactaatctgcggatgagttatctagggaatatcatgcagttgccaaagttttcagcatctaaaagcctccaaagttctctctgtgagggtctacctcccctgtctccagatccttcccatgcccctcagactcagcacttgtccactgtccttgctaccagggaatccctctgcagcccccttaccctcctgcccctcccaaaagagctccagactttgacctttctcttccacctcaacatctgtttgtgtcttaaactgatgtccattgaaagaaacagataaactaattaatgctgagatatgacttatgaagtattatgaatgtgctaactctctcaggggtatgtgcattttaatagaggaccagcagtccaaaggccggtctcactccactgtgcccctctaacagcaccgagtctatttccaggcagccagagaccaggcctgagaacttgccccagaccaccagcgtccccactgagaaagcaagcagactcaacagtttttcagtgtttcagggagcctgcagcagcaatacagttccttcaaagggtctgtggattctctcagctttcctagtaggttgctgtggtagtttttggagcaaaagttcacgatgtgaatcttcacatgctgctctttgtgccgagcaggtgcttgcaagctagttctgcccctatctgccatcttaatcctaacatctcccatgtttttttaatttaacttctattttggtttcagaggtacatgtgcaggtctgttatatagataaattggatgccatgggagtttggggcatacatgatttcatcacccaggtaataaacatggtttccaataggttagtttttatgtcctcacccgcctcccatcctccacccccaagtgggtgccagtgtctattattcccttatttgtgtttatgtgtactcagtgtttagctcccacttataaatgagaacacgcagtgtttagttttctgttcctgtattagtttgctcaggataatggcttccagcactatccatgtggctgcacaggacatgagctcattttttatggctgcatagtattccatggtgtatatgtatcacattttctttatccagtctactgtcaatgggcatttaggtttatcctgtgtctttgttattgtgaatagagcctcagtgaacatacgtgtgtgtgtgtctttatggtagagcagtttatattccttggattgttgggtaaaatagcagttctattttaagttatttgagaaatcttcatcctgctttccatagtggctgaactaatttacattcctacaagcaatataaatattcctttttctctgcaaccttgccagcatctgttatttttttgagtttttaataatagccattctgactggtgtgagatggtattcattgtggttttgatttgcatttctctagtgaatagtgatcgtgagtattttttcatatgcttattttccatgtgtatgacttcttttgaaaagtatctgttcagggacatcattcctatgaaaatgctagttaattatacaagtattacttgtttccaataatcgattttttaaaaaaccttataatcaatattgcattaaaattttcagctgtgtgattccttatcattttcttggatgcaaatgccttgtgtcacgtactatatctcataaatctatattgcatctaacaaagtgctttgtgtaaagtaggcaattaataaatgcttgtttaatgagtagatttgtttttgttttattttgctttctatgttttcctaaggatgtggggcattaggccaatggaaactgtctctcaaaagttcttatatataaatattgatgtcaaagtcactatttttgtacaaataaacacatttacctaatttggtgagcatttatagagtcctgcctatattcaaggtccctgtgctgatcagtgggcaactgaagaagtatgaggcactgttactgctgtcttccttccctaattgggtcctataccttatcttggtacagctacctcctaaggaggcccatctgtgctgttgagggtacatctgaaggcagtgcactggaatgtatagcctaggactggaatttggagtgaggccctgagagatcatacacatttttcacttgtgggggaatgtccttaagtagaaatagatggtgatttcagatatttgatccaaacctaacttcctcatttgaattgagtatgctaataactattcttgaggctctggaatagtgatgacatttcctggttgggaaatcagatgctgatttctgaagcagagttttaaagttgaaagatgaaaagggaacaaaacaataaacacaaccttagactgaagggtcatttttctagtccaacttccctccacctagctgccacccaagattgtccctcagccatccttagaatattaaaataaatccattgcagtgctcaaatgacttgtttctatttgaaaatccttgccattggagaatttttctatatatcttaccttaatggctctccacgaattttgtcaacagtttgtcagcaatgtactcatgaaaatatctcatatctatgtatattctatcactttagcctccttgacttctagaccagcagttcccaaacttttcaaatgtgaccccttttagtatcaacttctgtttataaaagtacaaaagccctcacatcttatactttcttttatgcttttatttattgagatattagacaacacatacttgtaggtgacatggattcttagatctaaataactccactctccatggtcactgtcacttcaacacaggttgatgcagtccttagtttggaaaacagttttggcataaataatcccaaaccttcctatcacttcttggagcttttttcttcatgctttccttgcatctttcttaaaatgtgaagactacattggatatattattaaaataatgtcattattagtgctatgtttaaagctgaccttttcttcctagccactgatatagcagtgccaactgtggactctctttagaatgaacactttagtaataataagtccttagaacacaaacactgtcacttgtaaaacacttttctatacttggtaacctacacagaacagcggttcccagactttttcttttttttgtcttgtgggtcctttatatattcttacaaattattaaagactccaaagagcttttgtttatgtgaggttttgttattgatacttactgtcttagtaattaaaactaagaaaattgtaaaacaacacatcccattagctgtcagagcatcatcatgtcttgtaggctctggaaaactccactgtacactcatgaagaatgagtgtgaaagagccaaatagtagcttaatattattataataatagtttaactttgtgagctcaccaatataatacatattcatgacacagtccctaacatctaaaaacttacaatctaaggcccaacataaatactaatagatgatgctaaattctggcttcacagtgcttcctacaataatactaaaaatatatgaatttagacagaggccaaaatgtgtttattaaccacttggctttgcttagtattttgttacccaccttggagaattgcctctgctgatttacactttataagaagcagccctatgaaattttttatcataagtttaacaatgatgtagaacatactgtttcattttataatgatccttgggcaaaatgtataatatctgtgggagaaatgctcaatgctgcagtaaaaactatacttctcctcagaatcaggtatgttcttatatggtcagtataaatcttataactgtgctttctgatctcctttggccaccaggaagacaggagctgacaatccaacttactataaattcttcagggtctgatgtcattatttctataagattttccctggcattatcttatttctcaggtctcacttttcctttgttctgatttatttttcttaatatgttttattgtgtatttgttaatatgttttgttgtgtatttaattgccaatggggatgaatgaataagtgagaaagaaagatacttgatccatttgagtgggactgcttgagtacctggagtggtgcagaccaagcagggtaactgtatcaggtttcattaatgaaatgggtcttaagtggagattaggaaggaaaggaagtgggttgctggagaggcggggtgttttatgtgacagattggctgtaataaagatgcagctgtggagtgagtgagtgatgtcctgagcacagtaaggagatctggctgacgtggcactgcacctcattgccttaatatcttttcatttgattgaagaggcagctgagggataggtgctcttggaaagtggagtaaccatttccaattaaggaaggactctcacttcagtttctaaaataaattagaagggagaaaatatgaagtctgagagatcaattaggagaaagttctggtgctacatatagaaataggcttatccgcatatgcaggtgagagtacgaagaagaatctgtgaatggcagtcattttttgtagctggttccaattaaaattgattctctataatgactacttattggctgctgctcaccaggtctgcctttttcatcattgtctgcagaacatatcacagtatacagcatagagtaggtgcttcataatgtgttaaatggatgaaatgggttcctacctccaaaggagatggaaaaaaaaaaacaggcaagtaaataaagtaaaatatgtataaattgctttaagaatgttttataaaaaaggacagtagcccaacagcattcacagtaggctggctggagtagcagtcattgaagaaacccatgaaaacagcggcagaagcaaatgtgcagctgctctgccttttcacactgtagggcagcacacgaatagtcctggagcaccagggcccttagactgtgggatttttaagttacctagttggcacagcattgactcctcctctggtgtgattaggggccaggatacaataaacatatgttatgttggaactttgatgccagcctaaacttgccagttcagtgtttgtggttgcaggtagtatcagctcctctcctgatatgattgagagactgaggtccaaggcttcaggttgaacagaattgatggccctaaggattgggttagaactcttccaaagcacttagcaggaagccagtttacttttcttggatgccagcttccaagaaaagatcagtcttgagcaaaatagtccttcactctcagctcagaagcctaattgagagggtatcctataagtaacacagcccactctgctagtaacctgttctacttcaacctgtaaggcccatgaggctagccagtgacatcactacaggacacagtggaggatgtttaggaatggctgggtgatgaccagggtgcagattgtgtttactcaaggctgattgagaaatactgttttcagtggtgtgcttataaatgtttaacagtggtgggtggaaggggggctctggcttgtagcatttttctagtgcccatggtgtaaatactcccaacatgaccaactttaagttaccaatgtgattgaaagtagagtttggaagcgaggcacagtagcccactgttatgtagtatttttgccatacagatgcataagagacataagtaacctgaagaacatagataattattaaatgtagtaaaatgatcatgaagtgacagatcttgagtgttttatcacatttgtttttaatataatttaattttaagttgccataatttaatttgtaattaagactatgttaataattggcttatggaatttctgagaattcaaaaaccagtgcccataggtggatccagtacaccactaggtaagaacagcctagaagtacttctaggctcttgttctgaaaggtgccaagactggcatccatggttccagtgccagggtcgaggaaagacttactaggtcctgcagtattgctcccaaatctctttcagtggccagggaaattatcagcctgaaggcaggctgaatggcttgcttacattcaggtcccagtatctacgattgacaatcggcttcatttgtaagtaccagatagtgcaactccatgtatccaggaggctgggaggtactgagagcagactgatagtgtcaagagacactgaaatgactgccagctctctcctgccatatccactactaagtgagaaattcagtgacatagtcactgaggactccaccactgctgggtgttggggagggcacactgagtatttcaagacaatccgggtaagatttttcttggagggattcaagtacaaaatagttaatatgcagaaatgaagcagaaattattatacctcagaaatgagtcagataatactaaagaaaggaagaaaggaaagcatgacttgattcatgtctttaatgatgaccaaagaagttgggtctttaaagatgacaagagaagactgatcaggtagcagtgaggtggaaggggaaagatgagagaggggacattcctggtagaggaagcaaggtagacaaagtgtaggaatgtgaaagagcataatgtatgtaagtattgttcaggtgacttcttgggtacctagatagtagagagaaattagaggtaagaatggaggaaggggagactcagggccaggttgttgagggcattttatgccatgctaaggagtttccaatttttcctttcagtaatagcaagaaacttaaaatgagcaggggtttgtgtttttgaaagaactgggaaaacacctctgggcaatccattacctggggataatgggtgaaatttcccaagttagtgcacaggctgctgggtagggcttgaggctttcctcttgcctcctatttcaacactgtggtcttttaggacttgtcctcaacatgttcttaaaaggaatgtttgctaactgccaaaacagtagtcttcatatttattctgttcctttccaaaaggtaaattgaaaaagcaacataccctcagccaagagaattaatcttttatcacctaagttactgcccactgcctttcagttttaaagttaatttagtgtgcataaatggctatgagcccctggaactctctttatgtttgcatcttaaatttaccagaccctccttctgcctctagttccagaattttctttgtcttattttcttcaagaaatgtatttctttaaattggattgcaaatttggaatacacacagtcaaagccttttaaaaccattcttttaaaaaaggacaagtttcttgagaacatttttaaaggaaaaagttaaaatagatgtcaatggaagatgcaaatatgaatataaaatatgaaaagcatctataggctggagcttctcagtagagctctacttcatttaaagtcatattatctggcaccatttcaaagcttttggttacttgattttgtagttagaaaaaaagtataaagttgaaatattgggctctttacatgaccattttgctagtagcagtggatgaagcttttctctaagagatcaatagctttagtgtaaacttggtcaataccttattggaagaggtgactatgtcagattaggtagaaactttaaaagccagcaagtttccaaatgtccttctggaattggcctcctagggccatgtggaccagagagatcttatcacagaagtcataaactgatatccgtgagccaaatctagctcatgggcatgttgtttggcctacagcacattttttttttttttttttttttttgagacagagttcactctgtcacccaggccggagtgcagtggcacaatctcagctcactcaacctctgcctcccgggttcaagcaattccctggctcagcctcctgagtagctgggattacaggtgcccaccaccacacctggctaatttttgtatttttagtagagatggggtttcaccatcttggccaggctggtcttgaactcctgacctcgtgatccacccccccgcctcttggcctcccaaagtgctgggattacaggcgtgagccaccacgcctggcccacaccacatttgtaagcagatgaattggttatttttaaaaatttgaagaatttaacaacaaaaacaacaacaacaacaacaaacttttgtgtccagcttctttttttttattgtcccaatagttaaggacaatcctgggcctgcattctttgaacagttggctagacttaagtagctgctgccccttttagatggggcaaacattctctactttttcacagtccccttcaagggtgcttcagccatttttgctactcacttgtcttcaataaaccaaggtcatgtttaaaagattaaataacagttattgcatgctcaccaaaccgtcacaaggaaccagacttgtgtaccagaacagagtcctggagcatatctctgttaggctagacatcactcttttagttatgggatcatggaaaggtgcagaaagttccagggaaggggtcgggagggatttggtgagtgaggcacttggaggcatgggtcaatagcttttcaccagctagcatggaagtacttttagtgtttaaaaacctatggcacagtgggatcttctaggaaagtagaccctggagatggagattcacatgtagcacatttattaggggatgccactaggatcaatatctgtaaaagagagagaaaggatgtaagagtgggcagagggagaagttgagctgcaaagcaggcccagtgccagcctcaactggctccataaggagctctggctctggaatgcccttttatatttgtttcccatgggaccaggatggctaggccattctactctgacatgcatcactcactgaaagtgggaagagtcttgctcttgagtgaggaaatcccctgctactgaggcaatccctcaaaggagtaagaagtgaaagctcctggcctggagcacctgcaacatctgaaacaagaaatccttcattgaacaggatctgggcagcacaccagagtgatcacagtcagcagctataccagtgacaacagatgaatatcaactctgcctttagcccctagggtatgacacctggcctaccaaggctgtgcctaaactctttggactgattcagaatcaagcaagtcctagcctaaagagaggagtttaatgtcatgctacgctctagcccaatatttgctgacttgtaattcagtcattaaaaaaattctttttatcttcacatagttttagattgtcaaactgttaccgttctgtgtccagaaattaaaatctattctttctattctttttttttttttttttttttttttgtgacggagttttgctcttgatgcccaggctggagtgcgatggtgcaatcttgtctcactgcaacctccgcctcctgggttcaagcaattctcctgtctcagcctcctgagtagctgggattacaggcgcatgccaccatgctcagctaatttttgtgtttttagtagagatgaggtttcatcatattggtcaggcttgtcttgaattcccgacttgaggtgatccgccccgctcagcctcccaaagtgctgggattacaagtgaaatctattcttatattttattgtaacctcagaaaagaatgcttttttgaggactagagttctgtctcttttattgtcttctcctttctctttcccaaacctataactctattttgcttagcacacaatgaataatcagatgtcttaaattgtggcttacataattactagtataacttttttgcttttttttatttcattttaatctgttcatgaggactgttacccaggtatttaaaaaatctcactccattgttttaaggttagtggttccaaagggattttagagaccctgacccaataatagttatatttttctaagtggttctgaagcaatggtcacaagtaagaaactgcagttcaaaacacatcataggtttgttattttccaaattcttattaaagcattaatgcaaatggaattttcctactagtattctgctttctctaatccttgacaggactaattgctaaactataatatgatttattataattttatgtttatattaaaaatatagaatatgattgccctttgatgtcaaatactaaagatcctgctactattttagttgtgctggttcttttcttccttatctttcattcaccttttcaattcatctcataaacatttaatgaaaaacttattgtgtatcaagggttgtttattatatgatttgtaattcaaaaactttctttctctggtctgagaattttagaaacatgaaaagaaagagggagggagaccaactgagagtataaaaataaatctggcatttattaacagttaaccaatttcttttttctataataatttatctactaaactgtattttttaaattattgttttagtttttgttgcatatatttaaggtatacaacatgatgttttttataattactagagtgaaacaaattaacaaactcatctcctacatagttatcttttgcgtgtatgtgtgtggtaagagctccagaaatctactctattaacaaatttccaatatgcaatacaatattattaatgatagtctttctgctgtacgtcagattcctagacttattcatccttcataactgctactttgtaccatttgaactacgttttcacatcccctgtgaaaatgggaggggggccgtaccatttgcatggaatatctttttccatcacttaccttttactgtatgtatgtactcagatctaaactgagtttcttgtggaaaccatacagttggatcttcattctttacccattcagccattctgtatcttttttattgaggagtttagaccatttacaatttaagtaattattgatagggacagatttaagcttgccattttgtcaactgttttctatttgtttataattcttttttctcttgctctcttcttcagtgttttgttggatttttatgctgataggttttgatttcttcttttgtgtaacttctatatattttttctttgttgtcaccaaagggcttacataaaatattttagagttgtaactgtccaatttatgctgatagcaacttagcttcctttgcttataagaactctctgcttttacctcttctcccccattatatgctactaatatcccaatgtacatctgtttatattgtgtatgtagtaacataatttagttatagttgttttaatacttgtcttttagtttttatagtagaatgaacatatttacctaccactgttatagtaatacagtattctgtattattttttaccaatgtgttccctactctgctgctttctttttgtttcaattttaagagctatctttggcatttcttataaggcaaatctagataaactctctcaacttttgtttgtctgagaaattatttatcttgcctttatttttgaaggacaggattgctgggtatagccgtctttgttgttaggttttgtgttttttttttcttttttcagcacttggaatatatcattcaactcccttcaggcctgcaaggtttctgcagaaaaatcgtctgataatactacagagatttcattataagtagcaagtcacttctctcttgctgctttcaaaattctctttgtcttcaacttttaacaattataatgtgtcctggcgtgggtctctttggattcatcttacttggtgtcgtttgggcttcctggatctggatgtttattttcttcccgggactggaaaatattcaaccattatttctttgaatttttttctctctctcttctccttttgtatattccgtaatatgtatatgggttcacttgatgttattccaaaattcccttaagctatctttacttctcttcattcttttttctttttgcttctctgactggataatcatcaataatctgtttttgagttagctgatcttttcttctgtttgatttagtcttctcttgaataccttctgagtaaaaacaaacaaacaaactgtttttcctctgctttcacagttcaacagcaatcagtaaagaagccctttgtgacaaaatgtgtgtttagggaaggggtggtttccttcacacaacaagtaagcaatcagttctgcagtaaataccagtttggtgtcctctaattcaattccaacacttctactgagagatcctacagattgggggctcagtccccgagactgtcttcctcaaccaacttccaatgccaattgcaaaccccaggttattttgcctgtacttcttactgactggctataaactgaggttcccacaacccccttctgaggttcaattaatttgcaagagtggctcatggaacttggaaacacttgcttatgtttatgagtttattataaaggatattttaagggatacaaacaaacagccagaagaagagatgtctagggtaaggtcaggaagggtcatgagtacaggagcttctgtccttgtggagttggggtacacaacccttcggacatgtagatgagttcttgttcaccttcctgtaagccttcacatgtatagctgtctagaagctctctaaatcctgtactctttggccatttatggagacctcattggataggcatgattgacaatcatgtggaaatgtgattggacaaaaagagtattagctagtgctaacagactgaatggaaaacccagaaaggcctgtctgttcagattcttcctggtctctctctgcagcattctttcctccagggaatggggcaggaccttttttgaaatgaaaatcttatgacctacaatcagacaaagtaggtcagagaatttctttatggccagaggcaggggaagacttaagtgtatttttagtttctgttgcctgccttatggagaaaaaggaacaggtgaatagagggtaagagaaagtcatagagagatttctgttttttgaggcctgcttctaatgtctaaagcaccccagcattataataaaagactgtaataagagctaaggaagttatgagccaggaactgtggacaaagtaatatcacacccctctattttttttttttttttagtttacttactgtattatttatttccatgatttctgtttggtactttttaatattttctatctttttgttgaaatctcactttgttcatgcattgctcacataaactcagtgagcatctttatggctgttatttttaattctctgtgaaatcagttacctccatttcattagggtcagtttatagaggatttatctagttcttttgtttgaaatatattttcctatttctttattttccttgactacctagagctttctttaaattatatgaaatagccatctctcccagtcttgtcaaactggctttgtgtagcagaggtacctcaccaatcaacttgaccagagatttgtggtgcctcttttttttttttttttttttttttgagacagagtttcactcttgttgcctaggctggagtgcaatggtgccattcagctcaccccaacctccacgtcccgggttcaagtgattcccctgtcccctgtctcagcctcccgagtagctgggattacaggcatgcaccaacacgcccggctaattttgtattttttttagtagagatggggtttctccatgttggtcaggctggtgtcgagctcccgacctcaggtgatccgtctgcctcgacctcccaaagtgctgggattatagatgagagccaccgcgcccggcctggggtgcctcttaaacttttgtgcttattcaaaccaccagttttgttcttagtggccctcggtaggaatgtcccaagtcctaagttagtgaccaaggtagagaaacctgtccctcaagaagcagctagaaatattggggctctagatgagtggtccatcttcctctctcctcagggataagctgggagctggactttataccccactcactctgcagtccagatagaggatctgtgccaaatgcttgtgctctatttcagacaatgctctctttaaacatttactttgctctctcaaatggcaggtctcattagctgtcctggataagtgaattagctggaagcttggttatgtttctggagtgaggagctgcaggaagtgccctcatgcctgttcagactcccggagttctactaattgcctgctccatcagctccctgatgcaggctaattaatagcttaatccacggacagcagctaggaaagtcagaatattatgtatgcagtctaactccgtccagggagaaactgagagctgggtgtttttgcttgctcactcttcactgagcttggggaactagctgctggtagtgcacatgagctcatttaaaaccacttctttgttccttgtggtcttgggggacacataaatgccagtcccccatagctcccagagctaggtgatttcagagccagtctctcaggtgggagctgtaaaagttggggtgctcaatgtatggacaaactccttccaggagagattagatgcttgattttatcattggattgagctgggggagaaggcacaggaagtgcccacacactagtgcccacatacataccctttcaagctcccagaggtcttactaattacctgccccactggctcttagtccacttagtaatgctataaggaatacctgttgctgggtaatttatgaggaagagaggtttatttggttcatggttctgcaggctgtacaggaagcatgatgctagcatctgcttccagtgagggcttcaggctgtttccactcatggtagaaggttaaggggagttggcatgtagaaatcacatggcaagagatgaggcaagaaagaaagaggagaaggtgccaggctcttttcaacaatcggttctctcgtagaaactaagactgagaacttaaccactgccctgacaagggcaccaagccataaatgagagatcattcttatgacccagacacctcccacaaggtccacctcccacactggggatcaaatttcaacatgaagctttctggggccaaacaaactgcatcaaaatcgggctcccagttttagactatgtagaactttaatccttgggcagcagctgggaaagtgcaataaaacccctaccagagagaaactaggagttgggcaatatcgcctgttcactctgtactaagcctgagggaattggggtaggaagttcttgcacacctgtttaaaattgccaccttgttctctgtggtccagagataattgcaaatgctgagcctatctgcttccagagctaggtgaattggtgattatggtttggctctgtgtccccacccaaagattgatcatggggacggtttcttccaagcattctcatgatagtgagtgagctctcacaagagctgatgaagttttaaaggtgtttggcagttccccctttgctcactttccctctctcctgccaccatgtaagatttgccttgcttccccttcaccttccaccatgattataagtttcctgagccctccccagccatgtggaactgtgagtcaattaaacctctttcctttttaagttacccagtctcaggtagtttctttctagcagggtgaaaacagaataatataaggagcaagtccctcagggaggagctgtaaaagttgaggtgctatatgtgtggtcccaaccctttaacttctaagaaggtaaagctaggagttgggtttccttcctgattacaaagtgatgtgcctgggtggtgctattggtgtgaattaaccaatttcttaaacatcaactaggtgttccaaactgtgctaagggctagggaaaaggctttgttatccttattctgagagagcttatagtctgattaggaataagaaaactgacacaaaataacagcaaataacaaggcaacataatcagttgctacatgttatggtggtatataaatgatggtagaatttagaaaactgaaaggggacaggatagacaagagtggtcaggaaggctgcatggaagagaaggaacttgatttgggatagaagaaggggctgggatttgggaagacaaaacaaaagaagagggccattccagtatccaagtaatgacagatagaggcacagggcatgtattaacacgagaatagcagaagtttgatgttggttagaacttactaccaacttcttacagaactttcctctaagaattatgagtttgaaaacattcaacacctcaatctactttcaagatttcctggcaaagtgaaggaagcaaatacctttattattttacaactgaagttacctgttttgtcagttatgatctaggctgattctaactacctatgggcaacctagaacagtcaaaagagctaggaattcattcaaaagaccaaaatctgcattgtctggtagtgtgagcatgagcaaatcacttcatctccttgagccccagttttctcatctaggaatgaaaagtagagccttatctatctgaccaggttattatgctattaagttatataagtaaatgtgaaaattcttcttaaacaataaaacaatataaattttagttggtacttttgttaacatctacactagaccacgtttatataggtaatttaaaaataaaaaagaatggggaattcattcttatgtcatggatttatattttttttgtagtacaaagttaatcgctcagcagtgtttgttacatttcaagtagcaaccatcatattgccatgaaatttatttagtaacccctaactactttttttttaatgaaatagcatagaatgaaagtatagtgtatattgtactttttagggcagtagattatatcatttgtcataaagatgagtgtcgtttagtgacacacaaaggcataagtgacatacacactggtcaaaatgtaaaatatatttctttttgtggattgttgtcaaagaagattgaaagacactaattaataatatagtatttcaaatataaaatcctcagtcttcatattttgaaccctcaaattaaactaaccaaaaagataaatttcagagaaaagttattttatgtaaagaaagtgagattttgatgaaatgagacatgctaccacatattctttattttcttcttatgtctcttgctgaaacccaaattctgtcttcacttctgctgcccaagtatacaaagcaaagggattttttgtgtgtgtttccatcaaaagctacatgcctagaaactcattgtactctattttttctggtagctcttgagttgtttattttaactatcaatcaatattatataatttaaaaataaaaacttaatttgtgacaaagtaagttttcagtctgggttcaggaaagaaagggatggcatatgcaaaaatgatgtaaccaggaagaatgcaataatatgtctatgtacaagaggggtgatagaattaaggaaaccaaccaaagatggtgaagaacccagagctaagaaaagggtactagctcccaggcctgaaaggtcacagtgttctaggttccagaagtgacactgagcagtgggagaggagcaatattactagtgccatcatgggaaaccagtcttttcaggaaagagagaggcatggaggggacaggtgccaatggctgaacccaatgaagaccaagggttctgggcaatgtcatctgtaatggccaacttcctggggcacagagcagggaagacgagagtggaaaatgagtgtggagcaacaaatggggagtaaccagcaacctattatatgaatgatcatttttcatgtcagatggtggcatatagcttttctactcaaattcagtttccttcctctgtttgctaactggcctagaccaatcctgatctagcccatggtagtttactttggttcctagctgttgggtagccaaccagtggtgtcttcctgcaggaacttcttagaagggccaaagataaaggatgaagtgtcctcattgatttcatagacacaaccagttctagatcactggttcaaagagggtaataaattagtaaagtgggagaacacgaaattaggaagattcatttctgctttattgtgaactgggtcaatttttgctttcttaatattaatcttgaaaaagatatcctttgaaatctcaaaatccttttctgtaatttaaaaacaaccttaccatctgtgtcctctgtcatatggtacaatattcaagagggtgaaataatggtccagtgactaagaaaaaccttaaaggataaattggccttagtgactgtcactaaaatgtaaacatggctttaaaaagtaaatcaggaggcatgaaagggccttgacagctaaggctctcaggaagggtctagaaagacatgaagcacaattttataagtgtgatataggagttactcttctttttttattcatgtgtcatagaagggaaaggaaatttctaaaggagtaagaccagccagatatcacaagaatatacaggaatgtaaggatagcatgttcaagggcaacatgaggagtcaaagaaaatgtcctggatgccaagactagctgtgttcttgcagctgctggctcctccttggcaaacacaccattggcaatgaactgatctgatgtgaacccctctaagtccttgagactctctttttattgcaaagcttgccagcctctttacccagtacatgtactccactctaagaagaaaaaacaaaactaagtgactgctaagctcatggacaatgtttttgggtctctccagcagccagctagtggctgactaggtaaaatcatttatttttctcaagatgttgtgattctgggaatgcagggtttggctgccatgttagcctggattttctgagatgcatccctgcaagagattcactgggaaattagatgtgcaagagatttatctggggaaatgcctatgagggaaaatggagaaggagctgcagaaggctggaagagatgaccactgcagtacaggtctaatcccagtggaaaaaaaaaaaggagagaaggaatgagaaaagggaaagagagaaggagggaagaaaggaaagaggtagggagggagggaaagtcttagacatcagtgcagtgccaagaaagttttggcaaggctgatggggagtcttcaaaccaaagtcacttgaaagaggaatcccctcatcatccctctaggaatgggcctgccttggtgtccttgtcatgcaaagtcactggctgggtggatttcagagcatagcagctgagggcataggccagttacactctgccataggaggcttgagagatgcattttcatagctgccacatttgccactgaaaccttctgggagtgatgggttgtgctggaagaatttgaagatactatcttatgctccagataaagaaatgcattgatgaaggcccttcactattagatttatttttgtgtgtcccaactattatataaattcccctatcaaggaattttcagtgttttctccttgcccttagatatgtgatcttatatcccaggtttgctgagacattcctcttacagatagttctactggctcatgagtgtaatgtgtctaaatgtatggttggaaaaatgtggttattagatctaaattttaagtccaaatttccttagcctgaagtttagagtcttccacagtctagtcccaaccactttttccaaccttaattaccattgcactttatcctgtatttcaattcatttgaaatatttgctcctttctaaattactcttgcttacccaccactatctctttgttcatactgttctcttcaactaaggttaattaatcaacatgtatttattgcccccttcccatgggccaagccctgtgcttagaactgtatgttaggggacaaaacgcacatggtttctgtcttcttagagtttgaatttagtagaagaggaacagacaaatacacaggtcaatggacagtgcatgcttacaaatcatgtgacagtgtcaaaagtaaacaaagagggttccctgacagagaattagaggaaggttttattttagatagagctatcaggaaagaaatggcatttcagctggaacttgaatgataaagggaatgtagttactaaggacttaagtcctgcaggtaccagttccatcatcttcaagatattgccatgatcttcacaaaatctttactgactcatcattggactctcaaccaattttagccctgtgctatctgcatcttttatatcacagaaagtgttgaagttcatactatatactaaatgtgtttgtctccaatcagactataagattgtggaatgttagacccatgtgtgatgtatgcctttgtatcctatcagattatatgattttggaaggttagagctatgtctgtatccagcataatatttatctctgtatctgcatgatacttaggataatagtatgtggccacatccaacaaatacttgttgaatgaataaacagtattccactctctgcaaatttggtctttctgacatttgtctgaattatagaaggagaaggaggctttacataatagttgaaaattactgttcatgtaatacagagttctgaacttcaaccagaagcaagtctacagcagatgaaaacatttgtaatgagggaattagctgtggataactttcggataggatgttataagtttagcatttgtattaaaatccattattatatgcataattaagttttaggaagaaaatctggctgaatagtaaacaattactattttcaaacagttcttcagcagttagttaccactggcttctagaatttaactgttgttttttttaatatatcaaactagcatgtgggttgagacacaacatcacattacaaatgggtagtcccttcacttgtagatcaatcagtaataatatagatactgatttttacagtttgtaaaattattgtcatttctttctcttattatctgtattctcagaaacaaagagtataaacaaagagaaagggcatgatgtatttttgataggctaccatctcaaattttcatttcaatgtttatttggagaaacacttttatctaaaatggaccttttccattttacaattgcacttgctctcagaatgagaactgcaccttccaggagagatttcaatctgactccaaagccttgaccctcacaaacagtgttgtttgtaatggcccctggttagaaactctcagcctaacaagcatgcagcatagcccctgaagtctctcctcctatctgcataaattggggatgtagaactcctgcatatccagcctcacttactcataaaatgctgggaatcattccaaattgctcttccagaggagggtttgtttttaaaattatttcagatagagatgtttcaaattctacataaatgcataatattatttctgattgtgctttcttggtatttctcttcctgtaacacctacttagccattctccagggaccacttcaaggacttttgtaatccatatagctttcctaagctgttctaactttcagcaatcccaaccacatcactgaccgagtttgtaatgactcaccagacaatgtgttgggtcctctagtaatactttgttaattccaagttatccttgctgctgttgtttctccgtgtgtgtttctatctgcgctctccagttaagctgtaatcaacttaaccactgggctttgtcttatactctacttctcacaacccttgcctcttaaattggttaatgtatgtttgatgactaattgtacacataatagctacttgataaatgttcttaagaaagggacaaattaagtattttccctgataatcctctataccaggcatcgctgtggaaagctgcacagttgggaaagcgtcatttcaaaaacaggaaaaatcacctgtaaattatttcagggatttgactttgacattatgttgacataaaagaggcttaagaacagctattagaaaatagaaacagataaatgaatgagtgaatggcatacctaaatggcatgaaatgtgaaaatgatacaaaatgttaaggtaatccttttttcttctctaattaatctccactgggtatggggaatagggaacaactggggtattcgtaacaggcaaacattcctgattcttgccctactaaaggtagggacattaggagaaaggatcatctacttggaaaataaactggcattgctaagtctaaatgattgagtcaagtgcaaattttataggccaaatagaattttcacaagtccattgactgttgaaaactacttgtaccctggctcaaaggacattttcttgctgtctgtagtaagcggtctgtaaactgtgtttaggacctgaaccgaatgctggcctttcacttctcaaactatagcttagtaatcccagctcagaagtccctccatacacaatttagtaaaattaacatcagagcataaccatgctttgttccctccagaagtaaaatgtgaagtttcttcccattggaagtctatttattattagtttcagatgttgtgacaccgttttcatccaaatgttagagaacagaaagaagccttttttaaaagcgtaactttcattattcatctaggtttttttcagggtccttgagaaatgctaagattatgccttgtgtttgagaagtagaaaaggaaaaagggaggaaaaccacctagagaagtgcttctcaaactttaaggcacacatgaatcacctggggaccttgcagattctgattctgaaggtcagaggtggggcctgacatcctgcatttctaacgagcttccaggggatgctgatgctgctggcccacagaccatactacctagagcagcaagctttataggccatagaggacattttttttttttttttttttttttttttttttgcatggagcacagattactgctctactctaggttacaattccaaggaaataatgactaaagaaaaatactgctgtttcaacatttctgagtcatttagtaagaatggaaggttaacattagcaatttaacatttcaaatgtggtgggagtatttattgatgtactaatttgcattttgttcctgccaaatctttttactctgttggctccagggagtttgaaagtctaggacagaatttttcttcctaggtttgtttacatattgtggaaaagaagtgagcatctttggagttaaggagagttaagacccaaggagaagaaagaaaaagactatgaaagatttttaaaatgtttatccctgtgtaagatctccaaagcccctcccttgacccagtagtagcaaatggagccacagtgatggctgaaattgaatatcccactaacttggtaaaagttgggcaggctcccagtcagacttaaatcattttagagaagtacaataatgtggcattccttgcaccctggtgatatgcagaaaatacatacctgcttccgacgaaatttaaacatggactgttaacaagaatgtacccttaaagttttgtaaactctacagcaaagaaaaaaaaaactgctacagaaaaaataaggattttttttctagctttaccagcgacctatactttcatttcttcatgttactaattacagaaactttcagcagaaatgtatcactcttgggcatcagttagttctaaacattttagctcttaggagcctctgatgacatctgttctgttgttagttttgctccctgactagattgtaacttctaagctcaggaatcatgtctgcaactacttttctttagtcctaacctaaccaagagctaggcatttaggaaatgctcactataaatgtattgacaaatgattatgtataattagctcttcatcacaatatttttcatcatcaagaaatagatttaaaggagatattttcaaacagtatggatgtatcatccccttacctttatgtatgtgtctggttgtgaatagtcagcacatattatggttaaactcaagaaacaagggaggttattttctaagcctgcatcatagcagtagaaatttggaaaaaaacaaaaaacaaaaaaaaaaaaacatagaattaattgagttgtaatcaaagaaaattatgtgactataaattgtaatatttctaaaatatacccacatatgccaatctattgtaagaaaatgttcgcagagggaaaacaatggaaattcctagaagctttagatagattctaatgattggaaataagtattacaaatggtccacattttaatgtgacttctagaattttttagaagtcatagtatcctttcacgctcttatgctgcttgcttacaacatacacttgggtcacgtttttctgttaggaaatatcatactaatgatttgtgatcatatttaccacttggggatcttggtggccatgataaggaatttggactttattctgattacatgggaagccactagagaattttagccagtgaggtagcatgatcttacttatgccttaaaaaggttaattgttttggtagttaattgaaggaaggcaaaagtggaagtaggaagtctagttaggaaactatttgattgttcgggaaaaaggtgctggatgcatgggctataataatagcaaaggagatggagagaagtgaatggattgagatggaactgaaagaacttgttgatggttaaatgagttggaaggagttagagaaagcaaagtgacaaagatgactcagaagtgtttggcttaagtacctgagtggatggtgaaacaattttcagacatagagaagaatttaggaagaacagtttttttcagacattgctcgagagttctgtgttaggattgagatacctattagataccaactgaagatactgaagaggctgagtagagtctgaagttcaatggagaggctcagactaagatagaaatttggaaccatcaatgtgtagatgatatttaaagccatgagactcgatgagattccctttgcaggggaaaaaaaaaaaaaagctagaatattggagggaagagttttgtaacaggacaatatttatgggtcgggcagaggaaaagaagccagtaaaggagaccaagaaagaacagtcggtgagctagaagggacaccaagtggctcaggcatcctcaaagctaagcaaagagcatatttttaaaagacagtaatgtactgggtcaaatgcctctgagaagttaagtaatataagaaataagaagggactattgaatttgatatgaacaggtttagtggaatggaaggattagaagtaaaaccaaagtagattcagaagaggagaaattaggaagtagagacagccattcagacaaggacttaaaagatccaggaatggaaaggaaattcctgggagcgcaacccctaagaagccaaaaatagagtatgctttccatgtaggtttttaattcttttttggtggtgttctttagaaagagaaatgtctgttgggattattgtttgaaatggtgttgggggcccaaccatttctggcttctatagatcccctttttgtacatgctcattcccttaaaaaaaaaaaagaagaagaagactagattttctaatttagggcaaggggctaatagcaaaccaaactcatttgtaatctaaatggtcacatattattttggttgctcttcagtggcactagctgctgctaggaagttcattttacacacacacacacacacacacacacacacacacacacacagcatttgctgcagatcctaaacttgaagccctggatcttccttacatcatttacccagaagtatctttgtcaaccttcttaacttacatccaccagaaagtagaacaaggcagaagttgtgtgggagttctgttcctccccatttcccccctcacctgctggcgtcagcacaataaatactgtgttcagaacttggctaactgcttcttttcccacattcgatcagggaatacttaaagccatacagtgtccttgttctgccaaaaagcatatggggcaggttgccccttcaggctgacacaaagacacactgtgcaagacatctatggccagtggagtggccgtgtatgggttatcaatgagacttttgacttttttctttatgtcatattgtcatcacattaaatagaattcaaacaaggaaacaaaatttatattctagacttttaaggcattgcctgccctatagctatgaaacttttctttttcatacctggtataattttccactttaaacaatgttgtgtgatttgattaccgttttgactctcatttaattgtccattttaaaaattttaactgaagttagatttagatttaaagttcaatacccataaaggatacttctcaatagagccgagaacttcagaaggcacaacaaaaaaagggcaaagttcaaaaaactaagcatcaggtagctactttttactgcccagggacatgtctaggtaaactgtcaccatatccatctacatttgcttgctagtagagcttccattttctactgcaaaatagtttctggaaccacttccatgttggccaaaagagagtgtcaacaattcctttccaaaattgacctttagaaagtgaatctaaaatgtttgattcaagtatgtgaggggagctgcatcaaagttttcatttttactacatacaaaagtgacagataaatccgtaaaatgtatgcatttttctgctaagactgctaattaatttaaaaagagattgttagaataaaaggtcagagagtaaacatattacagatatttattgagagcctgctgtgtgcagagttggaaaaaataaaatgaggttgctcctttcaacagacttacaatctaattgagggagcgacagcataaatgtatgcaaagcaaataatgcaagatacagcataagacataattaactatcagatgagtgacatatataataaataccattaattcacaggcaatcgtaatcagaagcacttaacttactatgtgccaggcattctgctcagtacttcacatacattatttcatttttttgaaatattatttctactttatagatgggaattggctctgatcttccccctattctggagaaagcaaggataatggtgtaaggtagacaaagacccaagcagacatgttggtctggggcaaaggtccatttaagggaatggagagaaatgaaccctggggccagcattagtctgtttacaaccatatcccagtgcctagtatagtgccttgcacataataagtgctcaataatatgtcttgaaaaaacaaatggccctctggtctgtgcctgtaatccagatcaagtaccatggaataaagttaattagtgaattaaagccacataccacatagcttaaggacccatccccaagacctcccaattcccaactatgacaataaaggattgcagtggaaaagatacatcataaggggaatagcaatagcaattccagctcactggggtctatttcatggaatctgacatggtgaacagttcataagtttatttccaggctgcaagaccctgcaacatctggcctcttgcacctccacaacctcaaatccttctattcttctctcactctctctactcctgccacacatacctcccttctactcctcaaacccatttcagggcctatattcttgcttcatattgcctggaatgttcttccacaaaacatctgtgtggctcattaccataccttcagatctataacagccactctccccacatcttcccagctgcctgacattataatacacatctatttccttatgtgttcatccccgtacacactagaacatgggcccaggaaggcagaattccatctgctgtttttgccattgaatgcccagcaactaggacagtgcctggcacattgtaagtactcacacacagcaactctaactcaggattactttttctagctctgaaatacctacttccaagagaacgaaatttattcaagaaatgttggatggaaattgaagagtgagcttggaaacgagacacagagtggcaggagcccagaccaacctgtttatgaaagatgcctttgcccatagagggaaaaatacaccttaaaacctctgccaaagtatatgctttcttaggacacctctgacatgctgaattgcacctggtctgaacaagatctatgaatttgccaaaacaactaattcctgtgatttaagagtcactactaccagtatcagcctagtaaacaagtaccaagcaacgagcaccacatatgtcagtatccaaagacaaacatgctgctgcatgcaaaaccagacaaatgcattcacgcgggtgacagtgagtggaagaaattaatcttatttttattattttttcccttatcaaacactagcaagggactagatgtcataaatctagttaaaatatgttgactttgcctcaaatttgagcattcatggttccaaaaggacacttgttataggatctgatgatgtactttagaatcttcttttgtgcaaattgagacttcagagaactcaaaatatatggtaaattcaaagtaatattataagtaaaatcataatgcctcacaacattttttgaaagttaaatatttagtaattttacaaatatgtattgagcactccctatatttaaggaactatgctaatgctgtgatggatcaaaaggagaataagccatgatccttaccttcagacttcaagcttattattcattgggcagttagataactaacatatcagacatggaataataagtgccattgtccagatattaaaaacaaaattggtgttgtggaagcaaaaagaatgtagagatggatcccaactaggagaaagaaaaattgcttcctaaagaagacacagattgaccatgaaaggtggatggttctacacaggactagaaggtaggaattcttcatttgttggacttgctaattttttttggtgtaaatatacccactgttgttgatttaaagttgataacgtgatgcaactgaacacagaactgggaagagaaggtggctccagcacgctacctatgagtcaccagctgagctccagacttaattaaatcaacctcctcactactattttgaatgagtgaattcacaagtcttaaaaagatctatgataacattataagggaagagatagtcacttctgtcattctcccttacatctccatctcaccttccaatattctgtttgaatatccttccaatttcagtcatatgttcctggctggcctacctaggattaatattggcccagtgccaaaatgtgattctatttattccttttagcattgctgtgattaatctgcgctcctgttatcccatggcatagcaaactctcttactgattatggcctggtattgacacctctgctgttctccataacgaaaagcagcttttggggtggctagctgggcaggatgttttgctgctcttgtaacagtaggaaggaaaagctggaggaattactgggaagctttgcagaaggaagatacaggccagctgagagccagcattcatattgcctgttcctttcagtattctttgtgaaaacaccaccaccaatgtgttccctggacgtcactactgcacctttaactggccttattatgctagggactgcatttgaaaagccaaactctagtatctgtctgtaattgcaagcggatatctcagcacatgcacaagcttatgtcaggaggatgtttatgaaaaactcaccaagcagaacactgctagacaggaaataaatatgtgaagcttgaagttgttaggaaacttccacatttgtccctctaagccagagataggacctgtgagaaaagaaggtctttatcattgcgcattgattcttgctgaacccctgctattctcaaaatacatttacagcaaaatgtggctactgcagatgtatttaaacatgtgcttttttaaatgacactggtttatcttccaagtttgttatctactattttactgtaaagcattaaaaagtgtttgaaaccaccagcaccatttcacagttcctgttttatttgtttaaattctctagctcatgtaatatgctgtatgatttactgttcaagtagagaagaaatacactccctcatggagatgtggggaggtaatactgtctcttggaagggctcagagatttcctgtttagattacacaggcttctttagagctgccaagagtcataacatgtacgagataatacactttggttcaggaaaaactatggataggaatgtaattaattcactgagccacaaaagatattccagcttagaaatgtcactgcactcaggcctggtggactcagtatgccaaggggtagccatgaccaaaaagaggattgctgcctgaggacccactgagtagtatccaaccacagagcaaaaggagggggcctggctgctaaggacatcacacgtctcacctgcttctttgagaattgatccctgaagggtatttctgcccaaagcctcagcaacctggcttcatcaatataactttgtgatgcttgtgacattgagatcaatcaatcagcatgtactttatcaagtgcctcctcatgagtaccaattgtggcacatagtggggaaaccctagaggcagagccctgcagaggatatggtgattctgaccagagcaagaaggtatagtgaaaagtttcctaaatatattttgtgtcttgtcataagaatcacctggcagggaggggtatggaagggcaaggtaagcatacacattcccaggacctttccaaaatgtagagtgaccagggacttagagattcagactctatcaatctggggcagggccctagacttggtatatttaataactgctgtgtgaggccctttacatgcatgacctcctgtaattgtatagcttggttgctgtatatggtactatgtttacttgtgtttgcactgtctattcaggggtgtttctaaatgccattgctacacaactggtgaattatgattcttgccagaacattgattctcctactcttgcttccttaatgacacactagagaactgggattggctgcatttagtctcaggatgaatcattgccataagtagatttccatcccctactccaccaactcatttgccaaacacccttaaagaacagaacccactgcctacatgcagcctgcaccaggagggcctaaatggtctagctgggtttatgacaacatcccgtcttcacatcagcaaaaccctaagtgcacaaagtctaatgtaaacacaatgtcaagttctccataggaaaagacatgtccctgctgtcaaggtagtgactagcaataataataatgacaaaaacaataacaatgataagcatatataacacttacttatcactaattatattgtaaatgaaatgatttgcatgtactaactgatttaaatcttatatatatatagatacttttactctctcaattttaaacacagagaaaccaagacctagatacgtgtttctgttgagaagttgagtacaaggttgagtgtaagtagggaaagttcaactgcagtcagttctagtcttggtaagtacactgtgaggcgctccaccccaagcatagcaaattaatggttccccagtgtttgcagaatcaaaattaagttctttggctaggttctccctgatgtgcccctgcttcttccctaattcaacacatccccagctccatccatgcattcccaacacatcacagctctttacatgcccaggctgtgtcttctgcacctttgtaccttctgcacctttgtttccttggccccaactgccctttcttttcctccacattaccctttatcccaaatttagcacctgtctcaaggagtcaccttcccaaggaagtttctccaaatttgttaacagatattccattgttcctccaatgcttgaccactcttcctttatagatccctgcctagaaaaatgtgggctcactgaggccaggggctgcagctagtttattttataacccagcatttaaaagtgcctatttattgatttgttgggaatagttaataaatggagtccttgcagatcataaccaagaccacagttcgtaatggtttcattaactttgttactattggatgtgattctctgcttatggtcttcctttacttgtttttcccttactgctcagcacctctagacattaggtacatggctctgatgctaattaaaattgatgactgagaatgacacttccatttgctaagccagcgcagttttgttcattgtgctttactttttaaccagcacccttagcataaatctgtagtctttccatgagggtaccatttgttccttttatgtctcgattcattacatattttcaggactgttagctgactaagactttttgctttgtgaaaatgtcaccaaatgcacgataaaggcaaagtcacaagatgtctgtttgcaaaaagaattaaatgctggtttgtgaagattcaaggctggccagggctccccaagcatttccaggccagagctttggctctgcactctccttaggatctcataactgacccccacattccatttctgccatcgtggaaaaatttgtcaactttactgctgatgttaggcctggaaattgtcatccattagttttctcagattcaagctgaaaattgagacaaacttcctacgtaattttgaccaaaataacacatatgtttatgtgctatcccatgattaacatatttttaaaaccactttattgaggtatggttggcatacaaaaatctgtgcatatttaatgtatacagcttcatgaatttggagataagtatacatccatgaaattattactgcatgtatgccataaacctatcacctacaaaaatttcctttcactttgttattattttgattaacttaatttttttcttcctttgaactatcaaaactttctcaagtaatacatagttgtcagttatacaaacttactgaaccttgaccaaaggtcctcttttagtgctcatcttagagaaagaattaatgaaacaaagtgttctctgatttgtagcaaagatctgtgatggtggtgggaatggttctagaaaataatggtaataataaaaacttagagtatcaaagcagcaagtagatttgaaggaattgttacaatgcaattttgctttcccgccactttaaaatcaaggtgtagtactttatttactttaggaaaatgtttgctttttgtcataattccttattgcatatgagagtaaatgatctatagatgaagataataataaaatttagagagagaataaaaaagaaacactttcacagctgaaaggctgcttcccagttagctaactgggaggagttactgaaaaagtacattgaaaagcggctcaggggcaggtgaattggactcaccaggctctgacattcagagagatgggaatgagtcagctcactgtccagcacatctttattttatttctctttcttgttttatatcagaaatagatttcttggcattgttactgtgggtttctattaaggactgaaacaaaagtattaataatctgagagtatgtaaaaaaaaaattcattttctcctactatactctcataacacagaatattttggtgaccagagatcaccaaaatgtgtgtggtgtcaacgaaaagagtcaaactctctaaaatatttgaagagattttttctgagccaaatgtgagtgaacatggcctgtgacatagccctcaggaggtcctgagaacatgtgcccaaggtggtcagggtacagcttggttttatatattttagggaggcataagacatcaatcaaatacatttaagaaatacgttgatttggttcagaaaggcaggacaactcaaatggggggcttccaggctataggtaaatttaaacattttctggttgacaattagttgagtttgtctgaagacctgggattaatggaaaggactattcaggttaagatatgtttcttattggacctaaaactgtgcctggctcttagttgattactgcctggatctgggaaggaaggaaggaaaacaaagggggaaggggattctctatagaatgtggatttttcccataagagactttgtagggcaatttcaaggcatggcaaggaaatatactttggggctaatattttttccttgtctcataatgttatgccagagtcatattgaaaagcaagtcacaatatacaaggtcaaataaaacccatcctgatgagaacccatggtttgtagggcatgactccccagaacccttaggtaggaatttgggcaagataaaaaatcggaacttagtcctcggtgggaatctctccccacacaaattctccaacagattcttcagtgggacaccaactgggtgttctcaaattcaattcaattctgacaatctacctatctacctggaaatagcatcagataaccacaggtttacggctcattccaacaatactgtcccccacttcagatgccaactgcaagtaataggttgttacctatacttctagccagtcagctgtaaattggtgttcccacaacctccccctccggtttgataatttgagacagcttgcttacatgtaccagcttattagaaaggatattacaaaggacacagatgaagagatggatagggtaaggtatgtgggttggagttgcagagtttccatgacctctctgagtgcagcatcttcatgtgttcagctatccagaatctctcggattaagacattggccactggtgatcaaattaaccttgagtccctctccccttcctgaggttggagagtggggctgaagtgtctcaacctctaatcaactcttggtctttcctgtgaccatgccccatcctgaggctctccaggagcccccaggcatcagtcaactcattagcatacgaaagacacttatcactacagagattcgaaggattttaggaactgtgtcaagaaacggagacaaggtcaaatatgtatttcacaatatcaccagtagtttcactgggaggtaaaactcagtgtttactgtgggcctgagccatgctgaccctctaagaataacttagaggtaacgtgatcagatgtggggaattctggagaaacacctttcaccaccaagcccagacaagagatgcatacttttctagctgggatgcttacaaagcaacccactctaatacttcaaggtagagtgacactacattcatcatttttcattttttcctgttttttatgccatctactactaatgtcaatcaaattacgactgtgtttatagtggatgaattatggaccatctcacaccataaagttctgtttctctcatgttgagcttttcacctcccttcattccctccctacttccaggatcattcacatgtttatttctaaaaataaactttttttactgaactttttttcatactgtttaaaaagaatttatatttctcttcattcttacagataagattcaagtttaaactcaaataatgtaggaaatctttttttaaaaaattgttccctactgtgtctaggcgtgagaccaaaagtaattaagaccaggttttcatttgctgtgatttgtgtgagttctttttagaggttaggtgcaattttaatttttaaaagggggattattatgagaggagaaatcatactttatcatttgaaaatgatgccataacaggtgttagcagaaaaatcaaactgtaaaatattttaaagagatttattctgagccaatataagtgactgtggccccattgaaatgagcgagttccctgatccctctcacagagcttgcgacagggatgtggctcacctgttcagttgccccactgctcaaacccctagggggagaatacagacggtcaggtgcaaaggctggggcaagtgccttggccccttggccccttagccccgaggtagtgtctaggggtggggtgcctgcaaccccagtgttacaaagttctttcagctttgcagtccacggacagcttgagtgttaatcagctcaatggaccctctgccttatagcaaaggcagagggccagtgtgacagctttctgtatcccaagctcttgcccagtgtcctagaaaaaacagatcatacaggggctcgaaggatgagtgcaaggttttattgagtagtggaggtggctctcagcaagatggatggggagtgggaagtggggatggagtgggaaggtgaacttcctctgaagtcgggcagcccagtggctggactcttctccaacctcccccaggcaagctcctctcagcgtccagatgttcctcttccctctctctctctgccgcatcatttcaccatctgtctgctggtcagctggcttgctggtgtgctggtctgttggtctgctggtctgcttctggaacctcaggttcagagtttatatgagtgcacgatagggggtgttttgggccaaaaggtagctttttggacatgaaaacggaaatgcctgttcccatttagggctgcaggtcttcaggcttgagggtggggcctttgcccaggaactaccctcttctacccagtgtttccctgtctcctgtccatatcaccagtattcacagtctcaaggagtcttgagaaagtgtgcccaaggccgtcagattcagtttggttctgtatgtttcagggaggcaggaattacaggcaaagacataaatcagtacatggaaggtatacattggttcactctgaaaaggcaggatgtcttgaagtggggacttgcaggtcatagtttggttcagagattctttaatctgcagttggttaaaggaacaaaactgtacagaagcttcgagttagcaaaaagaaatatttaaattaagataaggatgctatgtcagagtcagccacaaaatgacctgtttagcaagattaatggcctataggtgtgacttaacccttgccttgcatggcctaaggtcttgtttataatttagtatcttattgcccaaagagtctatttagtcagtcttatgatctctactttaacattaatgctggtcacttgtgcctaaactccaaaggggaggtatatccaacctgccttcccattgtggccaggaacctttctctggagtccccttggccaagaaggggtccattcggttggtttgggaagctgaggattttgtttttagtttacacagggtcatatcagattgttttgatggggatgactaatggttttcttctctttctgtttcagccacagcagctatccttagcagagcaccctggagtctgcaaagtgttaatccaggcctaaagacaagtaagaatttcagtcctttttcttccttcaatgatattttccatgttttagtgtaattaagctactatcctttctctattttatttgggatggtagtaactggaatagtgactgagttgaaattttataggcaagcaaaacattttttaaggatttattttttaacttctgatatagtttggatgtttgtcccttccaaatctcatgtaatccccaatgttggaagtggagactgggaggagatgtttgggtcatgtgggcagattcctcatgaatggtttagcaccctcctctttgtgctgtcctcaccatgagtgagttctcatgagatctggttgtttaaaagtgtgtggcacctcccccttcaatctcttgctcccactctcgccctgtgagacacctgctccgcttcaccatgattataggcttcctgaggctttcaccagaagcagatgctaatacagcctgcagaactgtgagccatttaaatcatttttctttataaattacccagcctcaggtacttttttatagcaatgaaaacaaactaatacaacttctgtgcaaggctgcttttttttctattttttgcttgtgcttggaggttaagtaaggccaaattaatgaaggaggaaaaaagaggaaatgatacatcatggatcaacaattatttattgaatttaggaaactgcctctttttataaattctttttaaaattattttcattattatcttgaagtatttatctaaggtttacactggtagaaagttaaacttgtctctccaaccaaattgccttaagcttcaaaattatgccttattgtaagctctttcttaaccttaaaatgactttacacattccccgctggtcctttgacaatctcctcttcaaccacaagacagaaccccaccatcaactctgtggggaagcgtctccaaattctctagtcctgaacaacattctgccttctctgcttccatggaactttgtcctttacaacatgatagcgtttgcctcctgacattttagtgtgtgtgttagccctgcatatagaactcaccagattgtgtggactgcatgaatgaattaattctattgaactttaaggcaaagcctaaactttatgcttcttctaaatcccttacatctcctaaaaaaattctgatccatagtagtaggtacttgtttaattaaattttagggatggatatttttcatcagtggaagtatatgctagagtccatattatgcaataagggaagggaagacagtgtacctaaatcagttaagatattgctattcttgttgttattctagagtcacgaaatcataatttgaattttatgactaaattgcagaattaatttccaatgtgagattttaacattatttccttggaggtgaccaaaaaggagagctggtactgtttttaacaactgtcattcaattgtcagttgtgccagaccacaaatcctttatagccctcctgtttaagaagcatctgacatgttaagctgctccctaattaacacagaggttgtaaaagaagtggctgtttggttctgtttgggtttcccagccagtatattccaaagccttttttcactcaacagatgagttatgtgctttatattctgtaaggaaatgagaagtaatcagttgaaaatgtgttactaatggtacatgcttcacattgaaaccatcctcctgacacaaacataatactttgccctccactgtcccccaaagtggcagtaggatttctctaagtaattttctttacttatatgagtgcaggatagggggtgttttgggccaaaaggtagctttttggacatgaaaacggaaatgcctgttcccatttagggctgcaggtcttcaggcttgagggtggggcctttgcccaggaactaccctcttctacccagtgtttccctgtctcctgtccatatcaccagtattcacagtctcaaggagtcttgagaaagtgtgcccaaggccgtcagattcagtttggttctgtatgtcacagggtctaagaagcgtaaacattgtgtcttgttgaaatacagcctctaggtatggaggatgtgttgaacaacttcctaccagtcatttggcatatgttgatttcctgtcttcatgatacgtaagacgactagctaattatcattcatatgtggtaagtcacatagatactgacttcccctatctttccagctttttcttatcaaaagtcacctgctctctgtcccaggaacgactggctaaagtaacctatatcagtgtctgtaacagtgggcacctatcatagtgcacatgcttgaacatatcattgccttttatcatcacgagcctcacatccagatgtgacagactcaagtgctcacatcacctcactctgtcactgtatacattgttaccgtgtcacaaatatttaacagtctgctgtgtactcagtctttagctgtgtgccctgagggagacagagtaagatactgccttgacatcaaggagctcacattctccctaaagagataatttcacatgaaaagttagtgtttaatatgaaaagttagtgtttaacatgaaatgtcctgagaatatacaattataatttacacgtttcctgtgtgtacttttctaagttctcagactcaaaacaaagccccatggaagaaaaaatgaaataaaaaccctgtcaggacaaatcctagccagaactgaccaaacataaaaaataaatgccactgccctctccaagctacctttactttatacttgggtccaagaagcccaaacattgtgcctcattgaaatataacctctaggtatggaggatgtgttgaacaacttcctaccagtcagtgcagtgcagtgaccatttagcagcatctccctcctctctccttccaccccctgccccatctctccttccttgcatctatcttcccctgccaacaataattttcttatgttctaagtaaatatctttagtgctctccctactacctaaacattaaacttcaaacctttcccaagaccctgaacacccaccccagcttgtaagttcaggctacttaccattccccaggcacactgtattttccctcctctggtacactgctcatgtcatcgaatctatcttcctcccaccccatcctggattctgtaaatataaatcagtcctgcccacctttaagtttcagtcaaaacctgatactcatggcctgaagcaatccctcccttctccatgctggtctgagagaggtcatgatatttcagtagctctggagagacacatatggtcaaaccagaccagctaaaattaacccatgctatgcacaacctaaagaatcacctcttgctgtaacctctttcttctcttgctcaccaaaaactgtctgtcacatttgctaagtaagcccttagggctttgctgtgctggcaaaaggtcttaatccatgtgaatgtgcatttttgtgttagtgagcacatgctaacatgccttccacagattagtttcttaagaaacattttctgggggaaaaaagacctgtttttggttagtaaccccaaaaggacctttcagttcacatacgtggtagcagcatactccacttatgcaaaggtcagcccagggtaaatatgggcaaaaacacagacttaggataagaagaatgttaagggagtttacagtttaaagagatatccaaacaacttttttatattttaaagaagtaatgctataattttactacaaagaaaacttctttatatttctggggagaagaataggaagagttacaatctcctagagaaaagcaaaacatttttagtattcccaaataagacaggcacctcaactagggtgctgtggttgcacgttctttgtagtttttcaagaattttatttctctgtcatgattatttattggcagaagatttgttgggccaaacatgtaagactttcttaaacacatatagagaaaaaaattagatgattgcacatctttctgagggagatttttcccctatttttaaaagtcattgcttttcactgaatttgtcttgtattcctataaaagtgtaaattttgtgattgatagcatttttacctcaaaatgaaatgaatatccaactggagcaagttttattgactgcttattggagcataaattagtctaagttttcatgaaaataggcatttgaacatgagtattaatggctgagatcagaggcaagttttgaaaggattccaaaatattatcatattagataggcaagcaaatgaattgcttgaatgctagaagttcacaaacattcaaacaattgtgagttacattaacttcaataaaaacttttgcaggacaaaaatttaatatagtaaacttcatcttgcttgtccaggtccgtatacattcttagctggactcttgtcctagcttcctaatttttcttcctatctcctatttttccctattccaagccaccatactctgttcttgattaattcttcctgcctacctctgattcagtgattcatctgcccaatcatctatagtagctccaaactcttttctaaattatgaataaacttatctccctggcattcagaaaattcaacagcattcatcttacacacttttctagccttatctcccttttctcttatgtactcctatgtttatattccctgcagtcttgcttcattatatccatttacaatgacccttttaccagtaatttcctcttctttcctctcagtctgaaacaatccttcatagattttgtcctgtgagccatatttcaaatacaactttatccacaaagctttgcccagttcccacaagaggattctgcttttgctttagaattgtagcctttttttcctctctcgcaaggagagagagcgtagcaccgcagtttaagtactcagcctctggagtaagctttagtttaagacccagttctactgcttacttcctgtatgatcttctctaaattttatgatctctttgtcttttttttttcatctctaaaataaagatgctaatagtacctacctcataagatggttgtgagaattataagtgttgatatatttaaagtagttagaatagtatctggccctacagtaagcttacgtggtatttattgtattctcttatggctcttattttattccaatgtgtattaaattgaaccgtatgaaattgcccatgtcaactctatattggaccctaaaatcattatgtcttttggttcaaccaaatgtagtgctttttgcacccccccttaataaattgaactatctctaaagatagggacaatatcttacacatcattatatcctacagtacctgctacatacttgacatatgctgagtatttcacggatggttattgaattttgcacacacacacacacacacacactgcaaaaaataaacagaagccaagccctccccagtatcttaagtactctttggctaccagggagtttactccatgctgttcagcagtcatttatgaaaggagagtgataaagatatagaggaggagaattttatcttgtctattgctgagtataaatactatgcctttccgaaaagccttccacagaacctttccttcaggtcagggacctagtgtcatgggtcggtcttggataacgttgcaggacatatcagttcaactgccaagggaatcataaatagtcctactcctgcctgcggcccaccactgcctctctgctttcattcttttttatcagatattttcaacatcaagaacttattagctgataatttaactaaattaagtataacataagggaaatgtgtcctggcagagatggcatcttagagtgaatgcacagtctttattggttaccaaaaacaaaaaaaaaaaaacttgagctttggacaagcagtagagagcagatttgatactgggttctgacatggaagctgacattaaattattgacagtctacttgtttataaactattcaataaacaatttagtaagtaaacatagattcttgcaatcccttttaaggaaacagtgtttatgttggctctctcttgtacccaacctagtgctcagcctttcctgactcacataagcactaatctccagataacaccaagcaccctagggttattatttatcccccttccttgttctctgaaataagagaaaggcaggttaaattatgcactttatgtaagaagaaatggaggtacagagaaaacagcttaagtctcttaacagcccaagagagtgaagaagatattgccaatgcaatgagttgtatctgtccctaggtaagtaaaatattaattaaagcatacaactatattaataattaaaacaacagtctttacttatatggactttgcagtgacttttttccagcctgaaatactcagataatgactgccattagtttcacacgttagtgctttattatatactgctttgttttcacacaaaatcgttgagaggtaagaattttttgaaagaaatatttggtcttaacttttttatcccccttcaacttcaagcaattttctgagcaatgataagtggtaagtagatatttaccacttagtttacaagagacctgtttctctctgtgcattgacttaggcactattaatgaaacctttggaatgcaggtcccttctggttgtaaacatatactgaggtcttctatttcttttggaactcaaacaataagaaaatagttagaaatctgtttgtgggcataggtctctaaaagccttaatcttagaagtgagtaaaaaaaattttaggccagacgcggtggctcatgcctgtaatcccagcactttgggaggccgaggtgggcggatcacgaggtcaggagatggagaccatcatggctaacacagtgaaatcccgtctctactaaaaatacaaaaaattagccgggcgtggtggcgggcgcctgtagtcccagctacttgggaggctgaggcaggagaatggcgtgaacccgggaggcggagcttgcagtgagccgagatctcaccactggactccagcctgggcgacagagcgagaccccgtttcaaaaaaaaaaaaaaaaaaaaaaaattagagcctaagaaggatgattaagcatcttacttaaattttcagtatgcctatgtacactctatatactgacttctagcatggtttctttgccaaagcataacacacattttttaaagggataattcaagacaaacattctttcaccctgggtgaccccaatgggtggtgaacactttttagtaactcttgaaagttaaagcatccaacagttggttgtgacctttttggttgtgacctttgagttcttctagcttgtagcccactgatttgctgcttaattccacagcttcaaaaccaactctaatcactgctcccgagagagccctagcttctgcacacatgagtctctcaccaggaaaggatacctgaagtccagaaaagccctttgttcacactggctcctcctagtggggaacagtttttttaaataatgtacatttatgcactgggaaaatatcttgaatttattatttaggtgtaaccagactttaatacaacttaacctacacactgagaaagcagacatttacaaaaagatttatggctttgacaaagcgttcaaatgtagttaccattaaatagtagttcaagtaattgtgtgtctcatggcaaatacatgcaatataaggtaatatatatttaagccaaaaataacaagaggtgatcatttgctaaacaaagaacttattacttaggaaaaaatgttacacaactttcaaaggacttttgaaaatatagtatgatttataggaaatttatttgcatataattcacaatatctggtacaaggtaagctacctctgtgttttttttctttaggtcaacaaatatttaaaccaagggttggcaaacaggccctcagaccagatgcttgtttttgtaaataaagttttattggaccacacccatgcctgtttgtttcagattgtgtttactttagggctacagtggcagagtggagtagctaagacacagagcataggtccacaaacctaaaatatttactctctggccctctaaaaaaaagtatgccaaaccattctaaacagcaaagcaattaattcttttttttcaactcttattttagatttagggggtacacgtgcaggtttgttacatgggtcaattgcatgtctctgaggtttggtgtacaaataatccccttacccaggtattgagcatattacttgatgtttttcaactcacaccccgctcccaatcttcaccactctagtagtcccctgtgtctactgttgccatctttatacccatgtttatccagtgtttagctcctgcttataagtaagaacatatggtatttcgttttctgttcctgcgttaattcacttatgatgatgacttccacatacatccatgttgctgcaaaggacatgattttgttcttttttatggctgcatagcttttcatggtatacgtgtaccacattttctttatccagtccaccatcaatgcgcatctaggttgattttatgtttttgctgttatgaatagtcctgtgatgaatatatgagtgcgtgtgtcctttttgtagaatgatttatttttctttgggtatctacccagttatgggattgctaggttgaatggtagttctgttttaatttccttgagaaatctccacactgttttccacagtggctgaactaatttacattcccaccagcagctataatatggttgtttgtttgtttgtttgtttgagacggagtctcgctttgtcgcctgggctggagtgcagtggtgcgatttcggctcactgcactctccgcctcccaggttcaagcaatttgcctgcctcagcctcctgagtagctgggattacagtcgtgcaccaccacgcccggcaaattttttttatttttagtagagacgggatttcaccgtgttggtcaggctggtctcgaactcctgacctcgtgatctgcccccctcagcatcccaaatactatactgccccctcagtataatatagtattttaaggaactaatcatcaagtttgtactggttaccctcttttagtctcctgttatcttcaatttcataattggcattaatgacaatacagtgttcactttataaatttgcttcatagtaaactcttctgaaataaattacagtcatgcatcacttaacagtggggataggttctaagaaatgcataattaggtaatttcatcattgtgtaaacatgaagtgtactcacacaaacctggatggtacagtctgctgcacaccagcctttatgatatagtctattgttcctaggctacaaatctatacagcatgttactgtactgaatattctcagcaattgtaacacaatggtaagtatttatgtatctaaacatagaaaatgtacagtaaacatatagtattgtaatcgtatgggacgactatcatatatgcagtctgtcgttgaccaaaacatcattatacagcacaagactatagttgaaaattttaaattacatatgtgggttgcactgtatttctgtttgcagcattgatatatacatttaatggtttgtatgtttgtgcttgcattcataaatattaaactgttacagggagcatattttcttgtgtaaaaaaataaataatttttatttctaatgacatataaaattattatggttatgtttaaagaggcttgaagaggtattatggttatgtttgaagaggcaacggaaacgtcacctttgtcattgaccaaaacatcattgtgtggctcacgactgtaatagtgtaaagtaaggattcaatgtatcggctaatcaatgtggacatatcattcagtattattaaagatactccatccaatgaagactgaacacctgtaaatgcttggtgatggatggaaagggcaattatttgcagctggactgtctgagacgtgtcatcattattgcataatatttatttaatgaaggatcaatgcaccatacagctccagtttgagaacacacttgacattgtagtttgtagatcttttataaactaactgctatcactgaatttttgctgaagaataaagacaaaagattctctctttaggaaattgtgcactttaaagactcataaacctgaaacctcacagaatcataatagatgtattttcagagacaatttctgagtccttgacatattctcaaatgtcattcatgtcttcactgccgcaggttatctttttatttttatctgtcatggaaaagcagccttttttctttttttatctcctactatgccttaataaatagaatttaaaaccccgaatttgaattattgtgaaagccaatatttgtagcaaatccatctatgctctgtgttgtcagcacatatggttttgtgtacctgctaccatgaaactctgccagggttatcctcagagaaatggagagacacctgatgccatccttactctgacagaagtttttctttctgtgaattccaaaaacttttgaagttatgcatctcttgcattgaacttcagtggcttgtgtacacatggtatcttcctttctagattgtaagttctttgagggcagggactgaacctttctcatctttatatgctctgctcctccacccttggtttagccagggccttacaaaaagtagaagcttaaataatgtttattaggtgaatatcatactaagttccagaaattacctgagagcaattgaagaagggaagtgtggagggagaggtgttagcatagatttcatagtgtttgagtttggcagtttggcatccttttcctcaacactaatactgacacagataagtaacctaactgccttctcaaatctgagagcagtagatgcattttctcttttgggacttttctatctcatgtgggaaaagcaaacaagaaggtcctgcaaaagtcttgtgggtatttattcttatcagtggttgtggcaaactctcttactggtttcaattggtcccacaggctatgtgatgaggactttggggtttggggagctgggaaccatgagttgtctcttaagtatgacctaacatactgctaataccccacaagcttcaatttatccatctcgaaatggagatactaacatctatctcaaagggtcattgtgaggagcgagtaggaacatagaaaagttcctagcacaaagtagatatggaagatatggaataaggtgttaggtattttattatttttactgctgctgctgctgttactactactgctattattattactactcctggaagagtaggacttgcctgggacactgaccctacttaccccttcacctcattcaccaaaacttatctcctatataaattcatgtatatttttctggaaggataagaaaaatccttcatctaggtagcgtattttgtatttgaatagtttatgtttcaaatcccagagaaggcctatacagccaaatttggaaaaaaaataaatttaaaaataaatattcagtgtttcatatataataaaatacctaacatcttattccatatcatatatgtgtgtgtgtgtgtgtatcttttaattgccatgtatttctaccaaaaaatacaaaacttaattttgcgtcctgaaagaccctcgtttgagaatccctgcttttatgttctgctttagtccaggcaacagatagcttaggttgtcactttacaactggagcagcaggtagggctgagaggctcgccatactccaaattaccagtgccagtcccatggcaccaagacaggaaaggcaggcactcaaacagaaaggtagtgcaattaattgcttcaaattctttactcagggctgcccttagtcatgatcaaataaaatgtacacattgtttggcacttggtaaaatgttgtttcctttccttcctccttcccctgatagactctccttaggtacaaaaaagatgaggctgtacacagagctaaaagtgtacacctttgaaaaaggtgtctttttcaaagagcaccttcaccccttactggactaaactcaatccaaagctcttttctctaagctttataacacttactgcctggatgagtcatttgtcaataaatacagaatgtttgtataggtggggttcttgtatatatgtacgagcccctagagtctctaacttaaaatttatttttgctttagaagttcaggaataaggaggctttgatgatcaattttaacaaccgcaatatataatacagtaactaatggttaggtgtccaggctagcccagggcagcctgtgtgattcatgctgctggtgaaccatggctggctgggcgaactagatctggaattctgtggtgcctaagggagggaagggaatatttcccacactatctcatcctgccctcactatcgctacccccaatctctctctacattctaccccacctactttgctttttctgtgaaagaccagctggggcaaatattttggattaagtaaaatttgtcttgggtaacttccctaaaatttagtttttaattgaataatcttggttaatccatgagtaaataagcttgtagagtatagtcagcctcactgtgagaagctgacaaaccagaaaaccagaggaatatacaccaattccttcctgtcctgcaaacctctgcttcttgaggtttttaaagagtgggtgcctaattgattagtcattagttattgacaggaccaaagagatatgcctggctcctcttggaaaaaccaaaagactgagagggaaaagtacaccaaaaagatacctaaggaggcagactgctataaagaaaataattaggagaagaaatcatatgttttcagatgaaaagaatctgaggatgaaaaaagcagccttttcaggccgatgatggaaagatagaaactaaattcagaaggatcagaagacgattagaagggcaagaagtcatagaagaccaagatttcccaaattaccaaaagaaatcaagcccagtcttgttcaggctgcagaatgagaacgcccttctagtaagatccgtacaatgaatttcacaaatgttgatttctttctgtcctctttgagcccataatcacctccttctacttgcacaaccttgaccatcaccactacctataactaataaccagttcttatgttcccctcaaggcataacacaaaaatattttctttatgattactttctctacaaaaaagagggagagagagagaaacaagtcaggggacttcgttggtgagtgtagaccacagcaagaacctaaaatcctagtgggttgttagtatagacaggctgaaaccactatcctgaagtggtggttctaggtaggtatgcccatcagaatcatctgtggataagtattttcagtaaatacacatgcaggacctctacctcaaatgtactgaattgaacttcattgctggagcttaggcatttcatatttgtttcctaagctgctataacaaattaccacaaacttggtggcttaataagagaaatgtattctgtcacagttctggaggccagaagtccaaagtcaaggtatgaccaggattggttccttctggaggctctgaggaaattctgttccatgcctctctcctagattttggtgactgccagcaatctttggtgttctttgatttgcagaaacatcattccaatctctggttctgtcttcacttgaccttccctatgtctgcgattggtctcctttctgtctcttttaaggacacctatcactgaatgtagagcctatcctaatgcacaaggagctcaattataccttaattatatctgtaaagaccctttttccaactaaagtcatattcacaggtaccaaggtttaggacttgggcatatctttggaggatacagttcaacccattacacatatgcattgaagggaaaaattcacgccacaactgattatcctataaagaatgttggcttaacttaacgcatttaacgcaccatttctccagcacttaggaaatgctaggagatgcaaagctgaagctaaataggcttctttattgcagaacctctcagaggctctcatctgtttgtgtgcattataaatgtccaagagaaagaaaagaatcacaacatttcctggaaatacttgaccagggaacttcttttcaagggattacctgttaactacctcaatggacactaatgactaaaggaatacatgctgctggtgatcatggcacttccaaactatgctcaatggtgtgggcatgagtctaccacagtgtctaaacactaagattgttaatgtctacacgacctctccctggatatgagcacacatccttcatcaaatatccacagtggtttccctagaggatttgcatatgtgcatggatttttagatgtctagtctctactcttgtcttcagccatttttgtagagagaaattggcaaaatattagcatgaatggaagggaaaggtggccaagataatacattatgcctttttttttttccctgaaaacagcccagaatatctgaaaagggagaagtgacttaatcatttctattcccacaattctggtcctacaaaattgatatcagtatatgattcatccagagaagttcacagtggtatttttttaaaaaaaacttttagaggttaccagggcatctcactattttaaaatttaatacctcaagggaaataagcaactaccttgaatttttgcatgaattgcatttgagaataactgaatagttggtggaataaagttgtttttttaaaagtaggcatattctagttaataaatataaaagaaatggtaggattagaaaaatcactacattacaaactctaatgacataatagatttaagcaagatgatcagtgaatgataaaatatttaggtatgctgtcttctaggtgaatcaagctgacaataccttggacccacgttaatcttaccacatgatattatatgtctcctgatacttaaaataaatatcaaataaatcttgataattgttgaaaattgttgatgaacatatagttcacagcaccacccatgatgtattctttccatgagaattgatctgaatcaaagtaagcctctaggtctaactgccagtgtgtaggaaataccagggatagagaaacatttttaaagtctttaagattgcagtaagctgaaagaaattgtctggtttctgcaataacagcaacaaagttatgtaataagaagagagagggagaatcacggatttatacaaacttaagagacactgtgtgaatctagtttgtatcctgatcaaacaaattaactgtcaaaagatgtcttttgaaacatgatgggaaatttgagcataaactaagtattctacgatattcaggaatcattaccaatttgttagatatgatgttggtatgtttttttaaatgagaaagtttttagcttttagagatacatacctagatagttatgggtgaaagcatatcattaaaaaaaagatagtggaagtacacaaaacaggattgctatatgttgataattgttgaaccttggtgatgaacatataggaattaattaaaccatattttctatttttatgtttattttgcaaattccaaaataaaaatagaataatccctcatgaacagatggtctcaaatttcatcctcaagtaaacacaattcacattctcaggggaacccatgagaatattatgaagtatatgtctatctcatttcattatatatggaatcctaccattccttttgtctttattactagtggccagagttctatcttgaaaggtgggaaatgtccttatatgaacagattagtttagagaattattgtgagaaaaccagaaaatatttgagttctagctaactggatattgaatgagttgtgctgaagtatgtggtcataaagggttgataatgaaatacttgctttccagtggcaaggaaaaataaatgtcttagaatttacaaggtcattcttgaaatcaatcaacgtgggctgaagatctcattgcttctgttatctggcacgatggtatttgtttgtgcacagctctgttgatgtgagctatcaaatatttcttagagctgaaatcatctaatagcaaacattgctatgtcccaatggagattccaagactctttggccatggaacatttacattctatcccctttcatcactcctgaacaaacaaaaacaaaaaaaggaaagataaccaataggctttttatttaattgaaaaccaaagagagagagaggaaagaaccagttagttgccattttctaaatgcaggcttttgtttgtttctgccttctaattctttgctcttgaagctatagctttcaagcttgtgtatacaggcccagagagaacatttgaaatgtggccaccctacccatgtccatgccactcttcctgcctttctctctgcctacttctgctccaccatcccaggtcaggggcttggaggctgacagcattacaagtaatatagtcgttcaagctcatataaacaagatgaaatccaaataataaccaaaatgtattttatttcaaggactggactactcagttccctcagtttcgctgaccgatttctaggagccctaggctcagctcttggttgtctcagaactgaggagagtactcatttgcaccatatgcatctgcttgttagcctgtgctaccaaaattgattcattacttggccttctctgaaaagaaaaatgaaaacaaaaatgcactcttaaaaataattattaaaatacaaccaggaggtatgtgcctagacatggctcaccttctaccaaatcatactttatgattttccacaatattatcttctattcctcctgcccctaaggttccatggagcagagcaagttgaagaatgttaaggttttactaaacttttagaacagaggctttggggaagcaagagagaggtacactgaaaatgaagtgtctgtctctgcttctattaatgtcataggactagaagttgacctcatagctgattacaaatgaaccctgcaaattgaaccccagcacatgcctctcattatccattcttctctttgcaggatggggtccatgctcacatatcaagaaaatggtgggtttcagtctggctcactgggtgaggttttggcatgaaaactaatacgggttagtgtacatcacccataataaaagtaaaagcttttttttttatttacccaggtaaataagcaaaaggcagatctaaaatacattagagttaagttccatggggacagaaatgtctgctttgtttgttgttatacaattgacacctagaatggtggctggaccatagtgactacaaataaaatatttcttaagggaatgaatggttctgcaggatagatgttctctgcatttggataagtgatgatactatagactcagagcctagatagaaaatattgtcccactttcagttctgcaaactgacttgaggtgcttggtgacgtcctgcagcaagcaaaccaaatgaaggcatctctgagaccccatagtcaccaccagcatgctagcctcccattaccttgcccaccctagattttcaaattgggaatcactgtggtaccagactgggaatcgtgacttgcatactttctcatattggggcttgggattttgagatcttatttccttttttggcttcttgagatctgaaattgttgttcagagaaggatattaagacaatgactcttccattaccatgcatttctgttaccaacagaggaggtaagtgaatcacttaaaatgatacaattccatccacttcagtacaccataaacatatccttagctttgactataattatagtatgtgggtgatgccgctgagaaaatggtataattataacattatggttgagaattgtctgagtagaaaacactgagctgtactgtgcaaagtttaaggcggaattgtgggtcccttttcaatatgaataaaattgattagccaattgcaactgagagctttgtgcaatgatattaataatataaaaatcggccgggcgttgtggctcacacctgtaatcccagcactttgggaggccgaggcgggtggatcacgagatcaggaaatcgagaccatcctggctaacacagtgaaaccccttctctaataaaaataaaaaaatatagctgggcgtggtggcaggtgcctgtagtcccagctactctggaggctgaggcaggaaaatggcatgaacccgggaggcagagcttgcagtgagctgagatcctgccactgcactccagcctgggcgacagagcaagactgcgtctccaaaaaaaaaaaaaaaagtcaagggccaaagtaacaatgtaggaaaaatttgatgactttaatttcatttacttctaggagtcttacatgcaagcctaatgcagagtagagaagctcaccaacttgaaggaagcatgaatgaaattacaaggaaatctagcttagaaaaattaaccctgtagcttggtttttccactctttgctcttggcaaaaggatcttacgtatgtataccaaatgtctatttgaaaattttgtttctctgaatatagctttcttttctctttaacacactggtccagtggttctagattttatgctcccataaattaagtaagacagcattctatatcatgactgaggtgttaatgacattatgcagttgtcacattttgaaatataaacttaaatgcgagcttttcactgtgtgtaaagtttctctgtatttttttaaaaaatttttaaagaccagagattttcagcaacaagaaacataaagaagtaaaaagagcgtagaaaccctgccctagaggacctgctccaccacttaaaagccatgtacctcttgaagcctgtttcctttatttccaacacaggaatttttatatttacaccctaaccatcacatgggtcacatgtgataacaatgtgcaagtttcttacaagtgttctaggaatctgtaagtcttagagttctgaggtttattcccaaaggacaggaaattgtgggttacaccaaacagttaaacagggtggcagggaatccctgtcacgtacccaggcctttgggttattttctagggtgaggggacatggccagtagtacaaagagcatgtgaacgcatggatgtgggtgtgtgaggtcatgagtgggtgtgtatgtttatgtacaacacatgtattggaggataaaagggaaaataatttgtcttcctgacttcttctctattcctggcttttcttagattgttattcctctctaaacaaagcttcaaaacagaaacccctccccttctttattatatcggaaatctgggaattcagttatccttgtcttatcctactccctgttctgttctaaatatataataacaataagtaatagtactactactagtactagtagtagtagtagtagtagtggtggtggtagtaatggtagtaatagtaagaggatgaaaagatggaggaggtgaattggaaatagggaggtttcctgtagctgactgacagtttatatagcaaccgcctgcagatttaggttttttctgactgcgcttattttatagcaacctcaacaagctgtgacaacctgcaatatctttagcccttaagatactgtctcttaaacctgaccaatatttcttatttctcaaagagtaatgatagtcttttctgtctgataagttcaaaaggcacaactgattttcctaacattttcctcaaatgaagggagtatttgaaaaatggaactcaaatgaggagccacctcagaagcctaactggagcattcagactgcatcagacagacttggcttcagttctgacactgatacttactagctgtgggatttttggacaagcttctcatctgtaaacaagtataaatactacctactttataagctcgtatgaaaattcccacaaagtttgatgttagtttcctttctttttgtgctcagctctaaaaatatgcagtgtagtgagtcactaatatttcattaacataagggaaaactatatacccaacccaaaagctgagattcttcagaacattttttaaagaggttctaattaggaattttataaatggaatacagagtactttttaaataataataacaatgattaatttaagttactaaacaaaataccttaatgaatttgagaaaaataaactgaagataaatattaattattaaaagagaaaattattaaagtaataacatgcaagtcacttgatacttgcaaagtaacacagaattagacataaagccacatttaagaggcagcaaagccaaaatggctggccccctttaaaaggctcttggcaacagacatatggaaaactgtcatctcttccctgggcctttcttcctactctggataagcagcatccttcacacaaaagaacatccaggataactaagaaagagatgaaatgatttatcggaactagttaaaataattaaatcttaaaagcatgttctcctgggcatagagtggggtgatttctgcaaacattttgaaaataaagtacccctaaaacaaggatttggtttaactgctagaaaacaaggtgacaggttgagaaaactgaaaattttcttaaaatcttgtttacttgaatggtgagccagccacccagggaagaaaccagagctctttcctttaagaaatatagacttcagttggaagaaaaaattagtaggttttaaccttcaaccttctagtgaagtgagaatattgattgagcacctattattagaataaatttatcttaagtgacccagggaagggtcgtgggtgacgggaactgtcaagaaagaaaaaaaatatggctgtggatcttaagtacttaaaatctactgagggctcttgtctccattttccttagaccgtgatgttgctcaaagtcacataagagggcacataaatttactgaatagtattacagaaagcagcagtgacactgaaatgcttgcattatattcactatcccagtcatctgcagttgcctgagggatttgcaagcaaggacaggaaaatgctagtaccaaccagttctagataaagaatttatttgctccaaaaactttcactgtattaaattaaattagattggctggaattaaaaggtaataaggcccattttcttatgtaggtcatcaattaatttaactctaaagataattccaaaagaagaggtttaaaaattgtttgagtagtagtaacatcattggaatttatgtaaaacttcccaatgtactcacttttacagataacatatatatatatatatatatatatgtatgtctatgactgctggcataatgatcaaaatgatcagttttattactttgtaatcacatcaggcggcactgatggttgaaataaaatgtgttagatgagtgaatgcaaagataacatatagcaaatgaaagtctttgtctatgaagcacatgattgttataattgttgctgcccttttgggatcctgaaccagattccccaaataagtaggtaacacagaatttgtcttgagcactttttcaagcattgtaatccatgcattgaagtaggctttatcagcctacagctataaactccaaggtgattttaaagtctgaaggtttataggtcttcattaggataagctgggcttaccatataaatctatgaggactttgctagaaaaatagtggaattgttgaatagggaaaagagataatggtaacgggatttgcctgatgtcttcatcctagaaaaaaagatttctgcttgggcattaaggaccccagtgatgattctgggagactttcaggaatgctgacaaggctggagctactcaggatttgatgccaaagaagccacactgcacatgtgttcctctaaggtgtacttggttctcatctgagaggcaaaggctctacttctttttaattgtttggtcctaagttaccttcaaactccacctaaccacatctctaatcctgtgtatagcctttccaacatcttgtaaattccaaggggttgggggaacctttaggttccaaggctgagctaagttataaatgaataccctgtgcagtgttgagaatgaaacagaagctttggtgcgtggtagcccactgtgagtggggtttcaaaggagcagtccaggggccctacatgaataggcatatatgggccaagagacaggcttctctcagccataccatagtatactggaacaatgagaaatgggagaggacatacttcttaaagtgacacactgacctgttttcattctctcctctctctgcttctccatttccacttattgcccctattgcatctgtccagtaactgtttctttaacagttttccaaactgacattattaatccagaagatggatggtggttttttaattaaaagagaaagctgattttatttggtgagacttctgctatcatcttcagtgttatatcccaatatgagtactttttttaatgttctactaaatccaatagtatattcacctcactctcgagttaaactcttggctttaaaaaaattagccagaaaaacttcttaagaaaaaatacagtattttaaattctataaatgaactatatcttaaaatatttgggggcataattcaattgtatccattttactttaagatcatgcaaaaagggaaaggtatagatgctattttattgatatgctgctccatggatttcaaattcaacatcataagccaagatttgtgggaccagaggaatgttcaaaagtataatctgatacattatctgctgcaggaattaagtaaaatattgcatacatctcacttcctataccaaatagagagaatgaaagtactagattttgtattacagatagtttagacaactatagggaattctgaactttcaaacttttatatcctaaactcaagatttgggccttgaaaaataaaactgataaaactgctacagtgtagatttttaaaattacattcatgtggtgaagttgacactttctgttggtatggctagaagtcagatagatgcttaatttgaaagaccatgtttttatttcttctctttttcttaccctatgatttcattgacctgaagtggcttttagtgccattcaattcacacagaagccaaaattggttactgtgttaagaagaaaccaagatgttttatttagtttatgaaacactagcaaaattactatttgatgcaaaactgtgaggaagttttgtagtcattgaaaggagcaagaatatagactgcttgcagttccagtgtcgagacattcattatcagatttaccacttgaaaatattatcaagatagtatttatattgtgtttaccaggtaaactaagcactttagttctgagcactttacatattttaaatcattaatagtgctgtaacaagcctctgaggtaggtactgttatccctctttaacagataaagagactgaggcacaaggaagagaagtgacttgctgaaatcacacacagctgaatgtggaccctgattcaaatccacacatcctgactcaagcatccttgctctgtactactgtgctacagtgcctctttacatcctcctgatgtagaaatcttcttctagaataatgagaagcagtgtgaactttgaagtaggacttcctgggcatggtgctttccatctctgggccaaagttttctcatctttacaaaaggattacgatcaacccccatctcatactgtggttaggagaattgagcaagaccatatactaaaagatgtcagaacagggcctgacagatcatagtgcccaataaacattggctcttgttatcatcataaatatgttaaaatgagctttagtatgtggataatagtagcagaatttcctgaatgagacatgttaaacatttattaagcaggcactttttggagtttatcttataataattcagtaaggttactcttgtcatccctatttcactgaatttgaggaatctcaggctgcaagataacgtattagttttctagaatcaaataagcaaggattcaaactcaggatatattgaccccaaaacctcagatctttctgccatccctatcttgttctaaaccccaggtttgctcatccgggccctagtcattgatcaaaaagcaccaatacaaatcagagtagagaaagtcatattgagcttgtgaggttgtattatgggcatggtaacaaatgtaattcagctgtattggcacagtgcataacaaccacacttaatttctgtcctaagacctgtctgagcccataaataaagttacattaataattacggaatggtaagggaccactcagaaaatcttggttgatataggaagtggcatctgtggcttctaattgagagatattgcttcttgaatcagtgctagaccattgctctagggggatattaagccttctctgtccatggaagatgtgaaattcaacagctgacctgactgcttgtcgctgttgatgatcctataaaatttcctctaagatacgaactctgtgttctagtccaaatcaagtgaatatttcctgttggttgacctacaacttcaagggtatgaggtcataagtttaaaaagattccttttctccccagtgttgtaagagttattttagttctatcaaatgctcccagtgagtactgcatatttcctttttgccagatacattagctattcactcttttttcctatctcttctatgcttttattttttccctcatctgtttaaccaatggtaccctgaattttagaaccagacaggtagtaggacaaggcaggtgaaaatgcacaggttgtaaatttcagaatgcacattcaaattccatcgttgtctcttactaactgaatgaatgtaggtaagatgctttacctctcagagtcttacttaccccatctataaaatgagaataatacaaactgtcttctgtggttttcttgagcattaaacgtctctatttatggaacatagtttcacatagtaactgattctgtaccaatgccctgccccccatgtaggcaaatgcatgtcccgaaagacccaaaacaagttgtccctcttttcaagatgaagatttgtaatctctccttaaacttatccagttctggtgtttaatttcctttataagccagaagttgttttacgtctcaccaaatcttataacatgaatattacactgtcttccaaatgtgagcctctaattaccttaggccaatagcagagcctctgatcttgtcttttctccttttccgcttaccagacagcacattctgcctgagagttgagacccaaaaagatataaatcaactagggggcaaaaatggagtttcctaagcttgtcccagagtttgactcagtagcctgaggtggagttcaggggcttgatgttaaaaacaagctaccccagtggttttgctgcaggtggaccagactcccaagaccacattttgcaagcactggcatttaggaagagcacgtacctactctagcagagtttatgcagactatgattgcagcctagtttgtgcagactattgattgcagccacttggcaaggctctataagaaaaagcgagccaacatgtaagtaaattatcatggccttgaaactcctcatctgaaagggtttcctctcatcccctcatccccttgtgtctgcccctgaatgccagactatcttctccagccccaagtcaacctctcatttttaagccattcctcattctcctatatagtccaaaatagcgaatacatttttaggaattctcttgctttatggacgttcatccaaaaatatttcattatgagaataagtgcttagcttatcctgtagtgtctttctgctctaatatttgggcccttcctttccacatagttgcattttctttgacgggcagatgctgctcctttaatatttttcacacctttgtgcttctaacagagcaattatttcaggatgagggcacttggagagctgtaagaggataaggagcccagggctctgccttggatttgtgtacctaaatgttacctaattagataaacctgaggaagatgtggaagcaaagtagaatggaacagaaagtgtttgaataataagaatttggacattgctgctccgtggtgacattggcagactctaagcctcttgcctcattttattcattcatgtatgacggggttatgctcagtcataagtcactaaaatttgtattctacatcccattagtaaagtaatttttgaacacatgatacatatgtttacatatttgtaagttatatatatgtacaaggttctaatatattctgttcattgtcaaacataaaatatatataaatttggtttaatataaaatataaaattggcattagtagacactgtctaccgaaatgagacactgtctcatttctgaaaaaagcacaatgtatactaagttaaaggttcattcttaacagcagtaggagtagatctttatttcaaatagtctttgggataatttcctattttggaagacagcttatcagatttggttagagttgatgaaagcttattctagggttaagaaaagtattagcccagccattttcttattgttgatttgggcttgcataattagttttaccttcagtatgaagtttctttacatgaatctttttaactcacttatttgttatacaattattagttaaatcaattttaaatcagtataatctatccacaaaatcagtcatacagaacctgcaaaaaacatgttctaacatgttacatgaagaggtaactaaagatactacaaacaacccctctgaacggtaacactcccactcttcctgcaaaattcctctcatagcaaatgcaacatgtgactcagacacaggctgactgaaggctttatgcaactcttacatgctcaatattagaaaactttcatttgtttcctattttatataaacaacacatataaataaacattttagtatcttctcattacccagtggattgtcttgcatggtccattttgaagacagtaaactgtagcctctatttttatttaatttcaaatacctgtttgccaatattcacagccagctcttgttaatgttcttttctgtcctgtgaatcctgatgtcgtatcttgcaacatcacctctaaagcctatctttgcactcctgtccatcccccattctctattattatgctgcctctgatggccagagaaaaaaatcttgaaaatatatattgtattgccctacctggcgaggaatcagcagttatacaattcaaagttgcagcaattcaccacattgtttagcaccctactatgtgtaaggaggaagcttgatttaaaaaatatatacaatcatgccttcttcaagaatgttttggagcatgcaagagcttaatgctcatggacatttactttattccagcaaatttagacccaatctctgtgtagtttcattttgttttccatttcctgattaactgactatatatctagctacttatttgctgccatctagtgtaataaagtatgttgattatacaaggaattttgagcccattatgtagttgaatatcagtactcaaaatgattctttttttctggtttcttataagtttacaaaatgcctagtcagggacctttcttatcactgtaaccctgaacatggtcttaatcttgtgtcatagaatctagggctcaggatcaaccttcgttcattttctataaatgtgacatttggaaactgggtaggggcttagcagttggtggatatgaagtaaatatataagagtaatcattaagagatcatctcagtttagtgaccatgattttttcctcatggaggcagcaaaacacagcatggattcttaccagtagtgtgaccatgggcaatttatttctctcttggaggcatcattttcttcatatctaaaatgaaatggtaggtccaggtgactgttaaggtctcttctagctctaagagtctgtgtctacatataaatgattttctctgccaaagtagtgtttttagagtcctttttaatgccagaaatgaatacggcttctctagttcttctaagtggccatctatcctttggtgatggttagaagtaagcagagatcctggctagaaagagagagaggaaaatgtggaccatgattttattccttttattcttgagagttgtccaatgggatattgtccactagtggataagtagatacttgccaatatgcacctgacctcttctcttcactcataatgggaatttagaagtataatacctgttataatcaacttcctaatctctatcccttttttgtcactctatttcctactgtaacttctctatgaagtactataagtctacagtaacatactggtgtttccctttccttatgaagttttatatagctactccagtatatcctaaaatgttcctttttcttgcttttatagtggagtcttgcttgttggccaggctggcctcaaactcctgagctcaagtgatcctcccacctaatagtagctgggtattcttctgagtaggtggtcctaaaatgttttattttcagcttatttcataggtataagtcttattttcccaaccaggctgaaaacttttcagaatcaggacttgtctttagtttctcattttttatgaggggatgtggcattattgcttagggaattcagatatttctgataataaagatgcttttctgtttgttcatataaattagggtaaaagaggaagtacaaaactatctcaaatcaagtacaggactcttaattattactagctatctaacagctcatagaaaccgataagtttctgaacctaatgccaaaaaaaagcaaccttaccataaaaagaaaatccaaataaaactgaaagaggcagtgggcagtgctacctatgggaagaaaactttgaagtgggaaaaatctggattcacatcccagctttgctacttattacctttgtgttttggctaaaaattatctaactttcctgaagttaagtttccttctctgtaaaatgagggttataataatatatacagcatactccacagaagagttgtgaagatggaatgagaaagcaaatggcaaaaacttagcacaaagtaggagctcaatcaatcatggttaaaaagaacttttatccattgttatttttgcttatatacagtaagaattatccaatgcaaatgtaatcagagcatctgcaattgagctttataaagtgaattataattctcataccatagtggttctcatcaagggtgatttttttccccccaggggacatttggcaatgtctagagacattttacttgtcacactggaaaagagggggtgctactggcatctagtaggtagagagtaggaatgatgataagcattctctaatgcacaggacagcattccacagcaacaaatgatctgatccaaaataccaatagtgtggaagttgagaaaccctaccataaagcctagggagtccattacttctgacctaaatttgttttatatttaagagtggatgtggattaaaagtagcttccattttggtaggttatgaagagagttgtctaatctgtgctttagattctaattttgaggcatatttttaggctaaggcattgcaatatataaggctttctaagtttcagacattttcttggaggtcaacaaatgaaggcttggggatctattaacccactagagtagtgtaataatggtggtggttgtttattgaagactaaccaagtgccaagtactctataataatctgatttatttttcagcaactgtataagcaggtattttgctctcattttacacaggggaaaactggagcttagagaacttatgtaacattactagcaagttgcacagctgggattcaaactgaaatccagctagcttcaaagactgtgttctttctgctgctgcatactacccctacctaccaaggctctgagattagaaagcaggatgggtgtgttttaaaggaaataaggtaggaaagttttcaaatattagaaactctgcacaagaagattaggtcaagtttcccactgaggggcccttgagtatctatgaactcgatgaaaactctgagcttctcaggaaggtagaccaaagggaaaggattcatcaaaatggatgttagcactatgccatgtgtattactccatcctcacacggccaaaaggacatacctgagactgggtaatttgtaaggaaaaagaggtttaaaaaagttctcttcgatggccaaataggaacagctccggtctacagctcccagcgtgagcgacacagaagacgggtgatttctgcatttccatctgagctactgcattcatctcactagggagtgccagacagtgggcccgggacagtgggtgcagcacactttgcaggagccgaagcagggtgaggcattgcctcactcaggaagcgcaaggggacagggagttccctttccgagtcaaagaaaggggtgacagatggcacctggaaaatcgggtcactcccaccctaatactgcgcttttctgacgggcttaaaaaacggcgcaccaggagattatatcccgcacctggctcggagggtcctacgcccacggagtctcgctgattgctagcacagcagtctgagatcaaactgcaaggtggcagcaaggctgggggaggggcgccaggcattgcccaggtttgcttaggtaaacaaagcaggcgggaatctcgaactgggtggagcccacaacagctcaaggaggcctgcctgcctctgtagactccacctctgggggcagggtacagacaaacaaaaagacagcagtaacctctgcagacttaaatgtccctgtctgacagctttgaagagagcagtggttctcccagcatgcagctggagatctgagaacaggcagactgcctcctcaagtgggtccctgacccctgacccctgagcagcctaactgggagacacccctcagtaggggcagactgacacctcacacggccaggtactcctctgagacaaaacttccagaggaacgatcaggcagcagcattcaaggttcatgaaaatccgctgttctgcagccaccgctgctggtacccaggaaaacagggtctggagtggacctctagcaaactccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagagcagaaaaactggaaactctgaaaagcagagcacctctcctcctccaaaggaacgcagttcctcaccagcaacggaacaaagctggacggagaatgactttgacgagctgagagaagacttcagacgatcaaattactccgagctacaggaggaaattgaaaccaaaggcaaagaagttgaaaactctgaaaaaaatttagaagaatgtataactagaataaccaatacagagaagtgcttaaaggagctgatggagctgaaaaccaaggctcaagaactacatgaagaatgcagaagcctcaggagccgatgcgatcagctggtagaaatggtatcagtgatggaatatgaaatgaatgaaatgaagtgagaagggaagtttagagaaaaaagaataaaaagaaacaaagcctccaagaaatatgggactatgtgaaaagaccaaatctatgtctgattggtgtacctgaaattgacggggagaatggaaccaagttggaaaacactctgcaggatattatccaggagaacttccccaatctagcaaggcaggccaacattcagattcaggaaatacaaagaacgccacaaagatattcctcgagaagagcagctccaagacacataattgtcagattcaccaaagttgaaacgaaggaaaaaatgttcagggcagccagagagaaaggtcgggttacccagaaagggaagcccatcagtctaacagctaatctcttggcagaaactctacaagccagaagagagtgggggccaatattcaacattcttaaagaaaagaattttcaacccagaatttcatatccagccaaactaagcttcataagtgaaggggaaataaaatactttacagacaagcaaatgctgagagattttgtcaccaccaggcctgccctacaagagctcctgaaggaagcactaaacatggaaaggaacaacaggtaccagccactgcaaaatcatgccaaattgtaaagaccatcaaggctaggaagaaactgcatcaactaacgagtaaaataaccagctaacatcataatgacaggatcaaattcacacataacaatattaactttaaatgtaaatggactaaatgctccaattaaaagacacagactggcaaattggataaagagtcaagaaccatcagtgtgctgtattcaggaaacccatctcacgtgcagagacacacacaggctcaaaacaaaaggatggaggaagatctaccaagcaaatggaaaacaaaaaaagtcaggggttgcaatcctcgtctctgataaaacagactttaaaccaacaaagatcaaaagagacaaagaaggccattacataatggtaaagggatcaattcaacaagaagagctaactatcctaaatatatatgcacccaatacaggagcatccagattcataaagcaagtcctgagtgacctacaaacagacttagactcccacacaataataatgggagactttaacagcccactgtcaacattagacagatcaacgggacagaaagttaacaaggatacccaggaattgaactcagctctgcaccaagcggacttaatagacatctacagaactctccatcacaaatcaacagaatatacatttttttcagcaccacaccacacctattccaaaattgaccacgtggttcgaagcaaagctctcctcagcaaatggaaaaaaacagaaattataacaaactgtctctcagaccacagtgcaatcaaactagaactcaggattaggaaacccactcaaaaccactcaactacatggaaactgaacaacctggtcctgaatgactactgggtacataacaaaatgaaggcagaaataaagatgttctttgaaaccaacaagaacaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaagagcaaacacattcaaaagctaggagaaggcaagaaataactaagatcagagcagaactgaaggaaatagagacacaaaaaacccttcaaataattaatgaatccaggagctggtttttggaaaggatcaacaaaattgatagaccactagcaagactaataaagaagaaaagagagtagaaaaataaaaaatgataaagaggatatcaccactgatcccacagaaatgcaaactaccatcagagaatactacaaacacctctacacaaataaactagaaaatctagaagaaatggataaattcctcaacacatacaccctcccaagactaaaccaggaagagttgaatctctgaatagaccaataacaggctctgaaattgtggctataatcaatagcttaccaaccaaaaagagtccaggcccagatggattcacagccgaattctaccagaggtacaaggaggaactggtaccattccttctgaaaccattccaatcaatagaaaaagaaggaatcctctctaactcattttatgaggccagcatcatcctgataccaaagcctggcagagacacaaccaaaaaagagaattttaggccaatatccttgatgaacattgatgcaaaaatcctcagtaaaatactagcaaaccgaatccagcagcacatcaaaaagcttatccaccatgatcaagtgggcttcatccctgggatgcaaggctggttcaatatttgcaaatcaataaatgtaatccagcatataaacagaaccaaagacaaaaaccacatgattatctcaatagatgcagaaaagttctttgacaaaattcaacaacacttcatgctaaaaactctcaataaattaggtattgatgggacatatctcaaaataataagagctatatatgacaaacccacagccaatatcatactgaatgggcaaaaactggaagcattccctttgaaaactggcacaagacagggatgacctctctcaccactcctattcaacatagtgttggaagttctggccagggcaattacgcaggagaaggaaataaagagtattcaattaggaaaagaggaagtcaacttgtccctgtttgcagatgacatgattgtatatctagaaaaccccattgtctcagcccaaaatctccttaagctgataaacaacttcagcaaagtctcaggatacaaaatcaatgtgcaaaaatcacaagcattcttatacaccaataacagacaaacagagccaaatcatgagtgaactcccattcacaattgcttcaaagagaataaaataactaggaatccaacttacaagggacatgaaggacctcttcaaggagaactacaaaccactgctcaatgaaataaaagaggatacaaagaaatggaagaacattccatgctcatggataggaagaatcaatattgtgaaaatggccatactgtccaaggtaatttatagattcaatgccatccccatcaagctaccaatgactttcttcacagaattggaaaaaactaccttaaagttcatatggaaccaaaaaagagcctgcatcgccaagtcaatcctaagccaaaagagcaaagctggaggcatcacactacctgacttcaaacaatactacaaggctacagtaaccaaaacagcatggtactggtaccaaagcagagatatagatcaatggaacagaacagagccctcagaaataacactgcatgtctacaactatctgatctttgacaaacctgagaaaaacaagcaatgggaaaaggattccctatttaataaatggtgctgggaaaactggctagccatatgtagaaagctgaaactggatcccttccttacaccttatacaaaaattaattcaagatggagtaaagacttaaatgttagacctaaaaccataaaaaccctagaagaaaacctaggcattatcattcaggacataggcatgggcaaggacttcatgtctaaaacaccaaaagcaatggcaacaaaagcaaaaattgacaaatggggtctaattaaactaaagagcttctgcacagcaaaagaaactaccatcagagtgaacaggcagcctacaaaatgggagaaaattttcgcaacctactcatctgacaaagggataatatccagaatctacaatgaactcaaacaaatctacaggaaaaaaacaaacaacaccatcaaaaagtgggcaaaggacatgaacagacacttctcaaaagaagacatttatgcagccaaaaaacacatgaaaaaatgctcaccatcactggctatcagagaaatgcaaatcaaaaccacaatgagataccatctcacaccagttgttagaatggcgatcattaaaaagtcaggaaacaacaggtgctggataggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactgtaaatcatgctgctataaagacacatgcacactatgtttattgcggcactattcacaatagcaaagacttggaaccaacccgaatgtccaacaatgatagactggattaagaaaatgtggcacatatacaccacggaatactatgcagccataaaaatgatgagttcatgtcctttgtagggacatggatgaaattggaaatcatcattctgagtaaactatcgcaagaacaaaaaaccaaacaccgcatattctcactcataggtgggaattgaacaatgagaacacatggacacaggaaggggaacatcacactctggggactgttgtgggggtggaggagggggaagggatagctttaggagatatacctaatgctaaatgacgagttaatgggtgcagcacaccagcatgccacatgtatacacatgtgactaacctgcacattgtgcacatgtaccctgaaacttaaagtataataataataaaagaaaaaaaaagaaaaagaggtttaatggactcacagttccacatggctggtgaggcctcacagtcatggtagagggtgaatgaggagcaaaagcatgtcttgcatggcggcagaaaagaaagcatgtgcaggggaactgccctttataaaaccatcagatctcatgagacttattcactgtcatgagaacagcacaagaaaaacctgcccccatgattcaattaccttccaccagctccctctcatgacacatgcggattatgggaggtgcaattcaagatgtgatttgtatggggacacagccaaaccatatcaccatgacatacaatttgccgattcagcaacagttttcaggtcttctatttttaagcctaatgcaatatattttatgaattcttcctatttatgtttttccttttaaataagttctactatcttaactatcactttcaaatataatgcaagctacatatgccattttaaattttttagtagttacatttaaaaagagggtgaaattaattttaacaaagtaggttatttatcccaatatatccaaactattatcattttgacatgtagtgaagctaataaaagcattcattgttaatgatctatctcttacattattttttcctaataaatcttcagaatctgggtgtgcattttaactttccagcacatctcaactgggatgtgaaattttcagcaattaaagtgaaatatagccctatcaaaactattaatgttgcatttaggaaaaagatatttttcactctttttatttttaaatttgagtttaaattaattaaaatggaataaaatttaaaattcaattctctgtcacactagccacatttcaagtgctcaatacctacgaaagacccatggctaccatattggacagcacagatctaagctcttattgctcagaatgtggtccccagagcagaatcaacagcatctgtgaacttatcaaaagtgcagtatttcagttcacacctactgaatctgcattttaacacaatccccaggtgatgcttgttcacatgaaagttgtgtctctctaaatcgcagatcttttcaacaaagagcccagaaaaagcacatgaatcaataactgtgaggaataaggaaacttgccacaggagaatggtgccagggttggcattaatgatgtgctctggtgaaaagtcgtaggtttcccacaaaggcaaccatggctattctattgtttgaactgacacagagccattctagagcttggagttggctctgctcccagaatctacatcaaagaatctaacactaacttccatgactaccacaattaaggcagctgcacaccccaccactatatatatttgaaattgcaactttagaacccctgtaacacagccgtgagcatgtttctgctatacacaagtggaatttaaggtcgaacctccctgggagaccccaggaagatcacccacaagagtggcttttgttgtctgcctcactgtcatcctctgagagctaacacagacacagtcaacatcctcttatatggaggttggcccagatgcccctggggattcaatgtattctgcttcacctcactaatccttatttggtttgtttttcacagaactcagtatttgatgggcctttcaatattttcctttaaggaattcattgtactaatataacatagaagctcattgttctaataagtggtccccaatgttggctgcacattagaatcacctggggcattttgaaaaataccaatgcccaggcatcaccccaatctaattaaattaaacctgtggaaggtattttgttaaagatccccaagtgattacaatgtgcagccagagttgaaatccactggtccaattagaaggaggccttagctagcggtcaggtgcccaaggaaaggcatctcaagttttaatgcgcatacagatagcttgggatttgttaaaatgcagattctgatccagtaggtatgggtggaaataaacccatgtttgtgtacagatgtttctcttgtggtatgtggttggtaatcatcctcagtatgtttccatttccggcaaactgggttgagttgatgaccctattcttactcctccctgaaacctttgtctctccctcaggctcccagttctcattaatcactactttctgtgatattctgaagcaattattatctttaactgccttttttcattagctacttctctatctgcttatgtacgtgagttatttcctctactggattacgatcttcaaggtagatccaaatatcatgtcatttttataattctcactgcacctaaagagtgccttacacacaaatgccacttgttgattaattgaaacagggaatagctgatgtgatcatctcaaaaaatatccaaaagacttaaaaatgcaagatatttttctttgttggacagaaaaagaaagtttagataggcaagggggtaggagatattgaggctttcaatttttatttcactcggtacatatttaaattttgaagaattattttgtaatttagtgattttaattatttgttgggaatagggcactattgacattttggactagatcattctttgttgtggctgtcatcctgtgcattgtaatatgtttcacagcatccctggcctcaacccactagatgccagtatcaccctttaccccagtcttgagaaccaaaaatgtctccagtcattgcaaaatgtctcctgggaaactcattcatggttgagaacccttagtttagaaaaatggaagtgtgacacagctgtcttaccgcactaatatagacctgaaaaaaataaaaaattaaaaacatgcacataagagaatgacaagctatgttctgagcaatatgtgtatatataaatattaatataaaaatgttctctgttcctgcgttttggaggccatgtgcttgtagaccatatttatctttgtatttgtcatcttggtcattctctttataaaaatagaggtatattgcatgccaatgctcctcagcttatgaggttacatcccaataagcctgttgtaaatttaaaaaatcataagttagaaatgtcaaaacttgaaaatgcatttaataccctgataaacacatcataaagttgaaaaatcctaagtcaatccatcatgagtcaggaactatttgtatatgaaacatttttaaaatctgaacatagacttaggaattttaatatgtagtggtagtaattccaccaagcaagagaatacatagagcaaaaatcattaagaaacagtgactgagatgattctcattctcaggaaactggtccagcccctttacataaaatattctgttcagtgtgctgtgatccttggactgaatatactgttttagcaagcagagttgttaagctaaagcctgcacatcaacaggtgttcaatgtctgctgaataaatgaagaatgaatgaatattaactgcacctctaaaccctaaaattaaaaagctttaatgtgctcatcacaaaagaccctattttgttgcatttgaaatttcaagcttcaaaaatgaaattacatgcaaaagtatattatcatcaatgagaataaatggcctcaacaaaattacaagatagaaaacaaagtttcatttgtcagttggtttcttctggcaatagaaggctccccttagacttcattagcttcagatatttcagtgacagaaatttaatgttggcaaagcattgctatactttcaggcttggattggaatgccccacatttactttttcctaccattcctggctaaaaacttgaatgtgagaaccagacacaaggctctagtggtagcaagcagaatgtctcctaagctccaaggggaaaaaatgatataagtcagtggttcccaaattaaccatcaaatgctacccattaaaatcactggggaacttttaaaaattaaatgcccaactaacaacaaactgtatgaaaaagaaatttagaaaacaatcctatttttaaaagcagcaaaaaagtaaaatacttaggagtaaatttaaccaaggaagggaaatatctgtttactgaaaactatgaaatgttgatgaaagaaattgaagatggtaaaaataaatgaaaagataaatatgtatggattggaagaattaatattgttaagagatctatactacccaaagcaatctatagattcaatgcaatcctatcaaaattccaaagtcattctttatagcagtagaaaaaaatcataaaattcatatggaaccacaaaagactctgaatagccaaagcaatcttgaccaaaaagagcaatgctggaagcatcacattatcagatttcaaaatatattacaaagctacaatattcaaaatagcatgctactggcattaaaacagatctatcaactactgaaacagaatagtgagcccagaaataaacccacacatctatgatcaattgattttcaacaaagataccaagaacacacaatggggaaagacagtgtcttcaataaatggtgctgagaaaactggaaatccacatgctgaagaatgaaattagatccttatctcatcccttatacaagaatcaactcaaaatagattaaagacttaaacataagccctgaaactataaaactaatgcagaaaatatagggggaaatctacatgatattaatctaggcagaagtttcatggatatgacctcaaaagcacagacaacaaaagcaaaaatagacaaatggcattgcatcagactaaaaaacttctgtacagcagatgaagcaacaaatagagtgaagagacaacctacagattaggagaaaatatttgcaaatcatatattagataaggggttaatattccaaaaggtacaaggaaatcaaactactcaataacaagaaagccaattaccctattaaaatatagggatagcattgggagatacacctaatgctagatgacgagttagtgggtgcagtgcaccagcatggcacatgtatacatatgtaactaacctgcacaaggtgcacatgtaccctaaaacttaaagtataataataattttttttaaaaaaaagcaaaaattaaaaaaaaaaaaaaaatatatatatatatataggcaacaaacttaaatagacatttctcaaaagaagcaagtatcaccctgatttaaaacctggcaaagacacaatgagaaaacaaactacaggccaacatctctgatgaacatagacacaaaaatccttgacaaaatactagcaaactgaatacagcagcacatcaaaaagttaatttgccatgataaactagtgtgttagggtgttctagcatgctattaaaaaatacccaagactgagtaatttataaagaacaaaggcttaatttgttcatggttctgcagcctgtacaagcatggtgccagcacctggccagcttctggggaagcctcatgaaatttttattcatggcagaaggtgaaacaggaacaggcacatcacacaggggaagcaggagtaagagagagtgtgagggaggtgccacacacttaaacaatcaggtctcacaagtactcactcactactgcaaggacagcaccaagccataagggcccacccccatgattcaaacacctcccaccaagacccacctccaacattgggcattatatgtcaacatgagatttgaacagatacaaatattcaaactatatcaagtaggcttccttcttgggattcaaggttggttcaacatacacagatcaataaatctgactcaccacataaacagaattataaacaaaaaccacatgatttcaataggtgtgggaaaagcttttgataaaatccaacctcccttcatgttaaaaaaaaaaaaaaaaaccttaagaaactaggcggccgggcgcggtggctcacacctgtaatcccagcactttgggaggccgaggtgggcggatcacgaggtcaggagatcgagaccatcccggctaaaacggtgaaacccagtctctactaaaaatacaaaaaattagccgggcgtaggggcgggcgcctgtagtcccagctacttgggaggctgaggcaggagaatggcgtgaacccgggaggcggagcttgcagtgagccgagatcccgccactgcactccagcctgggcgacagagcaagactccgtctcaaaaaaaaaaaaaaaaagaaactaggcattgaaggaatatttctcaaaatagtaagagccatctgtgacaaacccacaacaacataataataaatgggcaaaaactggaagcgttccccttgaagacaagaaaaggatgccttttctcacctgttgtattcatgacagtacttgaagtgctagccagagcaatcaggtaaaagaaagaaataaaagacatcaaaatagaaaaagaagaaatcaaactacctctctttactgactatataattctatgcctagaaaaacctaaaggctccaccaaaaaagctcttggaactgataaacaacttcagtaaagtttctggatacaaaatcaatgtgcaaaaatcagtagcatttctatacagcaatagtgttcacattgagagccaaaccaagaatgtaatcccatttacagtagccacaaaagaaataaagtacaactagggatacatctaaccaaggagatgaaagatctcataatgctgcacaagtacagccatttaatcttcaacaaagatgacaaaattagcaatggggaaaggactctctagtcagtaaatggtactgggataaatgtaaatgtcagtaaatggctagtcagtaagtgatactgactagctatatgtagaagaatgaaactggacccctacctttcaccatatacaaaaattaactcaggatggattaattattcaaatgtaatatctcaaactataagaatgtaatattcaaatatatctcaaatgatatacaaactataagatatatattatatctcaagctatatacaaactataagaatgtaatattcaaatgtaatatctcaaactataagaatcctataagaaaacctaggaaacaccattctggacatcagccttggaaaagaatttatgactgagttctcaaaagcaatttcaacaaaaacaaaaactgacaagtttttctgtgtagaagctcttagtttaagaaaaagaaaccagcaacagagtaaacagcctacagaatgggtgaaaatcttcacaaactgtgcttccaaccaagatctaatatctggcgtctgttaggaacttaaacaattgagcaaacaaaaaacaaccccatttaaaaatgggcaagcagcatgaacagacagttctcaaaagaaggcatataaacagctaacaaacatgaaaaaatgtctcacatcactaatcatcagagaaatgcaaatcaaaaccacaataatatgctatatcacaccagtcagaatagctattatcaaaaagtcaaaaacaacagacgctggcaaggctgcagaaaaaaaagtgaacgctcatacacggttgctgggaatgtaagttagttcagccactgtgaaaagcagtttggagatttctcaaagaacttgaaacagagttaccattcaacccagcaatcccactgggtatatatccaaaagaaagtacattgtttcttttggatattgttctacccaaaagacacatacactcacatgttcattacaacactgttcgcaatagcaaagacatggaatcaacctaggtgcccaacaaaggtggattggattaaaaaatgtggtacatgtccaccatgggatactacacagcaataaaaaagaatgaaatcatgtcctttgcagcaacatggatgcagctggaggccattatactaagtgaggtaatacaggaacagaaaaccaaatactgcatgtttttacttataagtgggagctaaacattgggtaaacatggatataaaggtggcaacaatagaaactggggactaacagagtagggaggtagggagcagagagaggactaaaaaactattaggtactatgctcattccctgggtgatgggatcaatcataccccaaacctcagcatcgtgtgatatacccaggtaacaaacctgcacatttgttccctgaatctaaaataaaagttgaaattacaatttttaaaaggatagaaactagtcatcagcgtgttttttaattttccaggtgactctaacattcaataattattttaaataattatttctgtctgtagaccttctgccagctactaagtttcaggaattttgatggtctcattaaagagaacctgacaaccccacttacaagtgcttcagctaagtttcatttataatattttcatattgccaaggatccagtagtgtcttttttacagtgagttacaaattcctgtttttgtgacagtgacaggccaaaattaatgagctgtgatttttaaactgaaaaagtgactgtccaatagaggctaaaaagaaaactaaaattatattttgtcaattttagtgttaagtgtgattttttgctttgtatgttttagatagtttttttattgagataaaacccaaatagcataaaatccacctttttaatctcaaagtggtttttggtatattcacaatgttgtgcaacaatcactactatctaactctagaacattttcattacttcctcatggaaccctgtacccattagtagtcactcccagtttcccattcacctcatttcctggcaaccactaatctacttttctgtctctctgtatgtgactattcttaacatttcatgtaaatcagatactataatatgtggccttttatgtctgacttctatcacatagcaacatattttcaaggtcattcgtgttgtagcatgtatcagtattttattcctttttaagacaatactttattataggattataccacatcttttttatccactcatcagttgatggacctttgagttgtttctacttttctgttattttaaataatgctgttatgagcattcttgcacatgtttttgtgtgatcatatgtgtttgcttctctgggcatatacctaggagcagaattgcagggtcatatggtaactctgtatttaacattttgaggaacccccaaattgctttccccagtagctataccattttacattctgaacagaagtgtgtgagggtttctattacttcacatcctcttgctttctattttaattatttaattatttaatttaattatctaagatgccttttaccctaaccaaccagaaaataaacttgactgaatttagtgctaattgtttttgcatagtcattcagtataattgtctttgacatctcaaaacactgcttatgcagaatacacttttttaaaacagtgaaatcatagcaattctatttcctaagtcagttcttcttcagggtagtaagttataggtctttgaggtcatgttcctgtttccatcttccaaaaggcaacattattaaaatcttgttgctgtatctgccttggcatatccccctctctatccagagaaaagatcactgacagaatagtgtccccacctttctatcttagaggtctcattacgagtcagtatgcttttaaaagaattaatggataaagagctagacatcaagaagaagagagaaaattttaaataagacagaggagtgtatgatcactctttctaagatgattaaatgaaataatttgaaaggcaataaactaactgcaccaagtaaatcttgtgaaagcgaaaggaaagaggagaaggaagatttgagtgctgaaaaccaggataaattgtattcaaccaccagcattaagggaagttatacaatacattttatgaagaaagtgttccatgaaaataaaacaacaaaaagaaagtttggtgaaggtttaaatgataaatgccaatagtagtatatgtgcaattatctactgacactgctatacaaatgagctatctatataggctgtgaccacataacctcacctgccaaaccacagtactataaataaatacttttcccagacactacagagctcagttgacttgagattcatcttatggtaactggaaatgtagactgtgcctttatttgggtcaatcctacaattttctttaatgtaccagcaattcattatttaaagtttactagagtttaatttaaaattataaaaaaggaagaaattggctgggtatggtggctcacgcctgtaatcccagcactttgggaggccaaggcgggaagatcatgaggtcaggagatcgagaccctcctggccaaaatggtgaaacccagtctctactaaaaatacaaaaattacctgggcatggtggcacacgcctgtagtcccagctactcaggaggctgaggcaggagaatcgcttgaacctgggaggcggaggttgcagtgagccaagatctcaccactgcactccaacttggtgacagagcgagactccatataaaaaaaaaaggaagaaattaatagttcaggtgagaacttgtgaatttttattctcaactctaagctagtaagtgcttaaatagaagactttacaacgagctgtaccttcttaattctacagagaatcatgaggaaaatcaaatataaatgtgaatttcttatgttcagtattgtccaaaaagaaaatattttattaaattttttgtcagttgccatcattatttaaagccttcctgccagtagcctatactatttttggaatggagtgtttgcagtttcataaccacttgataacaccataggttaaaaaaaaagtctaccagtctttttcagatggcctctttgacaatgcattatttatagggaagttcagttacttttaacaataaagacaagccaaaagaaattacagatctcttttaccatattttgatatactagcagcatccactcaggacaggacctttattaaaagggggcttaaggtacttttaattggaggaattactgaattcctgaagctcttcaaacaaaatagcacttgggatatgacaagagtactttggagaaggctgcttggtcccaaagcagagattcaagaggaggactccagctagctgggtaaggggttccttcctctcaacctaagtgtttatgtaagcctgctgggggccaggaactgcgtaaaactcagtaagctcagtacttctcagcacagaatccagtcccaaggaagcacccagcaaaaatttaggttgaattttctttaaaataaaataaagaaaaaagtaaaattaaaaaaaaaatacaattcaactactcagcccattccattccgggtagttttggctcagaatgctggaagagttggataggctattagtgagagaactcaaaactccccaaactccacttcattactcttcctttatattttttctgaaaagagtattgccaatatatcaataaagctttttgctatgacttcagagtgcccaggtcactagggaaaagtatcaagtagcatcctgaatccacaaatcctttgagagccagccacacagtatctgcgtgagtgtggtaattctctacccttacgagtgtcatcacagaattgcagcattctcttttcattgtttctcaggaaaacatagacaaaggctctgcttggatttttttaatttaacactaatatgtaataatatagcaacatctcctagttatctagaactcaggctttgatagctgtgactgtctagaatacaaccacagaaaatcacctctgaacagtgagggaaatagctgccacagtatcaccacctactccaagcttgaacctctcaacccgcaaccaacagactgcaagtagttcagtacagctttgaatgcagcccaagacaaactcgtaaaccttcttaaaacattatgaaatttttttgcaacttgttcatcagctatcgttagtgttagtatattttttgtgttgctcaagacaagtctcttcttccagtgtagcccaggaaagccaaaagattggacacctatactttggatgtttcatctagtaccgatatacttataattacatgtttcaactagtactaatgaacttatagttacaggatgaaatttcaaattagcaatgttcatcatttgctcttcctaggtaacaacagttaacaaatcataggttgacaatcacaactgattgtgaggatggaaataataacaatgagcatttatataatgcttactctataccaggcacttttctaagaactttacatagattagctcacttaatctttacaataaccctgtgacataccattattatccccattttacaggtgaggaaactgaagaagttaagtaatttgcccaagattacagattgtatgtgattgaggtaggatttgaactcagcagtctggcaccaaaatcagcactctcagcctctacccagtattatcaaaagtaatttcctggtagcttctttcaattgtcatggcaactctcaagataaagaattattgtttttaataaataatgtcattcccagaaatgaattatgtgtgaatcatactaagctgcagtgagagaatgaatatcaccatcacagtggtgaatctacttagtgtaggggtaaaaggccagtctctcccagcagccctgcacataggtacaccgtaattcactaggataatccctgatcgccatgctgtcataaaaaaacgttaaatgatgtttaacaggtttcattaatgattcagagaatcttataatatgtcttaggaaaaataatttcaggagtaactttcagttagctagacaatacagttctgttgagcatctcataatctatgccagacaaaggaaacattcttgcctttctttgagggaattatagaccaacaattttattaattttcaactttcatcgaggcaagattagcttcatgaacaatgtttctcaaactgaaagtagtgacctgtattagtaaatcaatttatagggttgcaagcagcatcatttataaactgaaatcagaattcattgcaggcagtaattttgagacattttattttacatgtgcgtgtgtatatctatcatataaataagtatgtgagaacattttaaaacatttaaaatatatttatatatctaaagtttaaatgtaaatatatatttatattaataatataattaatatgaattaataacatattaattcatattaacttatattaatttatattaacaatatgtaaacaatatattaattagtaatatattatactaatattagtatgtattaatatattattataatatattatatattaattaatatattatatattgtatattatatattaattaatatattatatattgtatattatatattaataacatactattattaatattttaaatatattttaatatacttaaatttatacttaaaatttacatatacatataaataattttcctgaaagtcactttcaaaaactttgaaagccaccagtgcagtggttaagaatacaaattttgggctgggcatggtggctcacacctgtaatcccaacactttgggaggccgaggtgggtggatcccgaggtcaagagattgagaccatcctggccaacatggtgaaacattgtctctactaaaaatataaaaattagctgggcacggtggcacgcacctgtagtcccagctatgcaggaggctgaggcaggagaatcacttgaacccaggaggtggaggttgcagtgagccgagatcatggcactgcattccagcctggcgacagagcgagactgcatctcaaaaaaaaaaaaagaatacaaattctgaagcacagctgttgagttggaatcatggctgtgccacttaataaccaagtgactttgggccagttattttacttctctatgcctcagtgtcatctattcagtagtgagaataatagtacctaactcattctagttttgagaatgaacactttttatattacatataaaatgtgtaggacagagaccccaaagaagccgtagttgctgtcatattgttattctgttcctgcttaagaaggggacttggaaaaataatgatgttgaatgcagtaacttctttcactcatggaagaattacatattcacatcttctttgctcatcaaacctttgaagatcatgcatgtctcattctgtaacatcgccttaaccaaatataaaggctaaatacaaaggtgtttttaaataactgatacatttaggccagtcacacaaagattttacccaaagcctatgcaggcatagtccaagaagtagacttgttctactgcaatcaccatctcttgtttattatttgtgaaaggaacattatggtttcaccacagttggcctggccaacgtgcttatgcagtcctcagaacatatgaaagtgatttcggctgacaataagtatttcctcactttggcttatgttcaataatagccattctttatccagatcagggtgactgagcatgctgtaaccattcttctcttctaaaactgacccttgtttgactgcatatgcagattgcttagcagaacccatatccaccataacgggccaaaagtcatttgatccaatgtgcttttctttttttttcttttttttttaattccatgaaattttattaagataaattaattataaacattgcaaaacacttttttttttagacagagtctcactatgtcacccaggctggggtgcagtgacacgatctcagctcactgcaacttccgactcccaggttcaagtgattcttgtgcctcagcctctctgagtagctgggattacaggtatgccccaccagacctggctaatttttgtatttttagtagagacggagtttcactatgttggacaggctggcctcgaactcctggcctcaggtaatccacccgcctcagcctcccaaagtgctggaattacaggtgtgagccactgctcccagccccaaacatgattttttgattgaatgcttaatgtctttctattattattatttttttttattatactttgttctggcatgcatgtgcacaacgtgcagatttgttacataggcatacatgtgccatgttggtttgctgcacccattaaaaattaattcaagatggattaaagacttaaatgttaggcctaaaaccataaaaaccctagaagaaaacctaggcaataccattcaggaaataggcatgggcaaagacttcatgactaaaacaccaaaaacaatggcaacaaaagccaaaattggcaaatgggatctaattaaactaaagagcttctgcacagcaaaagaaactaccagcagagtgaacaggcaacctacagaatgggagaaaatttttgcaatccgcccatctgacaaagggctaatatccagaatctacaaagaacttcaataaatttacaagaaaaaaaaaaaaccatcaaaaagtgggcaaaggatataaacagacacttctcaaaagaagacatttatgcagccaacagacacatgaaaaaatgctcatcatcactggtcatcagagaaatgcaaatcaaaaccacaatgagataccatttcacaccagttagaatggcgatcgttaaaaagtcaggaaacaacagatgctggagaggatgtggagaaataggaacgcttttacactgttggtgggagtgtaaattagttcaaccattgtggaagacagtgtggcaattcctcaaggatctagaactagaaataccatatgacccagtgatcccattactgggtatatacccaaaggattataaatcatgctactataaatacacatgcggccgggcgtggtggctcatgcctgtaatcccagcactttgggaggctgaggcaggcagatcacaagttcaggagatcgagaccatcctggctaacatggtgaaaccccatctctactaaaaatacaaaaaattaggcaggcgcagtggcgggcgcctgtagtcccagctactcgggaggctgaggcaggagaatggcatgaacccgggaggcggagcttgcagtgagccgagatagcgccactgcagtccagcctgggcaaaagggcaagactccgtctcaaaaaaaaaaaaaaaaaaaaagacatatgcacacgtacgtttactgcagcactattcacaatagcaaagacttggaaccaacccaaatgtccatcagtgatagactggataaagaaagtgtggcacatatacaccatggaatactatgcagccataaaaaaggatgagttcacgtcctttgcagggacatggatgaagctggaaaccatcattctcagcaaacgatcacaagagcagaaaaccaaacaccacatgtgtgttccaacttaactcattgttcttagtgataattcacttaggggcaaagttaggctctcttgttaattgcaacattcctttcagaggtgctataaatggatgttgaactatactatttttagatttaatctttaaaaatcataagaaagcaagaaatattactagttcagaaatgattttctgttcctggctaatcagagaagacctaagagtctatagtagtcatttgttgtcttcgtagtaaaagtaagattctaataggatttttagacatagtgagaaaggtgttcattttaagattatggtagttcctctcagatttagaaagccttaagatgacactaaggagttggactttaggaatgctgagtgtcttcagccacagcggcacaatggtactagatgtgacaggatgtgattaaggagaaactaaacggccaggcacaatatagttcttcttgcctccaaaagaggagtcacccactttctcacactcactgtgatacattccatttgctaagaaaagtggcttgtgtcattcttgagcactacttttaagttctgatatattaaattcatttactctgtattaatagcattcaaatatttagtaaagttaatatacctctcacactttttccaaagtaacccaccagctgtgtcctgtgcttcaagctatcttataagactgcaatcaaagtgtcagccagggctgtggtctcatctgaaggctggatagggaaagattggttcccatgcttatttacattgttgttggcaggattcagttcctcaaaggttttttttatttttatatatttttttttgagatggagtcttgctccatcaccagactggagtgcagtggcgcaatcttggctcactgcaaactccgcttcccaggttcaagcaattctcctgcctcagcctcccaggtagctgggattacaggtgcatgccaccatgcccagctaatttttctatttttagtagagatgggatttcaccatgttggtcaggctggtctcgatctcgtgacctcatgatccacctacctcagcctcccaaagtgctgggattacaggcatgagccaccgcgcccagccagttcctcaagggtttttatactgagggcctctacttcttgctgagtgttggccagaggccatgcttagttctctgctgtatggttctcaccacacagcaacgtacttcatcaaaaccagcaaaagggtgagtctgctagttaaaaagaagtctcaatcttttgtaacctaatcatagaactgccatccactccatgctgccatattcttctgattagaagcaagttactcaagggaaggaaatacataaggctgtgaatgagagaagacaggaatcattggaggctactttaggggctgtctgccacagcacttaacagcacatacccagccataaaatttaaaaaagccggaaagagagaaggagggtgcagggtaaaataaagaaaagaggaaggtggaagggaagaaaggaagggaaagaaagacatttaaaaagacaagaacaaaacagctctgctgcacaacatctgtatcggagttccatgtgcagacacacacgtcatcacatcagcaccacacccataaatttcctatttcttatttacaatgagaaggtaataaggactttctatgcatctggagttaaaaggaaacaataaatctaagaatactaagtttaagtaatcaaaatgtgtttcagattagttattttttctttttaagtttttttttttgtttcagctgacaaagttttttatttctttctgtttcaagttttgaagttgagtttattattcttgctattatgtaacaggcatattttacagagaatataggaacctgattgacatttgtatttggtgttctattgttgtttcaattcaaatgccaaaattatgtttttgttgtgtacgttattgttcataattatatatgcctcttaattgtaaaagcgaagctgtaaaattgtaaagtactttgtgtctcatctattccaggcattctactaaggaaatcaagaccaaatggcttgggaaggtcaacgttaaatagtgtcagagccagaactagagtacacatctctcaatttctaatctagtgcatttccttttcttatttctgtgcaaacgaacagttagaatgtgaaatagtctcctcagatataccagcattaaaacagttgtggtttaaatatttagttttaataattactaactttgtagaaggacctaaaatagtgtttgttttcagtgcttcaactaatagtaaaaaggaatattttcagtgctttactgtatgagaggtgcttgcctaacgaaatacacatctttttcactgtactcatttgtaacagataatgtgggctcgtacacctcagtgttctgagaggggttggtaaacactgaccacatagagagagctgcccatctgccctcagtaccaaggcacatcccatccatgccctaaaactcttgtaaatttctccattcatacaggaaaatgagtatttcttacaacaatatgaccgtggaatttgattacaaaaacactcctgctatccccaacctgtgctcccagggctaaagacatatttgcaactcaggattttctgaagattcacttgtttgtactattgagggcaacagttgttctcaaacaaggatgcagttcctttcttcttaccctgcttatttttctttttattattattattattatactttaagttctggggtacatgtgcagaacgtgcaggtttgttacataggtatacatgtgccatggtggtttgctgcacccaccaacccgtcatctatattaggtatttctcctaatgttatccctcccccagccccacagccctcaacaggccccagtgtgtaaagttcccctccctgtgtatgtgtgttctcattgttcaactcccacttataagtgagaacatgtggtgtttggttttctgttcttgtgttagtttgctgaggatgatggtttgcagcttcatccatgtccctgcaaagaacatgaactcatccttttttatggctgagtagtattccatggtgcatatatgcaacattttctttaaccagtctatcactgatgggcatttgggttggttccaagtccttgctattgtgaacagtgctgcaataaacatacatgtgcaagtgtctttatagtagaatgatttataatcctttgggtatatacccagtgatgggattgctgggtcaaatggtatttctagttctagatccttgaggaattgccacactgtcttccacaatggttgaactaatttacactcccaccaacagtgtaaaagcgttcctatttctccacatcctctccagcatctgttttttcctgactttttaatgatcgccattctaactggtgtgaaatggtatctcattgtggttttgatttgcatttctctgatgaccggtgatgacgagcattttttcatgtgtctgttggctgcataaatgtcttcttttgagaagtgtctgtttatatcctttgcccactttttgatggggttgttttttttcttgtaaatttattgaagttctttgtagattctggatattagccctttgtcagatgggcagattgcaaaaatattcccccattctgtaggttgcctgttcactctgctggtagtttcttttgctgtgcagaagctctttagtttaattagatcccatttgtcaattttggcttttgttgctattgcttttggtgtcttagtcatgaagtctttgctcatgcctatttcctgaatggtattgcctaggttttcttctagggtttttatggttttgggtcttacgtttaagtctttaatccatcttgagttaatttttgtataagatgaaaggaagggatccagcttcagctttctgcgtatggctagccagttttcccaacaccatttattaaacagggaatcctttccccattgcttgtttttgtcaggtttgtcaaagatcaaatggttgtggatgtgtggtgttatttctgaggcctctgttctgttccattggtctatatatcttatttggtaccagtaccatgctgtctttgttactgtagccttgtagtatgaagtcagagacacaataaaaaaagaaaattttagaccaatatccctgatgaacactgatgcaaaaatcctcaataaaatactggcaaacctaatccagcagcacatcaaaaagcttatccaccccgatcaagtcggcttcatccctggaatgcaaggctggttcaacatacacaaatcaataaacgtaatccatcacagaaacagaaccagtgacaaaaccacatgattatctcaatagatgcagaaaaagccttcgacaaaattcaacagcctttcatgctaaaaactctcaattaactaggtattcatggaatgtatctcaaaataataagagctatttttgacaaacccacagccaatatcatactgaatgggcaaaagctagaagcattccctttgaaaaccggcataagaaaagaatgccctctctcaccattccttttcaacatattattcaaaactctggcgagggcagtcaggcaagagaaagaaataaagggtattcaattaggaaaagaggaaattcaattgtctctgtttgcagatgacatgattgtatatttagaaaaccccatcgtctcagcccaaaatctccttaagctgataagcaacttcagcaaagtctcaggatacgaaatcaaagtgcaaaaatcacaagcattcctatacaccagtaacagacagagagccaaatcacgagcaaactcccattcacaattgctacaaagagaataaaatacctaggaatacaacttacaaaggatgtgaaggacctcttcaaggagaactacaaaccactgctcaaggaaataagagaggacacaaacaaatggaaaaacatcctcatggataggaagaatcaatatcatgaaaatggccatattgcccaaagtaatttatagattcaatgctatccccatcaaactaccattgactttcttcacagaattggaaaaaaactactttagatttcatatggaaccaaaaatgagcctgcatagccaagataatcgtaagcaaaaagaacaaagctgaaggcatcacgctacctgacccagcttatttttctacataggatccccacatccctgcttttgctagaatggaaactagacaaggaccaacttttatcaacttgttcatttctctattcctagaacacagcctggtacaaaatttgcgtttaataatgtttgttgaatgaatttgaatgatggatttgtttagaaggtttataacatcccatgccttatgagtttgttgccagaggaaaaaagaagcctgtttttggttcataacatcaggtatgtaacctggaatttggaatcatgagtttttatgcatttgcttcatattatttatttttaagagatctttcaaagtattgacaaagatactttaagattgagagcctccctgataacccaggaatgagagttttagattaagtttacaatatgattgaaggctaatcatataaggagaaaaaaataagaaaaagaagagaaatttgaaaagaaatctccaaaatggccatggacatcagaacactgagaattcatacacaaaaatgtgttttgcttcatacctgtctgttgcacatctatacatttcatagatgcagaggaattttggctaaattcctaacacatgagaggcattctgcacttacttctcaaattagaattaacacatgagtatgtataagttgtttagagtgggcatctatttaatgagtttactggctgaatcttttaaaagaatgcaaacataagtgccttttatcaaaaatcaatgaaaagataaaaggccctgtagtgcatgctgtggttcccacactacatcccccacatccacctgatgtcatcacaactgtctatggtgtccatttgccactatgcaccctgccgggcagactcaggtgcctgcctcggcaaagaccctcagctcatgtgcaggtacagcctagaagtgcatgggggtgaacatctctgaggcacccttcaaccagtgagtactgggagcggtagataaatatcctagcctctcatctttctacacaacagtggtggtgcatattctacacagcttctcaaaggagcctcagagggattgggccccattagccactgtgataaccagctcagaacacacacatattagttgttctccctttccttcccaccctccccattccctgactgctagatccagaagtcatcttccagatgaactacctatatccaaatcctaatctctagctctggtttcttaaacaggtcctatgaaatgcttgaaataaaaggcaaaatggtttgtgtctagaatcaaaggctgacaatggcaagcaacaggcactaaaactatgacccaggaaaaatgcttttctggaagacatcggcattacctcctagacacggaatacactggcttcatcccagtagtttcttcacacactttagatacgtgtctcattaggatcacatatgactcacctgatttcatgccttgccttttctttttattctgcagattcttctaaggagcctaaattcaccaagtgccgttcacctgagcgagagactttttcatgccactggacagatgaggttcatcatggtacaaagaacctaggacccatacagctgttctataccagaaggtgccaccatcatgcctttctgattttcctctccatggatgtacctactaaagtacactgagtcagatgtactgtgggaatggaagtgatttgttgtgatttatgcaatcaatgaatattcattcactcatttattgaaaaaaatattaatcaagcccatcctatgtgctgagtactattttaggccctggagatatagcagtgattacaaaagacaaaatccctggtctcatggagatttccttccaatgcagggagacaggcaataaaaattgaattaaatgtcagctagtaatataggttattaagaaaaataaagccagaaagcagcatatcagcagtgtgtgggagtttgtgtatgtgcatgagaatgtgtgagagtgtgtcaaagtgtgagtgagagcatgtatggatacacgtgggcatgtgcatgtggatgagagtgtgtgtaaaaggcttgaatgatgctgaaatgcgtggtcctaggaggcctctctattgtggtgtcctagaccagagacataagtgaaacgggacaggccacgtgagtatctgggggaaaggctatgcaggcagaggaaattgcaagtacaaagtccctgaggcagtcttggcatatttgagggatgaaaaaggccagcactgaaggcacaagattgaaagtgaggagagtgatatgggaagggatcagagagttacttagggactgaccatgccaaacctcataggcaagggcaaggctttgaattttactttatttgtggtggaaagctgtaggtgtttttgaaaagatatatgctttaaaagatgtagctttgtttctaaccagataatacactccttctcttaaatatattcagtaaaagactgtagtactttttcatttttaccagtgaccctctaaaataacagaggaagggtgaaacaaagacctctcaatataggtaccatccaagttgtttatttcttccccttcacctggcattattttcatttttgtttactctcactgtgtatatttttcccttttttacattttaggcttaaacacttcattatctcctgttttccacccaacccccagagaaggcctaagccaagatgcagggttagtgaggaccctttatccttggctcaaggtgttcgttagtcagaggatgacattgtctatccaaccgaagagctggaatagggaaggaagatgcagccagcagttaagggtatgagctcagggctaacaaacctgcacttcagtgtagttctgcactttctcaccaaggaatactagggaaattagccagtttgtgtacaactcagcctcctcatttgcagaaaggagataatggacttgcctcatgacttcttgtgaggatcatatgagataacccatgaaaaatacttggcagagtacttgacacataataagtactcactaaatggtagctggtattcttcttatcggtagtatagtgataattttaaaataattatgatatagaaatccagttcctggactataaaatgactataaattgtataagaccatttataccagtaaattgttataattattttaattattggtataagagcattttaatgcagagctgctgcttaatttgcagataaaaaaatacttggagttagcaaccaagcagaccttccccacctttcagtataagagaggtctcttggatgaagtgaagtgaagatgaaatgtttgggcaccaagtatactatatttttccttaaggctgacaccacagagaggttggggccagtaaacagagttgatttctataaatacattcagacatgaagttagtatgtttgatgacacttttgaaatgtgtggaatcattaagttatttgtacaggcacaattagccaaactgtaaagaaaagtagcagaataacctcttaagctgggcccactttatgaaaataattttttgctacctcaatatttaccaaatttgatgagcaaaaagagaaatccaaaggaatgaagccttgataaatatatatcccttgccctcatcaatcagggtcacataactctgtccacaggcatcttatgcacactccagtcatttcagcatctctggttcaaatccaggatctacactaccaaggatgctgctgaaagtgtgactgggtaaagggaaacgttcagacatattcagaaagatgtcttagattttgccctggtagtgtttggaatcccaggagggtaagtacagcttcatgattaagtgccaacccaaacttacaaaattagatatttgtgttttttctataaaatataactattttgaatatcttagccaaactactatgagcccacagcccagtttatccaagaaggataaaactgagggattaggagtatcaggactggactggactgattagtgtacagttatatttgatttctcattgcccacttcacagagaagacaatacaaatgcactttctgactcttatcactgtttcttagaactcagttgccaggcaactcctgaaactatagaaacatgcttctcatccctgacacataaataaaactctgagatgattttatccaaagtcagagtcagtgggcagtgcagttgtttcagtttgctggcctggcctcagtatctaaagcacaacagaacgtgaacatgtcaggctgtcaacaggacagttcaggcacagccctacaggcagttgtgtgttttgcctggctctgctccttgccaggtggctggcagaaaaggcagcctccacatgttagagcagcagattcaaaacagtgtctgccatcctgtgatgacgatagtgccaaattcagcctctgagcttgcaggggactcaggatgaatgcacattacaggcatggtaaaaagaggctctgggaagcatgttcgagctgctctgctctcagctccttgcatgtaaatgctgtgtttttaaaggaagtgggcatgtgaacactcagtccttaaggctgtatcccccacctcttccatacccattcaaccccacttcaaaaattaccctggtcttaagagaaatttcattttctatacaaggttgtgtggaaaatcagtagggagaaagggcattattactttcatttttctttaacaaaagtattaaatttaaagccaaaaacgtgcgctttctgtcatgaaaacagctgcccttaaaaacataaatgatgttttatttttattacttttatctagttggttgtctttagatgaaaaacatttcttctgctctttattcttatttttaatgatagtctctttctatggttctcaccccttccatttcacaagatagtctgggagcaaacctaaagcacttaacttttgggagtaagagcagaggggagcttccatacattgattttggtcatctgtagagacattcaacccagagaaggcaagtgacacagtatctgttttatgagctaatttgggttcttgtctacatttaatagtttaaaatataagttataaatatttatttaaaatgaaattcaacattggttcatgaagaaagaggttggaagtagtgttttgaactagctgtttctgatccatcatgcttaaaataaatgctctgtttgtcctgtggagttcatggatttgggataatctaaacagggttttttaaacagtcctcatggggaacaaggtactgacatgcactgttgagaaattctgtgaatcatgaaagagctaatcttttagaaatccagacctgttaagcactaatctacatctttggaatatcttaatactttgagttttctaacttttatactatcacttatgctaagtacatttgatatcccttctattatgtgaaagcctcattttctgggcaattttcttacaactactctctttaatgcactcttacttaatttgaaagtaaatatcaaattaagcatactatagttcaatgaaccacccacctattcctaatttttttaacatttctcttctgactctacatacacacatacttacacacacacacacaaacacaccttatcttttcttctgccttttgcccatttactttttgcatcagagatgaatctctcattcaagcatatgcaactttttttttttttgagatggagtcttgctttggcacccaggctggagtgcagtggctcgatcttggcttactgcaaactttgcctcctgcgttcaagcaattctcctgcctcagcctacctaccgaatagctgggattacagaagcatgccatcatgcccagctaatttttgtatttttagtacagatggggttttaccatgttagccaggctggtctcaatctcctaacccatgatccgcctgcctcagcctccgaaagtgctgggattacaggcatgaaccaccgtacccagccagcatatgcaacttttaagagtctcaaccaaagcagcaattcactgtctcagaccctggagtctctgccatttaaatcccaatttccttccaacagctgaggagcagctgtctcaaggaccctctgatactacacaagttttctcctagtgccaagcagaccagcctgagaaacagctataagaaggaaataggcgtcttctcccagcttggcatcctttccttccaggccctgccttccctacaacctgcattgtcttcattgtccactgctgcccagcacccatcccacagagggatggtcccaaacctccacagtctggcctgtgagccacaggcgcctctgcctgcacagggccattcctacctcatcttccacaaccacagattacatggttttatgtccctttgacttatatattgtcttctcaattaataggctagtgaataacatggagatgatgaactacctcacccaagtagcaattctaatttaagaaaattttcctgtcattccattgccttttacttccattaccacactcatgcccatacttccttacctcaatccctttgacctctctgtttattcccttccttgccgtattgccatctattaaacttttacccatccttcaagaatgctaaaaacatacctccaccttgaagccttccatgaagagccagagcaatcattccctcttctgaacttttaaggaccctagagagcactactaatgagcacttacccacattgctttgtaatatggttttttactctttccttctgaggcaggaggaattccttagacatctatgaatcccatagtgtctgtcattatgttttagacataaccaattctcattaaatgtcaatagaatgaatataagaggcccaaaaaactactcagatgggaatttgagtcttattttagcctgaaattaggggaccacatcttacttatctttatatctgcacagcgttggtgctggatataatgcatcactctgcctggagcacacatcaacttgtctcctcagtttctttcaccataggctggtgaaacagccaggtctaaaccttcactgttctctgggaatctctagtttgggggtgattctctgtactgttttaatgaacatttttaaaatgtccctaagtctcagaaccttcatctatacaactggcataataaagtacctaccataggaatcgatttatgagcaggcatagcatattcattcaataaacggaagttttaccataggcagaagtaccaaacggcctcgtagcagtcgtcagacactgatgatactgtccactgatgtgatatgtctcggaaatgatgttactaaaatacctcttcacaaaatatttgtcttccaatttattgaatcagactatcaagcaccttacttggacttaagctacaacatgatttttggaacaattaatctttttttaacccttcattttaggaacactcaagaatggactcaagaatggaaagaatgccctgattatgtttctgctggggaaaacagctgttactttaattcatcgtttacctccatctggataccttattgtatcaagctaactagcaatggtggtacagtggatgaaaagtgtttctctgttgatgaaataggtaaatcacaggtttttgtttcatttgacatagttttagactaaataaatggggaagcctgcaaggtccaagtataatcaagtaggaagactttgtaacagtgttctatagatacatggagatctgttttacaggagatgggatcagctggtgaacaagaggaaaagggcagggggaacttaagttgactttaacataaagtagcctggcagtaaatgttgtgaagaagagaataggaaccttgtggagtcttttcctttaggatatctttgaagctgcgttgtgtttttatgttccactgcaaagggtgaacttaatatattcttaggatttcttacttcctaattatttgataggatccttatattcaaattcactgaaatacgttggcctttgacctctaccattgctgtaatcaaagcctagattttctttatcacaaagcataatcattctggaattttacatttacaaaacagccacagttactttaaagacatgtttattagatctcagaacaaatactggagacaatcagctcagtgaactaagtgaaagatccaaacagaggatcctttgcccatcatatggacacaaggtggaaacaaaacaaataaaacaaacaattgtaattagaatagtcatgtttataccttaatagtataaatagcaaaatagaaagaatcaaagaaggactttgagtagctgaaattagtgcctcaaaatctatccacaaaagctcatttgttgcttataggaatttctcgttgcttctcccaaatgtattgttctttttatgtggttttctaggcataagctgactggaagacataggagtatgtggctagaacttacagatagaaacaaataaaatctaataggctgactttaagggagaagattaagagaactgtatcaagcagtaaagataacccaattgctttgcaaagacaatttagtatgtgtcctaacatcactgggtatagctgttgagttgaaactaaatgggatagcagaatgggatagtagcaagaacactgggttaaaacccatgttctagccctgttctctgccaatagccagtcctactcatttacctggctgacatgcctgtcatgtgtcacgcactgttctggtggtggtggttatagaataagtacaatacagtcaaagagggaagtcaggcatgttcacaaataattgcagtgcagcgtgataggtgttagcctggaaatacgtggaatgcagagctgcaaaggtggtggccaaaggcgtgaatgactgacaggcctgagggatgaggaagggctgcacagagatggtgacagtttagttacctctgaactggaattggactctccctatttttaaaaaagtgatgacccacagtggtcaaaagcatgagtgagtattgtcaggtaccacagtggacttgcctttcagtaactactaagttccaacagtaacttagtagttacttagtaattacaacagtaacttagtagtcccaacatgttcagggactcaggagcagttaggaagccctcctagtcagctggagaaatcatcagtagttgtttgtgccccaaaaaggaatttggactttaactgtcacgaggtacctttgaggatgtttaaatagggaaattacttgaggatactaatagttaacagtcacaaaagtcttaccatgtgtcaggtataaaaaccatcttttgcaatcacactttacagataatgaaaccgaggcacagagcagttaaaggactagttcaagtcaaacagctagtagatagagctgggatttgaacctccagcctccatgctcttactcttgaggctttgcagtaccacttgtctctttattaatgctcagagaaattaatcttgttgcaatgtgaaacgtagattggagtgggacggactagaggtagaagaggttaaaagactgagatgatcaaggtaaaagattatgacaggtagctacaactagcacaatagttgtggggcaaggtgctgagagtgaaagagaacaaagaactaatgtaaccctggtagatcttgagaaagttgtcaatcattataagcctcagcttcctcataaaatatgtatgtatggtactacctcacagggctattctttggatttgaagtactatattagttagacatttgtcattcattcaattcattcagcaaatatttattatgctcttctctcaggccagtcaatgttctccatgctggggatagaaactgtcttccctggtgggatttaatcccaacgaggatggaaagcgacaatgctatggagaaatataggaaaggagaataggagtgttggagaggttgcagtgttgagttttcaggattggcatccctgaggcagtggcatttgaataaagaaggattggagaggataattatgtgtgtgtctcagggaagggcatttcagcaagggggcacgccagaagaaagatctcaaagtaggagcatgcttttcctcactcaatgaacagcaggccggcggtggagtgggcacagagtgagcgaggagactggtatgagaccaaatcgcacagacaagacagtcaaatctacccaaccattgccaaagactttggctttcacttggagtgaggtaggcagcctttggagggttttagatgatgagcgatgtgatctaacgtaagtgttaggataatcactgtgtcagttcgcttgaggattgcatggagaatagactggagggggacaaagaccaaaggggtacagtggggagacaaatgaagcaagaagaatgaaaaaggataatggccaggaccaggttattagtggtgcaggcggtgggacatggttggattctgttatatcttgaaagtacagctgacggaatgtggattagtgaggaaaagatgagccaaggacaagttcattgtttttatcctgagcaactagaggaattgagtcctcgttaacagagatggaaaagaggaaaggagagcaggttttggagaggaagagcaagggtttgtttggggatatattaagtttcagatattttttaaatatctcacaggagttgtcaatatagcatgtagatttatgtatagagataaaggagaggtcattattatgcctgtaatggtatctcacaggaggtcattgttatgcctgtaatggtggtaccaaatcttttccaaaaggaccttgtctcatatcctctatttttcaaatgcagcataagtaatgagttatagaaaatcttccattaaaaacaattttatagtttggtcactttaaacggttaagctttgattatcaggattcctgaatctccaacaaatccagaagggtgaggaattattgccattatatcggcatatgtagtttggccattttgcatatccttccaatttaattttcaaaatgtagtcatgattcatcaaattttgactctccctgtttttaaaaaggtggtgtcgaccccacagagggcaacagcatgctcctccaccataaggcctgttttcactgtgggtgcacacaagagcttccctctttggccaacagatttgacagccagtaagagctcctcactgtgtatatctgtaaagttatctccagtcaacgctagggatgcacactctgcaacactctaggtggccttctgtatatatggcagaaaaagaaagtaaattttactctgtatctgcaagtgattttcaaaaccctcagtaatgagatccaactagcaaaaatttaccaggaactctctagaatataaatttagacatagttcctagctttggaatccatatttttcttcatcagcctctgagaaattgtggtctttgaggtcctactaagcagaatgcaacaaattttcgtggaactgtagagtatatcaatagaacctgaggaaaacaatgtttcaagttgttcatgtgacagtcaaaaagacagaaaacactgaattgtcaccatttgtgagactagcataatgctttcttccttcttatgtcagaagaaaatatcacatgtggctaggaagatcacaaagctagggagcattagcagagtgtgcaggaagattgtatgagaagattgaagaagagtaaaaaaggataatggctaggaccaggttatagtggtgcaggcggtgagatatggttggattctgttatatcttgaaagtacagctgacggaatctgacggaatatggattagtgaggcaaagatgagtcagggaacaacacagaaatgaggtaaacagggtctctgcccccaggccatacatagttgcaagaaaaaaggtttctctacccctagttccgaagcagccccatgtctaaattctgtaagtctttctgactctctgttttttcagtttcaagtgaaaataaattcctttgccaaaatcctgatgcatttatgatatcagagcaaaaagaaatatacaacatggcagatcttgtaaatagtgatcagatgttttactccaaaaggaatttttgtaagggcttatttagaagttaaaaacaagtcatccttgagttaaaaaaaaaagttactctcttataaagtgaaagttataataagaaaaatattggaagaaataagagcatgaatgatcaaaaatgtagaaagtaatttggtcttctgagaagaatgccttccattaatattaaattgtgtctgtctgtgtactaatgctctgttgaattgcacagtgcaaccagatccacccattgccctcaactggactttactgaacgtcagtttaactgggattcatgcagatatccaagtgagatgggaagcaccacgcaatgcagatattcagaaaggatggatggttctggagtatgaacttcaatacaaagaagtaaatgaaactaaatggaaaatggtaagatgttgctacaccttacactttgacttttctttctatttcaacaaactctctctcatttatcattagactttcctttgacctaataccacatgttcatgctgtatgctccataatttcttaattgagaaaacattatttaaccggtaaaatattgtcttgaaattctgtaagacaggagatgcttatgtatatatggaggcctgtggaaggaaaggaaaactatttctccattcattcttgctgtccagtttaactttagagcaaaattatagactggccacttagctgtctttggggatgtggataaaaatgggaaagtttgtgatccagtcaacagtgactatggccaaatattttcccatgatttcagttgctgctactcaaaggactcccactaaaacaaattcatacgtgtctataggaaaacagagggagggaatttgtctcttagaggtttcagaaggatgttttgttacatacctcagagaagaatcaagctgagattcttatgtaggcaattagagagcatggtaccagttgacctctgaatccctctcttccttaccaagcatatggaactcagcattttgataaatttcacatggcacataacaagaggaaaaacaggagtatcatgctgctcccaatataactaattctaaatctgtctaaccacagccacagccacagccacagccaagccaagcagtttctggccactcatcaggtgatgcccagcagcctggcacagatcactcccagaattttgagacaccaggacattcagtgagccactgaaaaagatgccaattttgtcattagaggaaagttaagtttggaggaaatttgagtagttacaatactgggctttgaggctctattttctgaatcattttaatttagatatctgttctgtaacttggtacaaataaaatgcctgattggatgctaagtcaaacaagactgtctaaatccaagctacaatcaaacattatttaacaacaggtactgaaataactactatgcagaaggcactgtgctaaatgcctgaggtggcggttctcaaagtgggagccacagacccttgagggtccctgagaccctttcagggagttcagtactattttcacaatacactaaaatattattttattaactatgttgaaatttaacttaatggcacaaaagcaatgctggaaacactgctggcaccttagcatgaagcaaggcagtaggatcaaattttactaatagtcatgcactcccaatgaagaaggaagaaaaagccagtttcacgtttgaagttcttgatgaagctgtaaaaattgttaattttactaaacctcgacctttgagtacatagcttattaatattctgtgtgacatatgggaattacacattaagcatgtctgctgcgtactgaggtattgtatttgtcttgaagaaaagcgcttaaatgactgagttgccagctgaactagttgcttttattgcttggagcaccatttttacttggaagagccattgataaactggcagatggttattcatatttgaattggcaaacatttgtcaaaaaagaatgaggcaagcttgtcgcttcaagaaaaacaactgacagtattttttgcaatggaaaaaatttgacttttcaaagcaattcattttgcctttttcgaaaatttgtgtctccaaccgtgagcttgatagtgttttaatatttgaagacttttcttgaagagattgatggtgatattaatgaaagtgactttttaattatattgtgtaataaaatgtatgaacatttagaaaaatctacaactcagttaaccaatattttccaaattactaatacatgatgtaatcaaatcatgcatggggaaatgatccattcaaagtactagatagaatcgtgaatttttttaatgatcaaaaatttttttgtatatttattgtgtacaacatatttttttgaaatatggatacattgtagaatggttctatcacactaagtaacatatgcattaccacacatacctttttttgtgtgttgagaacacttaaaatctactcagagattttcaaaatacaatacataagcattaactatagtcaccattttgcacaatagatttcttaaactcattcctactaactgaaaattttaattctttcatcaatatctccttaactctgcaccctgcccacaacccctgataaccaccattcaactctctgcttctgagttcaacttttttagattctgcatataagtgagattatgtggtatttgtttttctgtctctggatcatttttcttaatataatatcctccaggttcatccacattgtcacaagtgacaggatatccttctttttttaaggctgatagcattccattgtatatacctaccacattttctttatccacttatccattaatggaacataggtcgattctatttcttggctgttataagtaatgaacatgggagcccagatattctggctcaacatactgatttcattttccttggatatatacttagtagtggaataatataatggatcacatggtagttctatttttaatcttttgaggaagcttcatattattttccatagagggtatactaatttacactcccaccaatagtgtgcaagggttcccttttgtccacattctcaccaacacttgttatctcttctttttttgaaaatagccatcctaacatctttgtgcactctatgccttctgtgagctgatagctcattgtggtttaaatttacatttccctgatgattaaagatgtcaagcatttttcatatacctgttggccatttctatatcttctttttaaaaatttatattcaggtcctttgcccattttttaattgggttattttcttgttattgaattgttttagttccttatatatttcagatagtaacttcttatcagatgtatgcaaatattgtctcccattccatagagtgtctttttactctgttgattgtttccttggcagtgcagaagctttttagtttcatgtaatcccgtttatctatttccacttttgttgcctgttcccaatggagtcatatccaaaaaatcattgcccaaaccaatgtcatggagctttttcctatattttcttccagtagttgtacagtttcaggttttacatttaagtctttaatcgattttgagtttatttttgtatatgaggtaaaataagggtataatttcattcttctgcatatggatgtccaattttcccaacaacatttaaagacagagtcctttccttactgtgtattcttagcacctttgtgataaatcaatttactgtaaatgtgtggatttatttccgaacactttattcttttacattggtttatgtcatttttatgccagtaccatgctgttttgatgactatagctttgtattatgttttgaggttggtagagtgatgatttcatccttgttcttcttgttcaagattgctttggctattcatagtctattgcagttgcatacaaattttagaattgctttttctatttctgtgaaaaatgacattggaattttgataaggattgcattgaatctgtagattgctttaggtagcagggacattcgaacaatattaattcttctaatccatgaacatgggctatctgttcatttatttgtgttgtcttcatgttttacagttttcagtgttcagatctttcacctttttgtttaaatttatttctaggtcttttattttatttttatttttatagatattgtgaaagggatttctttatttctttctcagattgttccttattagtgtatagaaatgttactgatttttgtatgttgactttgtatcctgcagctttactgaatttgtttatctgttctagcaattttttgttgaagtctttagggttttctatatataaaatcatgtcatctgtaagcaaggacaatttaactttttccttctcaattttggatgccttttatttctctcttttgcttaattgctctgactaggattttgaatcgagtagaatagagtagaggagttacattgaataaaaatggcaagagtaggcatctttgtcttgttcctcatcttagaagaaaagctttccacatttcactgtttattatgatgtgagtttgttatatatggcctttattgtgttgaaatacattccttctatatctaattgttaagggtttttatcatgaaaggatattgaattttgacaagtgcttcttctgtatctgttgagatggttccatggttttcgtctcggttctgttaaagtgatgtattatgtttatgtatttgtgtgtgatgaaccatccttgcatccctggaataaatcctacttgatcatggagaatgttccttttagtgtgcttttgagttagtttcctagtattttgtttaagatttttacatctgtatttatcagagatattagcccataattttcttttcttgtagtgtcctttcatggtttgggtataagggtaatgctagcatcaagaaatagtttggtagtatccccttttcttccactttttggaaaagtttgagaaggattggtgttccggtgaagcttccagtgaaactgtcaggtcctggacttctctttgatgacagactttttattactgattcaatctccttacttattattggtttattagattttctatttcttcaagaaagtcttagtaggttgttgtgtgtaggaatttattcatttctcatgcatataatttttcagaatggtctcttatgaacatttgtatttctatggtattggttgtaatgtctcctccttcatttctgattttgtttttaatttgggctttctctttttttattatttagtctagctaaagattggttgattttgtttatcttttcaaaaaaacttgtttcattaatcttttctactgttttaatgtgctaactgaaaagcacattaaaaggatcattctccatgatcaagtaggatttatcccagggatgcaaggatggttcatcacacgcaaatacataaacataatacatcacattactagaaccaaaaacaaaattatggaaccatctcaatattttctattctctatttcatttatttctgttctgatctttattatttccttccttctatgaactttatgcttagtttattctttttctggtttcttcaggtaaaatgttaggttattcatttgagatctttgttttctgatggaggcatttattgccatgaacttccattgctcttagaacgacttttactgcattccttaaggtttgctatgttgtttccatttttgtctcaagatatttttgattttattttttactttttaactatttttttaggttcagagatacatgtgcacgtttgttatataggtaaattgcatgtcacaggggtttaccatacagattatttcatcaccaggtaataagcatagtacccagaaggtagttttttgatcttcaccttccttccacccactaccctccagtaggccccaatatctgtggtttcagtcttcgtgtccatgtgttctcaatgtttagctcctactaataagtgagaatatgtggtatttgttttcctgttcatgcattagtgtgcttagcataatggcctccagctccatccatgtgactgcagaggacatgatcttgttcctttttacgcctgagcagtattccatggtgtacatataccacatttcctttatccagtgtaccattttctttattccatgtctttgctattgtgaatagtgctatgatgaacacacgcatgcatgtgtctttatggtaaaatggtttatattccttcaggtatatacccaataacgggactgctgggtcaaatgacaattctcttttaagttctttgagaagttgctaaactgcttgccacaatggctgaactaatttgaattattaccagcaggatataagtgttcccttttctttgcaacctcaccagcatctgttattttttgactttttgataatagcctttctgactgctgtgatgtagtatctcattatggttttgatatgcctttctctctaattattagtaatgttgagcattttttcttacacttgttggctcatgtttgtgttcttttgaaaagtgtctgtttatgccttttgtccattttttaatgggactgtttgtttttggcttgttgatttaaagttccttatagattctggatattagacatttgtcagatgtatagtttgcaaatattttcagccattctgtagattatctgttttttcagttgtttcttttgctgtgcagaagctctttggtttaattagatcccatttgtcaatttttgtttttgttgcaattgtttttggcatctttgtcatgaaacctttgctaaggcctatgtccagaatggtatttcctaggttttcttctagggtttttatagtttggggttttgcatttaaacctttaatccatcttgagttgatagtcgtacatgttgaaaggaaggggtccagtttcaatcttctgcatataactagccagttacccagcaccatttattaaacagtgttttcctcatttcctgtttttgtcaactttgtcaaatattagttggttgcaggtatgaggctttattttggggttctctgttctgttccattgatctatgtgtcttcttttttaaccagtaccatactgttttgattcctgtagccttgtagtataatttgaagtcaggtaatgtgatgcccctgggtttattctttttagttaggattgctttgactatttgggctgttttttgcttccatatgaattttacaattgttttttctaaatctgtgaaaaattacattgataatttgataggcattgcattgaatgtgtagattggcttgggcagtatggtcatcttaacgatattgattcttctaatccataagcatggaatgtttttccatttgcgttatctgtcattttctttcatcagtgttttatagttctacttataaagatatttcacctcctttgttaaatgtattcctaggtttctgtgtgtgtgtgtggctataataggctatgttaacctgataacaatttaactttcttgcataaaaaactctacacttttactccacataccgcccccccaaacacattttaaatttttgatgtcacacttacatctttttatattgcatatttcttaacaaattattgtacctagtattatttttaataattttatcttttaaccttcattctaaaataaaagtgatttgcatattaccatgaaaatattagacaggtaatgtgatgcccctgggtttattcattttagttaggattgctttgccaattgggctgttttttgcttccatatgaattttacaattgttttttctaattctctgaaaaattacattgataatttgataggtattgcactgaatgtgtagattggcttgggcagtatggtcatcttaacaatattgattcttctaatccataagcatggaatgtttttccatttgcgttatctgtcattttctttcatcagtgttttatagttctacttataaagatatttcacctcctttgttaaatgtattcctaggtttctgtgtgtgtgtgtggctataataggctattttaacctgataacaatttaagtttcttgcataaaaaactctacacttttactccacatactccacacacacacacgttttaaattttcgatgtcacacttacatctttttatattgcatatttcttaacaaattattgtacctagtattatttttaataattttgtcttttaaccttcattctaaaaagtgatttgcatattaccatgaaaatattagactactttaaattggactgtgtacttacttttactagtgagttttatactttcatatgtttttatgttactcattagcctccttttctttcagctaaagacctccctttagcagttcttgtaagataggtctgttggtgaggaatggttaatttaaatataacaaagtacaaaaagttcatcagtagagtttcaggtttcatttttccactaacctgtaagaatttatcatttgagttttagtctattgttaaacagaaatgttcacaattatgtgaaaagtttattaaaatattcctcattttcctcattatttatctgtgtgaggccaggttttattcatttacgaaaatagcacattctaatagatttaattcagaagcagttataaaaatacagtcatcttcctttaagtctgacattaaataaatttgcaaaaatgtaaaacagtatcactcttctcactctcttttttgttgtttgggaaagtacaataatttttatgaaaatatattatttaacaaaatcaatttattattttcagtttaaaaataaggattttaaaattttttcatttcaatttctaatactgtaaatagtgataggtataacccaactaaaccaaactctttaagattctcaaatttttaagagtgtaaaggagtcctgaaataaaaaagttaaacaacctagaaaaaaacaaagatataaatcagcatgttagcattcatcaattcagttaccatcatttcatccctaaaagccatggcatatagttacgtctcactgagccaccactttgaaactcccaccctgtgccaggtacttgtgagcatgtaactttgttaatcaactgttcagggctatatcccaacatggctttgttgcacttttcgtggcacctctgctaaatctcgttaggtagaccaaaggggtcagttaactttttctttataccttttattcatgatatttataagtttggtaatttacaaaggtcttggacaaagaccaggggcttatatataataatttatttatctcttgaagaaacaaacaatataattggttatgaagcacaggcgtcataagcagaaaacaggtttataggtaaagggggaagacctagtgtgtgtcgcttgcatcaggaattcatgttaccatttggcaatatgaatttgcttagcagtgtgcttttttttctcccccccacaggatcttgctctgtccccaggctagagtacagtggcccaatctcggctcactgcaacctccacctccagagttcaagtgattctcgtgcctcagactcctgagtagctaggattacaggcgcaagccaccacacccagctaatacagctaatttttgtatttttagtagagacagggtttcatcatgttggccagactggtctcgaactcctgacctcaggtcatctgccaacctcggcctcccaaagtgctgggattataggcatgagccactgtgcctggctgccctttttagtaaatacattttgcatgaccatgtggttgtttacagctatttatctagtaaaccaataacttacagctttttaaaggcttaatgaatagcatggaattattcatgatatctgtgccatatcttgaggacccactgtatacctgatattgcactggactttggaaatgaaaaataatgagtgatcttggggaatttacaatgtaacatagaaaggtgtgtatcactaaatttgcacaatgaaacataattaataatagaagaagtatattatctggcagaatagagtggggaaaagtaccagcaaagacttagaataccagctctcctcaatacttgcacttagacttggatgagaaacagttccccgcacaggcagatgacagggttaggtatgataggagccacgtaagtaggagccactcgaaatctgagtttggtgtggctggtgtggagggttgagggaatatgaagagaggaccacaacttgaatcactgagggcccttttttgatcctattagtgaaatctttaaagaaattgtattggtgacaataacagagaaataagggctttgaggatgaaaacataggctttaaaaaaaaaacttaagaaaaaaataataaagtaagttcagtattcagtgtcctgccttaaagaaagcattttaggcatgcaaatatcccatatattcagaggcttctataaaaaatacaaacaaaccctgtcatatacacatgaggcaaaaaaagatactttgtgagtagaaactattgaggtaaaagaaaaacttgttttagaagctgaaggcccagctgctgacttaataaaacaaattatgagaattttgtttatgcgaaaatccatgctgttgaaaacgcgagtgtttaaagttttctataaacaggaacaaggtgttctaccaaaaaaaagtataaaagcacattgaataactgctttgagtatttgacttggaggaaactaccatcactagttgagtatacctctttgatagcaatatgtgttaaaagtctaacagtctcactctacccctccccgagaaggtaaaggaatatcctgaccttaagggttgtgagacctagatgtttcttaccaaagaactccggtgacttttctttgcagattttaaatagcaaactattttatggtggctttaagccttccagagcaagcagattaggtatgtagttccttttaataaaagtatttggaagttcaataaaggcaattatgatttttctaggaccttttccaattctgtgattatgtgaatgactacccggaatttccatcaaacactgatatacaacttgctatggctacaatttattttggtgtgaaaacatgtttgcttttctgttcttatgtctcccttcatacaaaagtataatatcccagatatgtaggcatatagttctgccattcagagtaattctaatatactttaatcttattaactatctggaagactaatgcacagttatagctgcatttctttaagcaagtctatcatatctttgggtttatgccaaactaaatttgtgaactattatccatttacaaaatgattatttacatcaatcttcctttaaataacaaatgctcacaatgcattttaaaatattacctactttataaaaatccattctgaataaaaatgggagaatacctgtagtgttcattgcattgagttgttgactctttggccaatatgcgtttatattttgtcttgaaagatggaccctatattgacaacatcagttccagtgtactcattgaaagtggataaggaatatgaagtgcgtgtgagatccaaacaacgaaactctggaaattatggcgagttcagtgaggtgctctatgtaacacttcctcagatgagccaatttacatgtgaagaaggtaaaagaaataaaagattaaaatagtagctaacctggcttttgtcaatataacagttgattcacccctgcactggtagtgtgttgtccaaatcaaaatatattaacatcagatatcaggatgagagaccttgagctcactatctgtaacagatattgttcattgcaaaagcagaaggaagatttagtttccaaatttttcattcaggagaagtccggggggcaggtggaagtttagagacaggaatttggtggcaatctccggatggtagaattcagatgattcttttctttatatatttttatatttctgaaattttctatagtaagtttgttttgaatttataatcaggaaaaaaagctgtactgatggttagggaagaaagtatgtatctatatggatggatagatatgtgacatctaagaggaaacccaatattgagtcagcataggtagtcaacagcaggtgcatacggttttagaaagcggaggtgtggcttttacctagaggaatgcctaataagtagtgtggcagtcatacttaaaggagacgtggaacatttgaaaaccctatgtaggagaatcacaacaatgattaaagtttttaaaaatgggacctatgaatttagaataaaagaattaaaacttttagatacagaaataaagaaaactgattaatgatgagcagaaagtatagagtattattattctcaaatgggaaatggctctattccatcttcattgaaaacagaagtttacagggctatatgtttgttaatgaaacaaccacaagctacatagaaaataaatttatatttctgtatttactatacaggtagaatctcatgatactaaatagcattaggatgaaaatttctatagcaccattttctctatactctagttaactgaattcttgtttccaaactatttgatattatgcaattctggccttaaaagtacaatagctatacacccttaagcttagtgtagtggcatttaattcacttaacatatattttttaaactgccttttccttctgttactaacaaaaaagaagctctaactttatgttattttcctgaatatgtcattgatatgaaattatagacactacaagacaaaaaatgattttttctcccccaccaattctttaaaatgcttataatatctccctaggggattttaataactttttaaataagaaaagactatttcagcataaagacctacattttaaatggcaatgttaaggtaaatttcatctgtcatttttataaaaaagtggttagcctctgcctctgtggtaagaatactgggtaccaactgcaaagtagctggcaggtactcaatcttaaggaatgaaatagaagttttacaaacaggttcccccaagtctcatacaaagtatactaaaacctgaagatgggagcctcagtagtgatctttctgtcaattttatgtatataatatacatgagatatatttattatattttaataatttaatttattgatataaatacgtatatttatagctgtaaaatatatgttatttgtgtctaagaagtttctgtcatgatttatcaataaaaactctgccttcatctttttgataaatcttcaatctggaaactaagaaaatcaccacacttaaaaaaaaatagaaaagaaaccgagtgggcattatttaggtagtgtgttaataagcaacacttttttactgaagctgaaacctttatgatactccctggacacatagtatgcttaaagcagattgtttgttttcataaaacacacattgattttgaactatatgctgtttctttattttgaagtttttttttaatgtgaggagatttgaaaagtggacagagatgttcataaaacagaaaaaaactaagtcgttgcattctgtttcagtggttatcaagagaaatcactgactttattagatgaatacaaattatgaattttttgtgaaaagggaaagggaaatgtaaactgtgcttcaactattcgtaattctgaaagcgaaatattcttgtgtgtttcagatttctactttccatggctcttaattattatctttggaatatttgggctaacagtgatgctatttgtattcttattttctaaacagcaaaggtaggtgtggagtagtattctttggtattttgtaccagttgtttagatttccatatgtgtttctatttgttatttgatattttctttgtcaaattatgagtggaaattttagttaacctagtacacttttatctccagttatatatttaccattcatataaaactcaatttgttgtatttatcttagacaatttagaggtttagattctatctggagacttgtacaggacattaagaggcttaggctggtgactatgcataccttgtgatatgtacctctttatccaagagctagctctttccctcaagtcctcaacaagttgacccattcattccaggacttcaaagtatcactgagcctttggctgagtctgatacagtccttatatacagacaatttttttttttccttgagacggagtcttactctgttgcccaggctggagtgcaatggcgcaatcttggctcactgcaaccgccgccccccaggttcaagcaattctcctgcctcagcctccagagtagctgggattacaggcatgcgccaccaagcccagctaattttgtatttttagatacagtttcaccatgttggtcagactggtctcgaactcctgacctcaggtgatctgcccacctcagcctcccaaagcgctgggattacaggcgtgagctaccgcgcctggccccatttaaggtatttttaaagtcccaatggttaatcttgttgcttctcctagaattaaggtgactaacactcccaggttgcctagaactctcctggtttttagcaatgcaagtccggtgtgccaggaaatccctcagttccaggtaaccaagacagttgatccccttacctagaattgaaaatacgttctccagctgaagccaagaggcatctataaatcaaaatgagatctatgttaatatattttaaaagattttactttgttttgtaaggtagtatagcacttgtaaacttcaaaacagaattttgttaggaagaagaattattgggacgctagatttctatagtgtcaagcatgctaaaagtctaactgaatgcagaaagggttattttcagtagagcttcatgtccaattttataatataaaccaattggaaagtaaaattcattctgaattccattttgcacctaactttctggcaacattcctgttttccaaaaaagcagctatcataaatcacaacacaattttctattgtttcaggaaaataaataaatatatttttagaattttaatttgtgtatttaagtaatgccaacaacaaaaaagccaaattattctgttgattaatttcagtttattaatctatatatttggtgggaaaatttatacataacttcagtagataaactcacgaggtatgtaaagtaattagctcttagtattagctgtgaatttctagccattgtgaaggccaagtcaatttgttatgttgtttagttatattagttaacaatattaggaagaaaaaattatcctctcaaaaagtaggatttccaagaaaacatattacttctaatacagtgctttttataaataatgaaatgcttaactataatgtttagtcaaaatcaccaaattctacaattgatttgaaatctttattgttctcccaaatttcctgcactaaattgaattttctgtaggaaagaattaactttattttttatttgcccattaaaaacgcttatcattgtctaaatttgcatgttctactgaaagtgggaaatagtagcaaatatttgtcagcaagtatggacagaacatgtagttccaacaattaaattgatactgcaaagaacgagatttttcctagaactgtagggctgtaaagtggcgtcaggtcctacatgcctttgaaattttctgagtccacaattcattatccaacccacttcaccctgctttaatccagttaattgagtcaactctagcaaaatttataattttatttgtatctgatacaaaaccacaaacatagtttcaagtcaggctattattatactggttcctaccacacaaccctcccagcctttgagctgttaccaattgaggaaagaaataactgaatcagcctaaaatagaatttccaaaccagtagcgaaattcagcctacagattcatattttgttattttattttaattagttttgatttcagagtgaagattttcctacaaagtgtttgtaaaatagagaattttcacacaaaaatccagatttggggattatcttttaaaaaatgaaagatgtagtgaaactaaacaaggcagcatatgctgcagcagacaaccagctatcctatttgggattggctcacattctttaatttgccaccatcctcattcctcctaatgactttgcaactggcttgctttattcctctgcatgacctgcttgggcctcttagatttatgctctgccactgtggcataaggtcactacaaccactagaaaaccactagcgcatgcctgaatgcatcatcctatttaaaaaggaaaagcacacgtcacaaagtcaaacatcagccatttggaaacctttgcttcctgtaattagaattatgttccatctttttatgtttttgggaatttgaaataccaatttcgagatgcagaatcaaaaaaaaaaaaacaaaacagcgaaacagcagcatgacacaaagaacctgggttttgatttggagtcaggttctctgggtttgagccccaactgtgccaactatgaatgcatgatttgaacatgttgcttaattttccaagtttttgcacagatatatcatctgcctccctgggagtcataaggattaagtgaaatgtttagtgcaggggtcacaaacttatttcatagagttagagtacatttttaggcttttcaagccatacagtctctatcacagctactcaactctgccactgtagcacgaaagtggccataaacaaaatggaaatgaatgaagatgcttgtgttctcataaaattttatctacacaaacatgtgacaggccagatttggcccacagaccttaatttagtgacccatagtttagtgcaaagtatatcccacagtgtctgatttatcagaagcactaaaaaatgatagtagttattattaataatttgtattacttatttctatatctgtaattcatcagtaacaatatgctttaacatttgccccactgagtagtagaggctacttaatgcaatttataaaatggatttttgcttattacttggattaggtaaaatagcaagtggaaatactgagaaaatgtactccttatggaatggactggactgaccattcacactgagtggaatagtaactgatatccaaaaatctggttaccacctcttcatgacagtgtcatctctgaatagtcaggagttttttaaaaaattaaatgaattgtttggaataatctctgagcctttttccagtgctataatttgattttaaaaaataaactccaggccagatacaatggcttatagcatataaatccagcactttgggaggatggggcgggagtattgccctgaggccaggagttccagacagctcgggcaatgactagagcaagactccattacaaaaaatgaaacaacaaaaattagcacaccctgtagtcctagctacttaggaggctgaggcaagaatatcgcttggcccaggagtttgaggctgcagtgaattatgattgcaccactggactccagtgtgggcaatgaagtaagaccctgtctcaaaaagttttaaaaaaaattaaaaacaccataaattccaattacactattaattgtacaaaatagatacatgatttattcatttttatgaccaaaaaataatttaaagatttggaacaaaaaatgtaagtgcatcctagaattgtatatataaacccatactgattagttagagatagttaaaatttaatctgtcccatctgaaatgaaccctgtagtaaaaccctggttaataagatcatcttagataatttcataattaatatgaactatatggctaacctacccaagtctaccctttttcaagggtgtaagtaatcttggctccatgtggattgactcttttttctttctttcctgtacaaattactgatgagatgtacactagaattgccttatagctgaaatggaaatcagctttagatgaaattaaatttctttctttcaaatactaaatctggctgaaaataaaaagcattaagaaaaaaacaattgtgggaaaaccacattttcttttaatagacttcagatgaggctttttgggttttttagttgttcttttttttccttctacagtttttctttctcatttactgtctaatattttcttctgtttctcacactccaattatataaagtaccagaatatttggaaaaagtaatagtattgccaatattttatttctatcttttgctataattgagaatatgtagcttttaagatgtcaaaaccaaaattttatatgttttcaaggattaaaatgctgattctgcccccagttccagttccaaagattaaaggaatcgatccagatctcctcaaggtaactaataattttatctaaattgtagctagtactaattaacacctgaagactcctgtcatatgttgaaggttttctgtaagctatatatatcacattcaattttcttgtgtctcttctcctggagaaaatttttttaaatattctatttcttaaaaataagaaaacgtcatatgtatttaaaaagttacacactaatttatgtttttttatatgttttgttactgttgttcttattgtaaccataattaatctctgaacattatttgctaattcatttaattattatgagtttcttttcatagatcttcattttctttctattttctaggaaggaaaattagaggaggtgaacacaatcttagccattcatgatagctataaacccgaattccacagtgatgactcttgggttgaatttattgagctagatattgatgagccagatgaaaagactgaggaatcagacacagacagacttctaagcagtgaccatgagaaatcacatagtaacctaggggtgaaggatggcgactctggacgtaccagctgttgtgaacctgacattctggagactgatttcaatgccaatgacatacatgagggtacctcagaggttgctcagccacagaggttaaaaggggaagcagatctcttatgccttgaccagaagaatcaaaataactcaccttatcatgatgcttgccctgctactcagcagcccagtgttatccaagcagagaaaaacaaaccacaaccacttcctactgaaggagctgagtcaactcaccaagctgcccatattcagctaagcaatccaagttcactgtcaaacatcgacttttatgcccaggtgagcgacattacaccagcaggtagtgtggtcctttccccgggccaaaagaataaggcagggatgtcccaatgtgacatgcacccggaaatggtctcactctgccaagaaaacttccttatggacaatgcctacttctgtgaggcagatgccaaaaagtgcatccctgtggctcctcacatcaaggttgaatcacacatacagccaagcttaaaccaagaggacatttacatcaccacagaaagccttaccactgctgctgggaggcctgggacaggagaacatgttccaggttctgagatgcctgtcccagactatacctccattcatatagtacagtccccacagggcctcatactcaatgcgactgccttgcccttgcctgacaaagagtttctctcatcatgtggctatgtgagcacagaccaactgaacaaaatcatgccttagcctttctttggtttcccaagagctacgtatttaatagcaaagaattgactggggcaataacgtttaagccaaaacaatgtttaaaccttttttgggggagtgacaggatggggtatggattctaaaatgccttttcccaaaatgttgaaatatgatgttaaaaaaataagaagaatgcttaatcagatagatattcctattgtgcaatgtaaatattttaaagaattgtgtcagactgtttagtagcagtgattgtcttaatattgtgggtgttaatttttgatactaagcattgaatggctatgtttttaatgtatagtaaatcacgctttttgaaaaagcgaaaaaatcaggtggcttttgcggttcaggaaaattgaatgcaaaccatagcacaggctaattttttgttgtttcttaaataagaaacttttttatttaaaaaactaaaaactagaggtgagaaatttaaactataagcaagaaggcaaaaatagtttggatatgtaaaacatttattttgacataaagttgataaagattttttaataatttagacttcaagcatggctattttatattacactacacactgtgtactgcagttggtatgacccctctaaggagtgtagcaactacagtctaaagctggtttaatgttttggccaatgcacctaaagaaaaacaaactcgttttttacaaagcccttttatacctccccagactccttcaacaattctaaaatgattgtagtaatctgcattattggaatataattgttttatctgaatttttaaacaagtatttgttaatttagaaaactttaaagcgtttgcacagatcaacttaccaggcaccaaaagaagtaaaagcaaaaaagaaaacctttcttcaccaaatcttggttgatgccaaaaaaaaatacatgctaagagaagtagaaatcatagctggttcacactgaccaagatacttaagtgctgcaattgcacgcggagtgagttttttagtgcgtgcagatggtgagagataagatctatagcctctgcagcggaatctgttcacacccaacttggttttgctacataattatccaggaagggaataaggtacaagaagcattttgtaagttgaagcaaatcgaatgaaattaactgggtaatgaaacaaagagttcaagaaataagtttttgtttcacagcctataaccagacacatactcatttttcatgataatgaacagaacatagacagaagaaacaaggttttcagtccccacagataactgaaaattatttaaaccgctaaaagaaactttctttctcactaaatcttttataggatttatttaaaatagcaaaagaagaagtttcatcattttttacttcctctctgagtggactggcctcaaagcaagcattcagaagaaaaagaagcaacctcagtaatttagaaatcattttgcaatcccttaatatcctaaacatcattcatttttgttgttgttgttgttgttgagacagagtctcgctctgtcgccaggctagagtgcggtggcgcgatcttgactcactgcaatctccacctcccacaggttcaggcgattcccgtgcctcagcctcctgagtagctgggactacaggcacgcaccaccatgccaggctaatttttttgtattttagcagagacggggtttcaccatgttggccaggatggtctcgatctcctgacctcgtgatccacccgactcggcctcccaaagtgctgggattacaggtgtaagccaccgtgcccagccctaaacatcattcttgagagcattgggatatctcctgaaaaggtttatgaaaaagaagaatctcatctcagtgaagaatacttctcattttttaaaaaagcttaaaactttgaagttagctttaacttaaatagtatttcccatttatcgcagaccttttttaggaagcaagcttaatggctgataattttaaattctctctcttgcaggaaggactatgaaaagctagaattgagtgtttaaagttcaacatgttatttgtaatagatgtttgatagattttctgctactttgctgctatggttttctccaagagctacataatttagtttcatataaagtatcatcagtgtagaacctaattcaattcaaagctgtgtgtttggaagactatcttactatttcacaacagcctgacaacatttctatagccaaaaatagctaaatacctcaatcagtctcagaatgtcattttggtactttggtggccacataagccattattcactagtatgactagttgtgtctggcagtttatatttaactctctttatgtctgtggattttttccttcaaagtttaataaatttattttcttggattcctgatagtgtgcttctgttatcaaacaccaacataaaaatgatctaaaccactctgtatactgtgaattatcattgtaaggagagcttagcaccactggatcaaatacatcagcattgggtatggagatttttatgtgctgagatatagagagggaaacatatcccccttcccttattttttgagaagacaaaagcccaactcagaaatatcccactggcttggccctccccttaggctgtgactccccataggcaaaggttcatagagctgtgtatttgatgcatcatggaaaataaatgacatgggtgttggatgagggagagtgatatgtgagcattatctttacatttccagcttgagcatgttgtctggaaggaaggaaagcagctcttcctctgccattcacccattggcctaagtcagtttattggactagctgcttgttatcatgggaatcagctaataagtcaggcttgggaggaaggctgattaggtaagttgtgtaggagcctgagagagccatgaagtttagattcctacagcaggaggcaggatgcaggtgaggtagctgctgaaccctaggctcctgagcaggcactggattctgagatgtaggaatctggtgaggacattgataaacctactaaacaatgacgtattgcttcagcaagtcaaatgcaaagtgccacaactttttataatactcaagtgttatgttaaaaaaaaaaaatgtcttcacctgctgccctctgccctgtgagcagccattacctgaaagaaccatggagtgaagcctcagggcttcttcatatagatgctttaagatatgaggagtacagggaaaagaaagcctgcctacttccatggattgaaataacacaattctatttcagaagattaatggtgtgttgaaaatggctacacacatctttcagcatttcaatttctcaaagtttctactaacactttattcaagtgctataatatttacatatttacatatttgtataccaaaatatgtcttgttatgtgcttgttttagggtaagaaatagtgaccagaaaaaccagaagttacttaaatctaaactttttagtttggaatccaagatcccacataatttgccccagtctcctttgagagtttaaaatttaagacctagatgtaaagggcacagcttctgaataagaatttgatgtttggttaacattcaaactctattgctgtggaaatctaatgagcatatgatgtcagctatgttacacgggaaacattgctcatagtttaaatgatctctgactgataaatgacatctggatagggagaaactataaccacctggagataagttatactttggacttgagtgtagtgacttgtaattaagcatttcccctatagaaactctggaagctatgtttctggagatgtaacaagagtaactggctccagtgaggcatagagcttctaagcctgggagactcctttacctgcccaataccttctctgaatctgagctgccagttgtaggaggagaggaaggaaaagaccttctggatagctatataaacagctgtttagattgcttcatgcactgttatcattactgtgactctaaagcagaaagcctgatgctgtatcccttctgtcctacatccctctgagtagactggaaccaagtatggtgaatctggggaatgtgtggttgagcctaagaagatccccttgcatatgtagcaaaagacacttgccatttcttgaacaaagtttgtgctttcccatctctatgttcttggtcatgcctcctccttcaactaaaaagctcccacttaccaaccctgcctgtcaagattcccttcatccttcatggcccagctctaatgcctccttcatgaactctcctctgattcccaccatccaatcagtgattttttcttctgaaccatgtttaatggtgtttatcacattactttggtagctcacctgacaaacggctagtatagatttaccagtatgtacgctggtgaatatctatctccaaaatgcccttgaatggataattttgtggtcaaataaatttggaaaacatctcatactacactcccatctgggagagtcatagtgcatcttgacattttaaagcttctacagtttaaagaaatccatttaaatttaacacattatttcctaattaataatgagaaatagttaaagaatacccagtattatattattaacacttaggaaaaaccgtataagcagagtaacacacctggcacaaaataaagttatattaaatttcagatgaatgtgaatttgaacaaaaccttttatatgatgtcattaaatttttactctcaataaaacttcctaaaaattgaatgcgaaggagctgcatgattaaaataaacacagattcttctcaactcaactcagatatgacatttttctgaaagtctggatgtcttagagcattcattatcttctctatgacagtgactttttatatgcttgctgaaacagattttaactttttccctttttcagtccaaagaatgattgacatatggaatgtaccaatattaaaaaattctgattcttatttaggacacccatttttctatgaaatctgagcttataacaccaagaaatgcttatatcacttctcataagaaggagcatatgttgctgtgaaactgcagaataatatttatctgttattatctgaacaaaaataactcactcctaatgctgcctgctaagttaaaaaaaaaaacttcgaatataatagattttttcacagtagtcccaggaagcagtctttgtaggaatacatagaaatcaattttgttgatctcttgttagaaaagaatccttacacaattgttctgtgggcattaagagatgttaccagctttttctataaggataaaataatttgtgaagaaattatactcactttggctttgacaatggtactgtagtcaaaaattcaaagtcgaaagatttttattgttacctttccttttatggtaccatatgataaaaaaaaacttgcatataaggactttataaagtactttcaaaggtattatttcatttaaacttaagaaatctgtgttgtaggcttgtcagatattattcttaatattttattgggaaaaaaggctcgtaaaaactaagagattttcccaaagttaataaactagtgagtgatgaagtcaggatgaaaacccatgttgactagtccagagttcccaaaacaatgcaacctataacattactggatgggggaaaagctttggatcctattcacagtctgaagaaaatggaaagttaattgttttgtaataattattattcaaagataataactaatctttgaataatctttggtaataataattctttgaatcctttggtagaactcaaagaatcacctgccaaagacaaaagattcttctctgataaacataaccagctaataaatgtctaacaaccagttctggagtcggggggatctagatttgtaacatttgccaatttcaatggtgtgaatacacaaatatggtgattttaagctattatcttatcactccgcatgaagttgggaaaagatggcacagtcagctctcataactgtacagagcagctccaggaaaccactgagtctacacaaccttacaatttcatctaatgctgacattttttataatggctaggtggcatttttagctaacatttatcaagcacttaccatatgccagacactcttctaagcactttacattgatgaacttatttatcctcacaacaatctcatgaggtaaatcctatttccccagtttactgatgtggaaactgagttatagatcatttaattaacttgaccaaagtcacaaaattaatcaatattagagccagaatgcaaacacaagcactctggctttagagcttgtgctctacatttagtgctatcctacctttgaataataattgtgtccagattggatgaacataatgacaacaaaaggcagctgattgctgagcactccaggcaggcagttcatattcagtattgctaatttttatataacacaagcattatctttccatgccttcaagacaactatctagattcgtatgtgggataaacagagattaccaaatgtctgcttctgagtcttccacaatgccatggagacttcattgcatgctttccccttggctccaagtgtgctgctggccactgagcagaaccggaccacagatttctctaaaccagtgatacagtgcatccaggtcagccaaactcctcgatactccttgttctctttattcacccagacacccccaaacaaggctgtgcagacgggctgtgaataactagagagaattaa

SEQ ID NO: 36768 - DNA, 48185 bp, Homo sapiens
gcgcggggcgggagcttggtggagcaggagcggctgggcatcctcctgagactccggggtcagacgcccactccaggtaaccggctctccctcgtgttcccctgctcggccgcccggcggtgggggaaggctgagaaggatgggtgggagggagccggctctcagccagtgccccgtggccccgggcgggctgggctcccccgcggaggaggaagcagaaccggggtgcgcccgggaccggaatggagcggcgcctcttccttccaccttcattttccgtccgctcagtggggctgggacgccggtgccccgtgtcccctgaaagtcactttctggcctcttgcccctggtccgtgtagcttagatgtcggaggggttggctgcgggcgtggataggcagggaacgaacagactcgctgccatcccatgggtgccaggggcttaacttcatttaacttcattgaatcctaacgccagcccggctaagatgcattttcacccctactttactgataaagaggccaacgctaggataataaatgactcaccctggagcaaactattactaataagaaaagagacgttagtttaggggctccgaagcctctcctttcctgctccctcgctttccttcttctcgcggcagtctaggaaactcgcgcgcagggtctattacgaaaacaagtgattcgtcttaaaagcattttaccccctcctaggtttctctttcctcttttttttaagtatctcaggcagattcctccaagttttggttattaggtttttgaaatggaagaagcccttgctcactgcttcttttctcctggcagcgctttctgcgcagcacaggcaccctcgcctgtcacgcctccctctcctcttcccgtctcccagcgtggatgagggcgcctgcagatcccggctagggcacggaccgcctaggccgaggtaggttctgtaggcacctggcatgctgtagatgcatataaacgttgccctgtacaccctttgccttgttatttctttctgcagaaaagagagtcggttttttacacataatggggcaagaggccaattgggaagatatatggtgttcaaagaaagccgtggtgccttgagatgagaatgcggccacagctttttgtgggctgaatttgatgggtgggaggtgagagacgtggtctggaagttgtctcttcgtctggcattctgccccccttccagagctgttctgaaaggccggtttgttttatagaggggaggaggagggcttagtagtttttaaagatcagtgtaaattacctgctaggagcttaggcaattccaggcaggcccccctgctggaggctttcgtaacagatttcagttctagcagggaggaaaactcagactgtgtagatacctgctttttcttaaaggaatttttttcgggcccttaaaatggtagttttgggaaactgatttcttagaaatggcaaactcctttattttaaaatacaatataccaaactatgaatttacttttaaaaagttttattggccgagaggttgatattttttccatttcatgatgagggtttgacggtcactgccacctcctctgcccgtccttcaacttggccctgtaaaggatctccttagccttggccccaagtttgtactagattctatccttcattaattatagttcattcttgattaatgatagcaatgcttccactcactttttaaggagttactccttttccgtttgtaattgaattgcttaacagtaagaaaaacgtttttccctaaaactgggatcacaaaatccactttatccacatggactaaacaggtaatgcacaagagtgcttggttgggcccaggtgactgcagaggaacctgctaaggctgggtggatattggccatttccaccgagtatccatgcaggaattcccattcagccatacagtgtaggcagctttttttttttttttttttttccacgaatagctgagaacttttacttaaaaataaaaaatgtaaagcctgattttaaatattggctcatattttttcctttttagaacacaaagagggccgggcgcagtggctcacacctgtaatcccggcactttgggaggcccaggcgggtggatcacgaggtcaggagttcaagaccagcctggccaagatggtgtctctactaaaaattcaaaaattagctgggcgtggtggctaggcgcctgtaatcccagctactcgggaggctgagacggagaattgcttgaacccgggaggcggaggttgcagtgagccgagattgcaccactgcactccagcctgggtgacagagcgagagtctgtctcaaaaaaaaaaacacacacaaagagcctgggcatggtggctcacacctgtaatcccaacattttgggaggctgaggcaggtggatcacttgaggtcaggagttcaagaccagcctgaccaacatggcaaaaccccatctctacaaaaatattcaaaaattagccaggtgtggtggtgggcacctgtaatcctagctactcaggaggctgaggcaggataattgcttgaacccgggaggcggaggttaggatgagcagggatcgtgccactgcactcaagcctggacgacagagtgaagctccgtctcaaaacaaaaatcccacaaagaataaaatcaaatttgtttcatgcatcatctgtttgcaaaactctgccttaaaaactgctactgtacacggtgattatattctccgatgaatggaaaattctgaactgtgatgtagatattgtacatttttcatgaaatgaagtggtagaaaacagaaattactactggaaatgatcccttctgactgtcaaattctgttttctatgaagtgtgtggtatttcagctatactgtattttttttttttttatagagccaaccaaggactcttgtcactatttttatttattctaatgagaaatgtattcatggttccaggtcagtatgtcaaatgtctaactccctgtcttaaaaagggagttcccaaatgactgttcatataaccatatgtgtttcttgtggagactgtctgtattcttggctttgtcactggatttgtggcttagtgctgtcacgtttcctatctgaggcaaatgccatatatgtttagaccagcctttctcaattgtggcacttttgccatttttggccagttaaattctgttgtgggggctgtcctgtgcattgcaggatgtttagcagcatctctggcctctacctactaaatgccagtgcaccctccctgcagttaaatgaccccaaatgtctccagacataggcaaatgttccccggagaacaaagtcatctttggttgaggaacaaaatgaacctatatttaagatggtctaaatgtttctgagatggtctaaacatttataagcttaacaattaacttgaaactcttcaggactagagaagctatttgtaaatttaaacatctgacgccttgaaacacctttatcataaagataactaaaccagtgttctttgtgaatggccaatgtgtcctgccagtttctttttttttctttttcctattctgagaagcatgccctgccagtttctatctccaaagaaatttcaagcgttcagtgtatttgttaaatttcataaagtttaaaaagttgaaaatgaaaaaggaattctacggtagttttaagtagaatttagttttaagaaaaattaacctctttttagctaacagcaataaaacgaagactgctgtgtatttctgtaatctgaaaaatctcgactttctcaaagggagcgctacataatgtatgatataatttatatcagaagaaaacatgtcctagaaatgtaaccctctttcttaggacttacatgtgctcagggaggttgaaaacaaccttgattatggaggatgcctccttagctggggattagctatccactgttcccttccagaaatcaaactaatttgtaaaactcaggactggctacataatttgtggggccccttgttaaaaaaattaagaatttgaacatggtgaccacagagcattaagccaagcacggcccagtgtgactgcgttggttgcccacccatgagctggccctggtgaaactctttattcatagctaagagtaaggttgtggtcacaaatgcaaatctaaaccgtgaaatgttactgctgccactaggcacctggagtttctgcttccttgattgttcttctgtttccaatgaggagtctgcatgtatttggtcatcaatgcaataatgttactaagaaatcctcccatgattgatttttcgtttgctaaagaggtagccaaatgtttgttcattagagtcatgggtactggagcaacctatttattcaggcattcattgaacaactatttactgagcatctgttagatgcccggcattgctcgctccagggccacagctgtgaacaagatggagggtccctgcctttatgagcttatgagccaaacacatagtcacaccggctcaggctatcacaatcttaagtggtacttaggaaagcacagggtgttaggggagcatgtgaccttgagacctaacctggttgaggggagagggactgttcagggaagacctgcttaaaaaatgatatttaaaataaggcctgggggcaggtatggtggctcacacctgtaatcctagcactttgggaggctgagatgggagaatcgcttgaggccaggactttgagaccagccaggtcaacatagcgagactcccatctctttttttgtttttttttttttttgtaaaaataataataaaaaaaaggctgaaggattagtaggagttagtgaagtacattaggggataaacttagaggctgaaagagttgagatcaagagtaaaatatgtcttgggtcatttttaggattttggactttaatgtcagcatagtggaaacccactttttgtttgtttgtttgttgcagacagggtctcactctgttgcccaggttggaatgcagtggcaccatcttggctcactgcaacctccacctcccaggctcaggtgatcctcccacctcagcctcctgagtagctgggactacaggcacacgccactatgcctgagtaatttttgtatttttaatggagatggggttttgccatgttgcccaggctggtctcaaactcccgagctcaagcgatctgcccacattggcctcccagagtgctgggattacaggtgtaagccaccatccctggccactaaagtgtttttgatttgtggttgttttgtttgttgaagacagtgtctcactttgttgtccaggttggagtgcagtggctattcacaggtgagatcatagcacacttcagttgaactcctaggctcaagtgatcctcccacttcagcctctcaagtagttgagactataggcatgggctaccatatctgactagaagtagttttattttaaacccatcaagtcctgagtccttcatgttttctctaaattctacttaaaaattgaatatacttctttagttcatctctctcacattttctcaaaggcagatactgggccagatagcacttcctacattcttctcagaaatgttcttaggcagatccctgatatggtgaaatatcctctcaattttccttgttagggcaggcagtagtgttgctcacattcctccagttcattttctccagtttccaatgagatttttttgtttttgagacagtcttgctatgttgctcgggctggagtgcagtggctattcacaggagcaatcatagcacactgccatcaaactcctgggctcaagtgatcctcctgcctcagcctcccttgtagctgggactgcataggccctgctgtgcctgactctgatttgagtttttttttttttatttttttttagacggagccttgctctgtcacccagactggagtgcaatggtgcaatctcggctcactgcaacctctgccccaagtagctggaattagatgtgcgtcaccacacccagataatttttgtatttttagtagagacggggtttcagcatattggccaggctggtcttgaactcctgacctcaagtgatcctctcacctcggcctcccaaagtcctaggattacaggtgtgagccaccgcacctggcctaatttgagtttgtaaaatgatcgctgttgctgtgtagagaatagtttagagaggtaggtcctgctggcacgtttggtgtctttgtgcaaacccaagaaaggcttctattctgtgtggaccaattagaaaaaatgcaccactgtgtcccagctaggccaggtcaaaaggcttcagccccctgagccagacttgttacgcaggcacagcctgtgcaatcatgtggccaccctggggaggaggagggtggatgtgaacaaacagtgcttttgcagtcacccagtgatggcgtagcagcactggataacgcttaatgacaggtgaggattgagattgagtgagattgggtttgtagttaaaatcagcaagaaggtggtgattatttggatatggttgatggagagggaggtagcaaggatgattcaaaagtttctggcataaacaactgagtaggatgggatggtggaaccattatggtgattgagaacacaggaggaggagcgggttggcacgaggtgtgggagggaagataatgcctttttggatgtgtgttttgtttgtgagacatccaagtaaagatgaggagtagacagttgctactcctggaagagatctggggtggagatacatgtttgggagctgttgcatgtaagtattactgcataaaaagcactcatccaaagagggtgtagaatgagaaaagaaaagggctggacccgtagagtttgatcactgtatttggtagaggaagagaggcctgttaagggtactgagaagtgtgatattcatgcagggcagggaggaaatgaggggtctatgatgttttgttttgtttcagattgagatggaagaaatttaaacatgctctaatgctactgggattttgtttgttttgtttttgacaggatctctctccattgcccaggctggagtgcagtggcacaatcttagctcactgcaacctccaccctctggggctcatgccatcctctcacctcagccttcaagtagcaccaagggtgtacagcactacgcctggctaatttttgtattctttttctagagacgggtctcaccatctgtgttgtccaggctggtctcaaattcctgagctgaggcaatctgcccaccttggcttcccaaagtgtgggattataggcatgagccactgtgtctggccactactgggaattttctggtagagaggaagagcctaaagatgcaggagggtaaaataaatgataggaccagttttcagagagggtgagaacacagtgcagaatttggtctttgatggaaggacggagggagaggatggataaagatgctttagattttgggtccagaatcgtgaggactttttctgaaggaagtggcaaaaccattggctgagtttggggtgtgtctgtgtgtgcagtcagatatttcttcagccagcatttagtaagcattttctagtgccaagctttgtgtttggctccctggaaagtgttatgaatgatgattaccttgaagcttggccctgtacacctgaaatagccttgcaccactttttctacaaattgcttcctacctttgaccttacaggcttgttaactaaaggcagtaaatgctcagctgatcttttttttttttctttgagatggagtcttgctctgttgcccaggctggagtgcagtggcacgatctcagctcactgcaacctacgcctcccaggttcaagcgattctcctgcctcagcctcccaagtatctgggactacaggcacccgccaccgcgcccagctaattttttgtatttttagtagagatggggtttcaccgtgttagccaggatggtctcaatctcctgacctagtgatccacccgccttggcctcccaaagtgctgggattacaggcgtgagccacctcacccagcctcagctgatcttttgatgggcatcaaagccactaggggtgacagtcctggaggggaaggaccttttcaagccccttccacatcatgcaggttcatgttccatgtcatggttctcggtgttggctatacattaggaacacctgtggaacttttaaaaaaacctgacacccaggtcaaactctatatcaattccatcaaatctctggtagggggactcgttattggtcctttttgaaagctccctggtggttgcagtgtacaaaccagattgagagctacttgcctgttgagtggccctgagtccagttaaagccactcttctgtgttgagctccagcccctgctgcctggagtttactgcatttgtcagttgtgtggaacagaaaataaggctgagaccaattgtgtaggacagaaaacgaggttgagattatattggtatccaaagcaggaagcgaaggacagtcctttgggggtgttgaaaggaagtgtaagaacctctatttataattttataagcatttaaggtcaagaatgccagtggtccctctttcagtgtttttttttttttttttttttttttttttgagacagtcttgctctgtcgcccaggctggagtacagtggcacaatctcaggtcactgtaacctccacctcccaggttcaagcaattgtcctgcctcagccttctgagtagctgggattacaggcacatgccaccatgcctggctaattagtaaatacagggtctcaccatgttgaccaggctggtttcgaactccttaacctcaggtgatccgcctgcctgggcctcccgaagtgctgggattacgggcgtgagtcaccgcgcgccgaccctccttcagtcctgtgtcttgtacggtgaatgtggtttctaaggtggataaggaggcagggattccttgcctagctggagccctgctcacctggccatcaagcatactgtgagatgttgcaagttaggagctatagagtgtcatcgagttgtttaattttagaaacacaaaggctttaaattagagcatctcaggttagacttgtccctgagcgggtgataggtgtactgagatactgcatttctctcagccctctcccttaagccaagagagctgaagctgatgtttgatggttaccttttggtatatatgtcatggcatgagaaagaatcactgctttagtctgtagaagctttgtcgtcctttgccatgccctggggagggagcaggaccatcctttgcacccatcagagcattcctagttcttttgttgccagatacgtaagagtggttgagtttacaggtgtctgcatctctctttagcagaaagatggggtttcaaatgtgttgcctctttccaattttgctatgcctatcagtagtcagatattttggggagaagggaaaaatccaaggtaaatgtgaggttcttacagtgaattacttttcaaaagaaatttctgctaccaaggggcatttgggaagtggctgtgtggagaagttttcattgtaatgcgaacatattgccaaaaaatattgtacatttgtgagttatcaaagctctcaaaggaaaaaaaattaaaaactgggaaacagaattgtcatactactttaattgaaaagtaacaatgagtttttaatccatttgttaactttatggggcacctgcagactattttgattagtctttacaattgattgaaacccactgggcaaatttcgccaaaaaactatgtgattggtggatagaggaaactaagtgtcaagatttaggtagcagagccaagagtgcactactataattgaagtaataagttttattgcatcctccaagtttttgaattatgatacatgtaatttattagtacaatagtgagagacaggactagctggatttcctaggcccactaagaatccctaagcctagctgggaaggtaaccgcatccacctttaaacatggggcttgcaacttagctcacacccgaccaatcaggtagtgaagagagctcactaaaatgctaattaggcaaaaacaggaggtaaagaaatagccaatcatctattgcctgagagcacagcgggagggacaatgatcaggacataaacccaggcattccagccagcaacggctaccctctttgggtcccctccctttgtatgggagctctgtttccactctattaaatcttgcaactgcactctcttctggtccgtgtttgttacggcttgagctgagcttttgcttattgtccaccattgttctttgccgctgttgcagacctgccactgacttccatccctctggatcaggcagggtgtccgctgtgctcctgatccagcgaggcgcccattgccgctcccgatcgggctaaaggcttgccattgttcctgcacggctaagtgcctgggttcatcctaatcaagctgaacattagtcactgggttccacggttctcttccatgacccatggcttctaatagagctataacactcaccgcatggcccaagattccattccttggaatctgtgaggccaagaaccccaggtcagagaacatgaggcttgccaccattttggaagtggcctgccaccatcttgggagctctgggagcaaggaccccctggtaacagtagtagatacatagaatttttaaataaacatacttatattaagggtactcttagggtctatactaagaaattttgcatgcttgtcattaaaagctttgagtccaagtcctgtgtgtgtgtatatgactttgactctaagtcaagtgtaaatgtaactgtatagatatgccatgtatataatgtaaataaaatatatacatatatttataaataaggcagtctgaaaacttgcttgctggtgaactttaaaacagcctctttctcgtgatatacccctccagtttatccagtggaaaagaaaattactgctggattaaaaacaagtgcttaggctaggtgtggtacctcatgcctgtaatttcagcactttgggaggtcgaggcaggcagatcgcttgagcccaggagttcgagaccagcctgggcaatatggtaaaaccccatctctacataaaaatacagaaattagctgggtgtggtggtgtgcgtctgtagtcccagctactcaggaggctgagttgggaggattgcttaagcccaggagtcgaggctgtggtgaactgtgattgggccaccacattcaagcctgggtgacagagcaagaccctgtcccaaaaaaaaaaaaaaaaaaaaatgctcaaactaaagagtgataaatacattgtatacatgtcttgtttctcttgaaatgtgtacattttatcattccataatgtatacatctatcaaaacatcacattataccccataaatatatacaattattatttgtcaattaaaaattaatttttttttaaagccacttaatgtgcaatttgcagacgtcttctggttagtccaagattcagcgggggtcaggtgatcaagaatttcctgaaatcagcagctggatccaggaatgggcttaggacaccatcccagactttggggcccgccaggcttgtttgtcctcttcatgtaaatgcagaacttgcctctgaaatatgcctaatcctttcatataggtggagcccctgatctcatccattgtctacacatttctcacatctgttatgctaaccaacacagtccttgtattcaccttgtgaggatctggttctcacactacttatgctaattaacaaaacctctggtttgcaattaaaaatcctgaagcacatgctatatctgctgctggagtgcccaccaccatggctggctgatttttgtatttttagtagagacggggtttcaccacgttggccagggtggtctagaattcctgacctcagatgatttgcccacctcggcctcctaaagtgctgggattacaggtgtgagccactgtgccctgccacacttgtctgtctttatgcctttgtttcttgtaatttatgggaccacagactccacccctatactgaagacctagtaattgctcccagaattgctcccaggaatgtgctcctgcctggggcgcttgacttccacaaaccccagggtatagataaaaacccgtgcatgtatgtctcactgctatgcagaagtgtttttcaagtcagaaatagacagcccaccaattttgttgttgattacttgtggcagaaaacttatgagttccctgaaaataagaggcatggctataaaaatacaggatttaaaaaaacatgtataagtggaaattagtacctttaacataagtgttttccaaagacatttctgaccattttgaggcatgtcctctgtgctgtattctcctattaggaaagacaccagtttttgatggtagatgtgattttgcagcatgtcagaagttagcattatgaggtagattggtcatgctcagtaatattattttgggtcaaaataagatgtaaatttttttttcttttgagaccagtctcgctttgttgcccaggctggagtgcagtggcatgatcacagctcactgctgcttctccccagtcagctcaactggttctcccacatcagcctcccgtaaatattttttaaaaatggactaggggctgggcatggtggctcagcctgtaatgccagcactttggcaggctaaggctggcagatcacttgaggtcaggagttcgagaccagcctggccaacatgatgaaacctcgtccctgctaaaaattaaaaaaaatagccaggtgtggtggcgttcgcctgtaatcccagctactcaggaggctgaggtgggagaatcacttgaacccgaacccgggaggcggaggatgcagtgagtcaagatcgcacctctgtacttcagcctgggcaacagagcgagactttgtctcaaagaaaaaaaggaaatgagaaaagagaatgtgtgactgacaccacaaagaaatgtcagatgtctcttttggggttctgtgggtggccctccctcccaaaaaagtagaattgagtgaagggaatgcagtagagcgtgaaagaacacatacccacaagggtgaagctgcaggctctggttaaaggcagctttccactagatcttgacccttatgccccagggcctcagctttttcttgagttacagaggagggtgcaacttggggctagatggacttttttgttatggacttgccatatgctcttcttgtaagttttctttgtcatgtaagtttgagaaatgctgaataccatgtctctgtctttaaatatttacagtagacctgactgtcttaagggctaagaaataaggagccaaaccagcaacagagaatcttgtctttcttttcttttcttttcttttcttttctttttttttttttttttgagatggagtctcgctctgtcacccaggctggagtgcaatggcgtgatctcagctcactgcaacttctgcctcccagattcaagtaattcccctgcctcatattccggagtagctgggattacaggcgcctgccaccatggctggctaatttttgtatttttagaagagacggggtttcaccacgttggccggggtggtctagaattcctgacctcagatgatttgcccacctcggcctcctaaagtgctgggattacaggtgtgagccactgtgccctgcgacacttgtctgtctttacgtctttgtttcttgtaatttatgggaccacagactccacccctagcctgaagacctagtaattgctcccagagctgctgtttccagcaacactagatgcttcctgaagtttctttcagctctacaatggatgcattgttctaaaaatagtttctaactatattgaccaagcctataatttcctccagaaacctcagcatataacctctgagtgaattcctggagagcagggagcatgtattatttatgtttgtatttttctccccagagcctaggaatctattttgtataatagattctcagtatagaattgagtatattgaagtatttgttagtaaactggaaatatggattttcatttttgaagtctgaaaaagttacccttagacatgagctcagatttgaacaaaagtcaaaaaagggaaaataatgaataataatacattgccaatattaagggctcattatttgtcaaatacagtataaacatgttacaagttagctcacttactctttataaaaactctaaggtatatatgataatttccccaatgaaattgtttaaagttaattagttttttaaaaaaacaacaaaaacgctgaagctaggagaggctaagaatttgctgaagtttgggttggggaatgatgactcccaggtctcctgctggggcagtccggttggagagctgaaatcattgccactgtactcttctgtgtctcagatgtaaacaaacccaagagaaaatattcaggactgggcacagtggctcacacctatcatcccagcactttaggaggcctaggtggatcacttgagcccaggagttcaagaccagcctgggcaacagtgcaagaccttgcctctacaaaaaatataaaaattagccaggcatggtggcatgtgcctgtactcccagctacccaggaggctgaggtagaaggatcgctttgaacctgggaagtcgaggctgtagtaagctttggttacgccactgcactctagcttgggtaacagagcgataccctgtctcagaaaaagaaagaaaagaaaagattcagccactagtaatcaaagaaatcacaaagtgaaaccttgatgatgtaccattttacagttgcaatatcggcaaaaataattatacagtatattcatatacagtcatttaacattatatataattaaaatgtatagtaaatgtagagaaaatggtatccagatgttactggggacagtataagtatcgtttatttggaaggcagacaagaggcacagaaacttacaagtagtgacctaaaatccttattcctgggaattccaaggaagtcctttaaaagcaaagcaaaaacaaagctatgaatatacaaagctattcatagttcatatttataacagtataatttggaaatacccttaatatccaaccataagataaactaattgtgacaaaaacaaatgatattttgatagccaataaatcaaaaaagaatagaaaatgaaatccctgctgctattacatctgagcaaaaatataagtgtattgtgcaatgttacgtaccagaagagaacatggaacgtgaacgcagaggatgtgtaagtgaagttagattgtcaatggatttttgtttttgggaaattatatgctttgcaaatatatttaattggagcttattttggagaactgtcaccattttatcccagttggcaatttttaaagaaaattactgaagtgaacataaaaaatggaaacatttcagaagtgtttgaataaacatcccctctccaaaaaagaagatcctcactgaatagttttgggtgtgtgcttctcagtttttccagtgcatgtttataatatatttatctggaggctggtttttttgtttgttttgagacggagtctcgctccgttgcccaggctggagtgcagtggcacgatctcggttcaagcgattctcctgcctcagcctcttgagtagctgggattacaggtgcccgccaccacgcccggctttctctgaacatactgaggtgcagctcatctttgaataccacatcatctcacatacctcttttcatgtcattacaatgagaattacttcattcttggctttagtgctaatttcaaattcaataactgtaccaaaatataatttagatgatgtggaaatggagaataaagattgccgctcaggtttatgaagctgtttaaagggcacattcacagcttagatcacaaatcagtccctgagggttgaagaggttgctctgatgtgtcttaacactgaagcctccaaaaagagaatctgtaacattcatattcgcaggaagatttgggggattccagagctcctctctggaaaagactatgagctataaggcacacttaacacaaagcatccaagatgctgccctacattttttgggagaaaggaagtggattttgtaatatttggacatttgatgttttttatttttattttttgagttcatgctaattgaatagacccacggagtagtgtgggagacaagcctgagacttgaccgaggccactaagggctctccaaagcacccacatggatagcttcacggagacagagtgatgtgggattcagtgctgaagtgagagacgacgataattcctgtttattgagcatgtgctgtgtgtaccagtcactgtgcttggcactttacagattacttaaacatcactgaacaaatgagaggagtcattaccatatctccatttttcagatgaggaaactaaggctcagagaggttaagcaacttgcggaaaccatgcatttaggaagtaactaacataggctatgtcttcacttctgtttgacttcacacttctgttttgctccgtggcctccaacagtgaatgatgttgatttcaaagaggggcaatcattgtggtttgggaaaggaccagaggaaggagttgagctggattttgaacatgtagaggaaattggggagacagtgctttttatttttgctaatggttagccttttgccatctggaataaggatacttaatctgacagtcacatttagcaaactgaaaatccagatttgagggctatctctaaaaacaaggaatctagaatttgggaactagcatttctaagaccaagccatttaggaggctcaagtacttaaaattgggaccgttcagaaaacccaagacgtgtggcccatgtgacacacaggatgggtgacctcagggccaaaaacccagggccacctaatctttaagaggggacaaaatgaactttaattttccaatccaaaattttgtttccataaaaccgtggtgttctatttggtattataaactgcctacttttagatttgaaaaaaaaaaagagaaaaagaaaaaagtccattactcttcagtgtggaatttcaaagtagacaatgagatcttttattctcatttttggcctgcaatgataatgaggttgaagattgctatttaaaaaaaaaaacactgtttgttttctgtatgtatatataaacagatatttctgctcaagcccatcaaagtcagcctctgcaaatgaagtctcctgcctgagaggacaggttttttccatgtaaaactgtgtttcgctgttacttatactttaagcaaattggggtaacagtaaatgtgcacaggcagtcggaaacacactggccttttggagaaacttggacaacctttgttcttttatctctaaactttcatgacactaaactcaaaaaggttatttttcagacaacctgcggtcatacctacttatatttcccttattctaatatattgttcttcactgtcttctcttaaattaattttatttatttatttatttgtttagacagagtcttactctgtcaccaggctggagtgtagtggtgcaatcttggctcacgtttgaaacctctgcctcccaggctcaagcgagtctcgtgcctcagcgtcccgagtagctgagattgcaggtgtgcaccaccacgcctggctaatttttgtatttttagtacagacggggtttcaccatgttggccgggctggtctcgaaatccttgcctcatgtgatctgcctgccttggccttccaaagtgctgggattacaggcacgagccactgcgcccagcctcttaaattaatttttaaaagcctcttctggggcctggagtggtggctcacgcctgtaatcccagcactttgggaggccgaggcgggtggatcacgaggtcaggagtttgagaccagccttgccaacatggtgaaaccccgtctctattaaaaatacaaaaattagctaggcatggtggtgcgtgcctgtagtcccagctactcaggaggctgaggcaggagaattgcttgaacctgggaggcagaggttgcagtgagcctagatcatgccactgcactctagcctgggcgacagagtgagactctgtctccaaaaaaaaaaagcctcttccatgtaacattcttcatctcattcacttacctgctctgaaggtgcatctagtcacgtcgtagtaagacagctgcatcttttaaaatcataacaaagagactgaaaactcccaaggttaaatctgaggaaattcagtgcattaagcatatttgcactgttgtgcagccatctcaccctagccattcctagaacttttcattatcccaaacagaaactgtactcatgaaaacagtagctccccattcttccctcccccagctctggaaacaaccatgctactttctgcctctgcgcatttgactactctaggtacctctgtaagtggaatcctagtgagaggtgaagccagctgggcttctgggttgagtggggacttggagaacttttgtgtctagttaaaggattgtaaatgcaccgatcagcgctctgtgtctagctcaaagattgtaaacgcaccaatcagcactctgtaaaaatgcaccaatcagcgctttgtaaaatggaccaatcagcactctgtaaaatggaccaatcagtgctctgtaaaatggaccaatcagcaggatgtgggtggggacaaataaaggaataaaagctggccatcccagcgagtagcggcaacctgctcaggtatccttccatgtagtggaaacttggttcttttgctcttcacaataaatcttgctgttggtcactctttgcgtccgcactacctttatgagctgagagggtctgtggcttcatttgtgaagtcagagagactatgaacccactgagaggaacaaagaactccgggcatgccatctttaagagctgtaacgctcactgcgaaggtctgcggcttcattcctgaggtcagggagaccacgaacccacgggaaggaagaaactcaggacacatctgaacatctgaaggaacaaactccagatgcatcatctttaagagctgtaatactcaccgggagggtccgcagcttcattcttggtgagtaagacccagaacccaccagaaggaataaatttcagacacaatagcatatctgttttattgtgtctgacttacttgagttagcataatgccttcaggattcattcatgttgtaccctaagccagaatttcattcctttttaagaccaaatactgatccgttgtatggatataccacatcttgtttatcacgtgctttttcttaaccattaggatggtcttcattcagatacaatgcaatcatggacattcctttggctttcaagggaattaatgaaatttgtatgggtaaagccatatatgtatttctagcaatacattttatttatctatttttattgtattttaagttctagggtacatgtgcacaatgtgcaggtttgttacatatgtatacatgtgccatgttggtgggctgcacccattaacttgtcatttacattaggtatatctcctaatgctatccatcccccttccccccaccccacaacaggccctggtgtgtgatgtcccccttcctgtgtccaagtgttctcattgctcaattctcacctatgagtgagaacatgcgatgtttggttttttgtccttgcgatagtttgctgagaatgatggtttccagcttcatccatgtccctacaaaggacatgaactcatccttttttatggctgcatagtagtctatggtgtatatgtgccacatttcttaatccagtctatcattgttggacatttgggttggttccaagtctttgctattgtgaatagtgccgcaataaacctacgtgtgcatgtgtctttctttataggagcatgatttataatcctttgggtatatacccagtaatgggatggctgggtcaagtggtatttctagttctagatccctgaggaatcgccacactgtcttccacaatggttgaaccagtttacagtcccaccaacagtgtaaaagtgttcctatttctccacatcctctccagcacctgttgttacctgactttttaatgattgccattctaactggtgtgagatggtatctcattgcagttttgatttgcatttctctgatggccagtgatgatgagcattttttcatatgcctgttggctgcataaatgtcttcttttgagaagtgtctgttcatatccttcgcccacttgttgatggggttgtttgtttttgtttgtaaatttgtttgagttagattctggatattagccgtttgtcagatgagtagattgcaaaaattttctcccattctgtaggttggttcttcactctgatggtagtttcttttgctgtgcagaagctctttagtttaattagatcccatttgtcaattttggcttttgttgccattgcttttggtgttttagacatgaagtccttgcccatgcctgtgtcctgaatggtattgcctaggttttcttctagggtttttatggttttaggtctaacatttaattctttaatccatcttgaattaatttttgtataaggtgtaaggaagggatccagtttcagctttctacatatggctagccagttttcccagcactatttgttaaatagggaatcctttccccatttcttgtttttgtcaggtttgtcaaagacaagatagttgtagatgtgtggtattatttctgagggctctgttctgttccattggtctatatctctgttttggtaccagtaccatgctgttttggttactgtagccttgtagcatagtttgaagtcaggtagtgtgatgcctccagctttgttcttttggcttaggattgacttggcaatgcgggctcttttttggttccatatgaactttaaagtagttttttccaattctgtgaaaaaaagtcattggtagcttgatgggaatggcattgaatctataaattaccttgggcagtatggccattttcacgatattgattcttttcctcctgacaaatttacagttttccgctttgtggcatagactgagggtgtatttcatctttcctgcaaagtcaataggcagaaagggtaggtgtcagttcttcccccaggctgtcagctggtgtgtccctggtgtgcctttgggagagagagcatggggaaagaggatgctttttcttctgttaacgtgctaataaatactattttcattaatgagtgaaatgcaagggttatttaaatgacattttgtctcaaagtagtataatgattacaagaaaaaaattctgtagaacttttcatgtcattaattcaggcatggagaactgatattttttcttctgtatgtaaactacacagatgaaacctaattttatttaatttcatctaacttagaggcatcaaatttcattatgtattttaacattttttatataattataaaatatgttttaatataggattactcagaaaaaaaaaatagctgggcgtggtgtctcacgcctgtaatcccagcactttgggaggccaaggtgggaggattgcttgaggccaggagttcgaaaccagcctggctaacatggtgaaaccccatgtctactaaaaatacaaaaattagccagattggtggcgtgtgcctgtaatcccagctactcaggaggctgaggttgcagtaagctgggattgtgcgactgcactccagcctgggcaacagagcaagactccgtctcaaaataaataaatacatatatatatatgggattaaatggtgagtggaattgtaaaaagaaaataggaatggagaaaaggaaattcctgtaccccttctgcttgatcaagactttaggacaagcttgtccaactcactgccaaggatggctttgaattctgcctgatatacatttgtaaactttaatacatgagattttttttgtgatttttttttttttaagctcatcagctattgttagtgttagtgaattttatgtgtggccaaaaacacttcttctttttccagggaataaggcccagggaatccaaaagattgaacacccctgctttagaacattgatttgtatcagttatatataaaagctgattagccatctttataggtcttaattttatcactacctgtaaggctttttaaaaatgtagttcttattttaattagagttataaatgcacgtgatttaaaaaagaagatatttccacaagcgtgtcaagaactacgaagggtctgagattttaccctacttgaaagttaacaagcctgttaacaattttcatggatcctggcaaaagacacagactcctgggccagagatgaagtgccatttatgacctatattaagcagtagcagaggatcagcatttttcttttaggttgctagagccttaattcccacagggcagtatgaagagggccaagtgataactacaaacagtgggttgcattatgggaaagaaaccctgagcttagagaagccaaatcttttatagtgggcagtaagcatgctgtgctttgccccaggtaacattgtctttattatattgtcagtaagaaggtttgccctttgctagggagggaaacaccatctctgtctttctaggctgtttgctataaaaatagccttgaaaaaattatctggaacaaaaagacagtgcctcacttgcaagatgtacagaaatgcaagccacccatggcgaattgcctcccaacaaagagttgtacttacgaaaaacagcatgcttctcccaatggccccccaaatctcctactccctaaaactccattgtccattagaaatataatgtgagaaataaaattttctagtagcagcattaaaaaaaaaagaatcagggctgggcgtggtggctccatgcctgtgatcccagcactttgggaggctgaggcgggcggatcacgaggtcaggagatcgagaccatcctggctaacacggtgaaaccctgtctctactaaaaatacaaaaaaaaattagccgggcgtggtggcaggcgcctgtagtcccagctactcaggaggctgaggcaggagaatggcgtgaacccaggaggcagagcttgcagtgagccaagattgcaccactgcacttcagcctgggcaacagagggagactccatctcaaaaaaaaaagaactggtaaaatctttttttatccttttgagacagggtcttgctctcttacccaggctggagtgcagtggtgtgatcatggctcattgcagcctcaatctcctgggttcaggtgatcctcccacctcagcctcctgggtagctgagactacaggcatgcgccaccacaccgggctaatttttttttttttttttttggtagagatgggagtctcactgtgttgcccaggctggtctcaaactcctggactcaagtgatcctcctgcctcagcttcccaaggtgctgggattataggtgtgagccactgcatctggccaaattaacagtatattatctttaatctagtatatcaaaattttataatgttaatatgtaaacagtataaaaaagtgaaatattgaaatgatacatgtgtctaatatttgtattacaatgtaataatagtatcttacatgatgtcattaaagtgaaatatagtcctaccgaaacagtaatgtgtttaagggaaagacatttaatactgcttcaagttttaaaatgtaaataattaaaattttaaaaaagtatttgttgagactagcctcatttcaagtgctcagtagttgcatgtgactactagctaacattctctactgcatagccctgaagttaaccattttcaactttttacagatttctttaggtgtgtattttcatatctctaaataataatgcttatatggtttctaaattattcagctttaagttctttctactattaaggaggggttttttttttattgttttttgttttaatagagacagggtctttctctatcacccagtctagagtgcagtggtgcaatcatagctcaccgcagcctcgaactcctgggctcaagtgatcctcccatctcagccttctgagtagctgggtctacaggcgtgcaccaccacacccagctaatttttaaatttttcttgtttttgtagagatggtatctcaccattttacttaggctagtctcaaactcttgggctcaagtgatcttccaacctcagcctcccaaagtgctacgataacaggcacaagccaccacacctgaccattaaggagggtttaattctctttcaaccaaaaccctccaccacacttgcactcatttcctggctgtctctcatccccaaagtcaatgattctgaaaaactttttgtcgtgtgtgtgtatttttaaatatgagatggggtcttgctatgttgattcaggttgttccaggctgatctggaactcttgggctcaagtgttcttcccgcctcaaccttccaagtagctgggatcgtaagtgtgtgccaccatgcctggcctgaaaacttttttatttcagcactgtttatactttaaaaaaatcactgaggatcacaaagagcttttgtttatgtgggttatatctattggtatatattctatcagaaagtaaaactgaggctggacatggtggctcacgcctgtaatcctagcactttgggaggccaaggcaggaggcttgcttgaggccaggaattcaagatcaagtttaagtccagcttgggcatcatagtgagaccctatctctacaaaaataagcagccaggtgcacctgtggttgcagctacttgagaggctaaggtggaaggatccccaggagtttgagcctgcagtgagccaagataatgacattgtactacagactgggtgatggattgagaccctgtcttaaaaaaaaaaaaaagagagagaaagcaaaaaacttaagtattacttctgtgaaaataacaatgataagccctttattttaacataagtaatttcttgtgaaaatcttttcagaaaaattggaagaataacagtgtttttgtatttttgcaaatctcttttactgtttgacttaatagaaaatacctgaattctgatacttctgcacttattctgttgaaaacaaacacatcatgtagaccctggaaaactgcgccgtatataacacagagggagtgaaaagggtgcagaatggcctagtattattatgaaaatagttttgagaccctctgtatattgtcatgctttttgtttgaccacaactcaatgtttatattactatagccatgtataaactgagcatagcataccatgattgcttttttttttttttttttctgagatggaatctcactctgttacccaggctggagtgcagtggcaccattttgggtcactgcaacctccgcctcccagattcaagtgattctcctgcctcagcctccagagtagctgggactacagactcgtgccaccacacccagctaatttttgtatttttagtaaacacggggtttcaccatgttggccaggcttgtctcaaactccagacctcatgatccgcccaccttggcctcccaaagtgctgggattactggcgtgagccgccgcgcccgaccatgatttcttttattgtacatacttgttggcatattttactcacttgtactcaatggcattttttcatattgtttgtttattatatgtacttttatgttttttggagatggagtctcactccgtcacccaggctggagtgcagtggtgctatctcggctcacttcaacctccacctcccaggttcaagtgattatcctgccttagcctcccaagcacctgggattatgggcgcatgccaccacacccggctaattttttgtgtttttagtagagacagggttttgccgagttggccagcctggtcttgaactcctgacctcaagtgatcagcttgcctcggcctcccaaagtgctgggaggcctgcattttacttatttaattctggcctgcacctggcctgcattttacttatttaattctgaactctaccttagttatcaaaatctcttctaaatccattaatttacagcaggggttctctgtttctctcaaatattttctggagctgtttacttgctttaattaaggactggtttcttcctagtactcccacacaaccatcatcttgggatctgtctttgtaatcctaggatttctgttgcctctcatttatattgggtcccttgattactggatcctgtctcttccttttttttttttgagacaaggtctcactctgctgtcacccaggctgaagtgcagtggctcagtctcactcattgcaacctccgcctcccaggttcaagtgattctcctgcctcagcctcccaagtagctgggattacaggtgtgcgccaccacatctggttaatttttgtattttcagtagagatgaggtttcgccatatcggccaggctggcctgaactccagacctcaagtgatctgcctgcctcggcctcccaaagtgctgggattataggcgtgagccactgtgcctggccagatcctgtctttttcttaatgggcagtagagcgcaaacttgggggccagattatgtgagtttgaagcctagctcttctgcttactagccatatgacgttcgaagagctatttaacctctttatgcctcagtttccttatctggaaaataatactttctatgtagcattctcctgaagattctatgtgttaatacgggtaagccatttagaagagttccagagcatattaagcactccaggttagtgatgttgttaatgctcttacagttgctggtgaatttcatcttttagtggcatacttctcatagtaacctgctgagaaaggtgcatgtgactttgctgtataaaaatgcctttctgttacatcacatttgaccaatagcttggctggttatttagaattccaagttgaaaacagttttccttcagaatttggaaagcattgctctattttagtctacctttcagcagaaggtgggctgtaaattgcacggtctcagctttccccatagcctgctttaggattcagcttcctgagatctccaagtcagttatcattcactacctctaattttcaaatttttgatgctactacttcagttatattctttgtgtttgagggacttagccttttttgaaaaattgcttattatcattttatcttaaacagagtatgcttttagatatcttcagttcctgcaagtttgtggggaactagaaacagaactcttttctggcagtcaaaagagaagaaagaatagggctgggtgcagtggctcatgcctacaatcctagcacttcgggaggcagaggtgggtggatcacttgaggtcaggagttcgagaccagcctggccacaatggtgagaccctcatctctacttaaaacaaacaaacaaacaaacaaacaaaactagatctaaatttttagcagaagagcttggccggttcctcatggccagccacagttagggtctcagcagtttgttcagtgtgagaccacagaggagctaagcagctcactgcagggagtcacagacaggtatcagagactaccctccaagcagggcaaggttgtggtggggacagagaccaaataccctaagatgagatgaggctatgaaagtgcaattggccagaaagaactccaccctgaatggcaaggccttcgccttgtgatcttacctgtttcctgctccttcccttgacctaccttgggtggcgtttgggctccctcacttgggtcacagtcctccgagatactggcatggctttgacatcaaacacagtagttggtattttgctccagtcacagcagcctctgggacactgaacagtagtccttggagagtcagtgaaattgataagtattcactgggactagaagccaactgaacttagaccatgcttcctgctgccgaagggcaataggttggtgacccaggtttatccatcagcggtttgtttatgcatagatgtgtgcatatgcttacgtgcatatgtaggcatgagccaccgcgcccagccagttttgtcttcttgaagatgtctctcccagggccttctgacaggttccagtctgctgtggttgtctgttggcttgttatatggcctagatgttccttgacctggggattctcttttttttcttcttcggttagatctcctttctgattcttacatcctcccctttcttggttaataatgcatacatatatttgagacagggtctcactcctgttgcctaggctggagtgcagtggtgcgatcatggcttactgcagccttgacctcctgggctcaggtgatcctcccacctcagtcccctgagtagctgggactacaggtgcacaccaccacacgcagataatttcatattttttgtagagacagagtctctccgtgttgcccaggctggtcttgaactcctaggctcaggcgatccactcgcctccacctcccaaagtgctaggatcagaggcatgagccatggcacctgtctaataattattgaatataactcattctccagtagctggacagtagctggaatacattttgcttctgaatccatttgatgtggcttagtttcccccctcccctgaaagtatatgcagtattcttcctcccattgttctgacatttcatgattaatgaatacatcttggtgtgggtctattgtcatccactgtgctgataccctagaagattttgcaatctagaaaccattctttcattttgggaaatactcttgaattatttagttgacgacttctttccttttttctttttcttctgttttctttttctggagctcttgttattcgtatggtaggtctcctgatctagttctctaaattactgtatgttttgttttattttctcatccctcagtttgtctatttgcttaactcgctgtgagtgtttctcactttatcttccaacccttttattgagtttctctatttttggagctggagtcttgctctgttgctcagggtggagtgcaatggcacagtctccgctcactacaacctcttcctcctgggttcaagcgattgttctgtctcagcctcccaagtagctgggattacaggcacacaccaccatgccccgctaatttttgtacttttagtagaaacagggtttcatcatgttggccaggctggtcccaaactcatgccttaggtgatctgtctgcctcgtcctcccaaagttctgggattacaggcctgagccactgtgcccagcctaagccagcgcacctggccgagtttttcatttttgctatcatgttaataattttcaagggctctttttatttgctagttctatttatgtggtttcctgtttgttctagtcatctattgctatgaggcaaaccacttcaaatgtagtaggatacaacaatatcattttatttttttgctcacacattctgttggtcaagaattcggtgaagactggagttactaggggctgtagtcatctgatggcttcttcactcacatgtcagacatctggctgggattacttgaaaacagggttcagctggaacagttgactaaggtacctatatctggtctctccatgtggcttcttacagcatggaagctggttctaaaagggagcctctatctagagagcacatttttcaagacaactgggcggaagctgcatggttttacatgaccttgccttgatggtgacatagtatttcttttgccaaactttattggtcaaaccataatcataatgtgtctggagttggttccttctggagggttcttggtctcactgactttaaaaatgaagccgcagacctttgcagtgagtgttacagctcttaaaggtggtgtggacccaaagagtgagcagcagcaagatttattgtgaagagcaaaagaacaaagcttccacaggcgtggaaagagaccccagcgggttgccactgctggctcaggtgtccagctttttattcctttatttggacccgcccatgtcctgctgattggtccgttttacagaatgctgattggtccattttacacagtgctgattggtctatttttacagaatgctgattggtgcatttacaatcctctagctagacacagagcactgatgggtgtttttacaatcctctagctagacagaaaagttctccaagtccccacttgacccaggaagtccagctggcttcacctctcaatcccccctctaaacaggacaccccaactgctgttgggaattgggtgatgaccgctctagctaattcctgctggataagagctaagaagaggccctgcagttgtagtgtcctccagaggggaactctttaggccagtcaaaaggccagtgggtcagtccaggggtcctcagtagaagttgttagttgagctcatttggggttccatttgtaagatcatctgtagcttgatggcctcaatcctagaggaaacaaatttgacaaggaggttaaaaatacagggcccgaaggcaagtaatagcaagatggctgtcatgggacctagaaaggggagaagtcatgtccaccaactccagaggttggtataagagtttgaaaggcgttgtctgatttcagaagccttttcctctaagtgccgggcagcatctcgtactatccctgactggttagtataaaagcaacactctttccctaagaaggtgcaaagtcctcctttctcagcagtgaggaggtctaggcctcagcggttttggagagtcactgctgccaaagagtctatttgggattgtagttactatccttactggatagattttttatttcttgcaaactgtatgagaaatcctttgagagtgtgtggtagtaatgaagtagataaacttgatattctggttcctgtagcagtggccatttctaaccctatacgtagaggtattagttgtatggccctgtgctgacagacttgagctttgaggggcactgacaaggtctgatttccacaagattagaagttaggataatacacgttacactgttaacgtttagcgaactttacttttgttgaaaatcttgtaagtttgggattttaatttttgtttgctattaataaaaccttgttcagtccatagtaacttagaattggtatagatggctccttcctgattctgtaagtactttaaggtttggctgagtgcaaagaactcacttgtttgagcagaccaattattaggcaagtttcctaactgcaagagttttcttatcacttactgaatacccattgtgtcttttcctgttctgaagggagttcctcctaggtcagacctttgtatgataattagttaagatttagatcccctgtaaggaaacctgctgggttaaggatttttgatcagaaggctgtgagttgtcagtggtctcagtgcttttgggctacgcccttgtttatactgacaacaaggtggtactggagtgttacagtgttacagggaagaccttcaattatcaattataggtttttaatttaccctggcttttaaaggaatagattacacttttttctttactacttccatctctctttctttctctttgacttcttctttgtctctctctttttgactccctctttgtctctcttcctctctctctttgactttgtctctttctctctctgactccctctttgtctctgtctcttcctctctctctctctctgactttctctttctctctttccttactgctggtctttccctgcctctgccagctgcttatgctgctgttctcctctccttcccctttttgatggcttcggcagtgtaagactgccacctctttgggtttttgcactgcatgcaataactccatgatttccttgtggtatttaatgggtgtccccccagaggttaggaactccctttctttccatattgcagcatgggcatgtaggattagataagcatacttgctatctgtatacaaatttgttgtttttccctttcccagttttaaggctcgggtaagtgccactggttctgctaactgggcgctggtccctgggggaagaggcttactttcaagtactgttacatcactaactgtggcataacctgcccttcatatcccattctccacaaatgaacatccattggtatataggttaaggtcaggattagctaaggggacttctaagagatcctcttgggcagcataagtctggacaataatttgttggcagtcatgctcaactggttccccatcctctgggagaaaagtggcagggttgagggctgcacacgtgcatatttgaagcaccggtccctcaaggagtagcgcctggtatctaagtaggcagttgtctgatagccatgaacttcctttggcacctaatatgccatttacatcatgagtagtccagacagtgagatcctttccttgtattattttgatagcctctgacactaagacagccaccgccgcaactatctgtaaacagtgaggccagccttttgctactgtatcaatttccttacttaggtatgccactggttgtggggttgtcccatgagtctgagtaaggacgctaagagctattcctgctctgtctgtgatgtataaagagaagttttgtcctgtgggaaggcttaaggctggagcttgagtttgttccttccaatgcccagacttcagggttgattccctcctcaagcagcggacaacaaatgggtaacttgttccccatattcatgtagataatagctccagctatggataatatgtccctccctaataaaggtatgggactttcaggcataacaagaaaggcatgtggaaagagcaaagtctcccaattacaactgaggaggtgggagaaatacctggttacaggccatcccaggattcctcagatggtaagggaccttgaggacagctgtccgggacaggagattaacacgagaaagccgcaccagtgtccaggaggaagtcaatttcctggccctcagtggttaaatgtacccggggctcagtgagggtgatgacatgagctggtgcttgccccgggcaccctcagtccttttgttggattatctggttggcggcttctggcccagagaaactttgtgccttccagtgatttccgcggcatagtggacacagatgagggggcagcttgtttctcgttggacaatcttttttaaagtatttctgcaaaccacactgataacaagccctactgggtgattggcctgctccattttctgtcctctctaaaccagcaaggtttgtttgtctgagagccatgactaaggctgtggcctttctctgatcccgcttttccttttaggcctgttcctcttggtccctattatagaataccgaggttgcgaggtttaataatgtctccagattttgttcagggcccaggactcacttttggagctttctcctgacatctgcagctgattgggtaataaacttatcttttaggatcaattgaccctcgagggagtcgggtgacaggggagtatattttcttaaggcctcccgtagccgcttgaggaaggcagaaggattctcttccttgccctgagttatggtggacatcattgaataattcatgggctttttcctaattctccttcatccttctagaacacaggtcagcagacgtttacgactccagtccccatgatctgagttgaggtcccagtgggatccatacaggggatggcttgctgaccggtagggaatttgtccctttcgtcagctgtcattctatcatttacttgactaagataccaggtatctccaaactctcgggctgcagctgaagccacattcctttcatttaatggcccagagtttgatctaacaatagcatgacatctctccaagtgagatcaaaggtttgccctagaccctgcaggacatctatatacctatcaggatcatctgaaaacttccccaggtctgccttgatctgctttaagtcagagagggagaaggggacatgtacctgggttgggccaaattcccctccccctacagcttgaaggggacataactgatagcctgggggtttttgtggtcctttggagatttctttgcttgtttccttctgggcgggggagattagaggaggctcatcattaataggaaggagagctatagggaggctaggatatggagataagctgagaggtcatcctgtgggatataaattgcaagctttgcatagttgtggattctccttcaatgaaaagaaagcttggacataaggtatttcactccacttgccttcccttttacagaaaatgtcaagctgcaggatagtattgtaatttctacttccctcaggtggacatttttccccatcagagagagaatattggggccaggccatagtgcagaaaaaaataagccacttctttttcagggtttgcaggtcagattgtcccagtggcttaggatgcatttcaagggtgagcctgttgatgcctgagtgtttcccatctgaaagaaaaaaccacccgcggttttggtttgttccccgccccccaccaagaacccataacggtccctggaccctgctgattggaatagttgcactcaccgacacagcagcagaaacactagttttcctgctagaccacaaggatgaccgaggaaggtcagatttagtggcccttgctgacgcattcttgaaaacctgcacccttgcgtattctcctgggccacaaagaggactgagaaaaatcggatttagtgacccttaccaacacattcttgaaaacctgttagagtcctaagcattctcctgttagtattgggaccttacccctgtcccataaagatgttatgcccccaaaatgaagtggagggccataccctgagggagggaagggatctccagggttggaagagtgacacattttgttctcacttctcatcatatgaataggaaggatatcatgtctgaggctccccatatcctagcttcaggagtagcttttgttaggcctgctagtctgagaaataattttggcaaaaattatttctttctgattggtgagcccaggtgcctaaagaagggaacagagtcctgaagtttatactagaaatcattcttataggagaaactagaaaagcaccagagacagggagtggtttttataatagggactagcctcggagaagagagcaagaagtttgtctgacaggctttaggagccaggaggcaagggtcaggatagataggatagatgggcgagtctcacttgggtgatatgacttggaggagagttccgctcttggctacagggtcagccaactttctgtcaggaccccggagctgaatggctttcctctctgtcaaccctgggctcagcctggaagtacaggaaaagcggaagctgttttcaggcaaaccaacactcccaactccaaagagttgggggttgttaggtagccatttcccagaaaacctgacacccgtatctttagtccggcagccgcactagtcgcttttaactggccgataggtgcccagtatttagccaccgaattctaaggaaaaataggacagaatagcaagcgaaaggggtccgatggtactcactgcttggtgatggtccaaggtcaccaagatgtgtccagcattggttccttctggtggattcttggtctcgctgaccaagaataaagccgcggacctttgcagtgaatgttacagctcttaaagatggtgtgtccagagtttgttccttcagatgtgtctggagtctcttctttccattgagttcatggtctcgctgacttcatgagtgaagccgcagacctttgcggtgagtgttacacctcttaaaggtggtggggacccaaagagtgagcaacagcaagatttattgtgaagagcaaaagaacagagcttccacagcatggaaggggaccagagcaggttgccgctgctggcttgggtggccagcttttattcccttatttgctcccgcctatgtcctgctgattggtccattttacagaatgctgattggtccattttacacagtgctgattggtccatttttacagaatgctgattggtacatttacgatcatctagctagacacagagcactgattggtgcatttacaatcctcgacccaggaaggccagctggcttcacctctcaataaggccactcaaattcaagagggagggaatttgactacttcttggttggggagtggcaaggtcatatagcagaagaaaatgttgggtgaaaatattggcctggctgtcttcagaaaatatattgtgcctcattaatatttttttaacatatttttaactttatatcctgaggatgttagtggtagttttctatatcctgagaatgttagtggtagttttcctctccctgaacagtctgtttcatttgactgtttgggggtctcccagtttaagcaagatatttaagccttatttctcttggcatgcttggattccccagtaaaaaaaactcctgccctgggctgacaatcaaagttctgggaactaatatggataagcaagctggaaatggagaaggctattcactgtgcctgggtcctactgttttctggatgggaactgctttccattaggcctggtgtgccctggaagggagagcctctgcagagactacatcttggatgggtctttgccaagtttgaggtagaaacccagctgctttgtaaagagctactagtggatactttgaacaaaacaaaaaacaaagcaacaccactcctccatcattctccgcatccccccttcagagggatccgtgcaaccagcaccagttcctgcaccctttgaagatcctgcagtgtaaatagagctggtctgttctttcccgcctgtcagcctgggatttgtgcatatgctttttcagtttcctctcgtccatctgcttttccagtttgatttctgcctcctgtctccctctccctgaggtcattttgtccatcttcccactccattaagcactcagcggcaccctgtctatctggtggtgctgactctctttatgttggaacacttttagtgaccatatcgtcaccttaggggcacctgatacctatcttctttttcccttccttgactagctttccttcttattgactatataaaagataagtatttattttcagtattcttagaatttagtatttttgtatttcttggtcttaaaagtcaagtaccaagaaccattactttcaggtactggctttcctctgttccaactcacggtggaattatttcatttctcatttcttcttaggttatgcgatctacttaaaattatatagggtagtgtcctcaaggaagtctcctcttccaggaaaggaccagtgtccactgagggaccttcttcaggacatgccccaggtcagttgttggattaggcaggccttgggcgagtgaggcttagtatggtttgggacttgagtttttcttgctttcccagaattcatgagcttttgtcatttagaatgtttcttactcttctgtagttgtcctcactggcaaatcccaccagatattcttcagtgagtatgcttcctgagtgaaatataaaggtgaaggaacattgggcagagcagtattaactacccatggccacatttttgttaattattttggtatttattccttgtgtgggtgtgtaatttttggtaaagttgcattaaaatagtatagcatgtgcgcatttttacttccctttaaacttcttttcttcttggaaatctctttggctatgaaatctcattttcctttcacccttctgattcttagccgagttttacttaagaaaacgttgtatgtcttgaaattaggttggttaattacaattccttcgaatgatttgacttctgtattcaccctgatgataaatagacaaaatcaaaagcatttttgacaaagtaatgctttctcacatatttagcttctttatagacacttacccatcttgttaaaacccaaaactagtgattttacgttgtaaaaagcgtttttcaaagcatgtgggccatgtaggatgtagacgacagtggtaaagacctatgccttttttgaggtgagatccaagtgtttggttttgaactttgtattttctatttggatttcgaggtgaccctttcatgtacccacattccataaaatcctgtttaagataattctacttctcctgtttaaaacaaaaaaaaacccaagactcagcggtgtcacaatttgtaacttaaaatctgtttactttggtgaactttattgttactattctaataatagctttattgaatattcacataccataatgtttacccttttaaagtaaacaatatgttcacaaagttctacatcaatctctactatctacctagagaactttcaaaggaaacctttgtacctaccagcattcattgccattcccccatgtccccagcccctggcagacactcatctactttctgtctatatggatttgctttttctggacatttaatataaacagaattataaatgactatttcttagcctaatgttttctagattatttatctacattgtatggaacttgtgtgagaccttcatatcttattatacccgtataatatcccattttatggatataccatattttgtttatccattcttcagttcacggtcatttggcttgcttccactattttagctattagtaatgccattatgaacatttgtatacaagtttttgcgtgaatatatgttttcatttttcttgggtatatacctaatagtggaatagctaggtcatatggtaactctagttttaattttctgtggacccaccaaacattctaaagcagcttcaccaagcatttacatttctaccagcaatttatgatggttccaatttgtccactcaatgagataaaaaatacactagggctgggtgcagtggctcacccctgtaatcccagcactttaggaggccaaggcaggcagatcacctgaggtcaggagttccagaccaaccaggccaacatcatgaaaccccgtctctactaaaaatatagaaattagccaggtgtgggggcgggtgcctgtaatcccagctacttgggaggctgaagcaggagaattgcttgaacccgggagccagaggttgcagtgaaccaagatcgcagcactgcactccagcgtgggcaacaagagcaaaattccagctcaaaaaaaaaaaaaaaaagaaaaaaagtgtatacacacacactgtcagcctgtcaacacagttttatcatcataaattaatgtagctgtcttttaaatcagatgggaagagagttacaaagaaaattacattcatactataaatttgtctgtatatatatacctttactgctgctttctattttttcatgtggatttgagttgctgtctagaatcttttcatttctgcctgaatatcttcatttagtatttcttgtagggtaaggctgctagtgataattttttttttaatttatctgggagtatcctagtttctcattgtttttgaatgattttgctcattatagaatttttggttaacaatccttttttttgagatggagtcttgctctattgcccaggctgaagtgcagtggcatgatcttggctcactgcagtttccaccacccaagttcaagcgattctcctgcctctgcctctcaattagctgggattacaggcatgcaccactacgcccggctaatttttgtatttttagtagagatggggtttcacagtgttggccaggctgatctcaaactcctgacctcaagtgatccgcccacctcagcttcccaaagtgctgggattacaggcatgagccaccacacctagccaacaaactttctgcgcgttgaatatgtcactcactgccttttggtctccattgttgtttatttgaagttgttaatcattttcaggatttgttgtataatcacttttctttaacattttcaaaatcctttgtccttgtctttcaacagtttgattatgaaatgtctaggtaaggatatctgagtttatcctctttggcgctcattgaacttcttggatgtgcaaattaatttttgtttcaatattaatagactatttttagagcagttttctgtttacagacaaattacacagaaagtacagagagtttccatttaccccctcactgtttctgctgttattaatatcttacattagtgtggtacattttttacaattaagccagtatttatacattattattaattattgatacattatttttttcaactatttttctacctccccaaacttgttatataaattattattaagggttcattctttgtgttgtacattctatttctttattgaaattttctcaatttggttagataccatactcgtgctttctttcagttatttagttctttgaacatatttataagagctgatttcaagtatttattaaatccaatgcctgggcttccttggggacatttttattgactgcttttttttgttccacccccctgtatgtggaccagacttttgtgtttctttgcatgccttgtaattttttttttgttgaaactggatagtttataatgtgtcaaccatggaaatcagatctctacccctaccctgaggagggtttgttgtttttgttatttgtttagtggctttcctggaccagttgtctaaagtttatattctttgttatttgagacccactcaagtttctctcagttagttagtggtctgctaatgattccatagagatttccttatgtgccttgaaccagtaaggggcaggaattacttaaaggcatactttttgtagtgttttgatattttagtggttgaaattcttatgttttgttaccgaagctccccgtggtcgctttctgatagaggtgtggagtggggtggtgatcaagattgttagaagaaaatgagatgagcaacaaattcagcttcaggattgtcattaatttgccagtgagcattgggaatcttcacagtgggggaaaggatatgttggattttctaatcatactggactgttaaactgttccttggtatacattaagggaaatgctgctagagttttctttcaaagaacttaacctaaatttcagggtgttttcaaatctttagcaatccacaaacatagaattagaaaaataagtaagactagagagaaggaaattttaaaagagaaaagttaaccacccataattttgagaaaaaaaagcaaatatgtaggattagttcaccaacatattttctgagtgtgtgaatactatgtgtccatatatcccttgtcacattgttttttaatttcacagatttctttaaagactcgtgcagcacatcattatcgctggatgcccggacatgtaatacacctgacagcatgtgaagtgctcagaatggggcaggatgtcacctggaatcagcactaagtgattcagactttccttacttttaaatggtaaaaagtctaaatacttttcttaacattattttatattaatgatggtcagttattcatttttatttgtattattactattcacaactcatttcctaatgaaatagttaagtttctggcattaaaaactcgtgtcaaatctctagaaatcttgttatgaacagatttataacggtcaaattggtagtacttgactttctttttttagaacagcagcgcttatcagctgtagaaccaattgccaagttataaaattgatttttgaaaacaaagctatttaatgtttgtaagcatttcatatagtaaaagtgggttgtgttcctggaatttgaatatagatgaaggtctgtcataaattacaatttgtatacactattgttttctgcaagacttagttattacagtctgttataactaatgcagaaaacgcaagctgtatctctcttttggattatgaatactttgttttcttgtagtttctggcatggaactaaactcattgtgggactaacccaacacagtcccaaacggggctttgtttcatctgagccttttcaatccaatttgaaaattctgttgacttgcccttccttcaaagattcttagaagtcacaaccatttccaaacttctccctaagtatgccccaaatcctaaatcagcaaaaagcagaatggatctgatctcttttagggctgctgacaccagctaatggacattaaaacatgtcaggaggaacttaaattactaacgatttcaagaacaaggggtggtaattctggcacagtgtcagaaactcatcaactatagactgttcaatcattattgcctaggcgtccaactatggttttgcacctcaacataccaaagaggtaaaatgcttgttgttagatattctagtgcatccatgtactgggatttggggtttgttttttcttttgttttctttttcaatctgtggtataaatactagagactgtgggcttcctgtactactacaatttatcctctgattcagccactttgtttttgttttaaacctaacctcatagcaaagaggacagttttttgagcctgagaagatttattgtgaaaaactctctctctctctctctctctgtatatatatatatatatatatatatttatttatatttataattgcttcttttatttcagtgctgctcttcatttcaagatgccgttgcagctctgataaatgcaaactgacaaccttcaaggccacgacggagggaaaatcattggtgcttggagcatagaagactgcccttcacaaaggaaatccctgattattgtttgaaatgctgaggacgttgctgcgaaggagacttttttcttatcccaccaaatactactttatggttcttgttttatccctaatcaccttctccgttttaaggattcatcaaaagcctgaatttgtaagtgtcagacacttggagcttgctggggagaatcctagtagtgatattaattgcaccaaagttttacagggtgatgtaaatgaaatccaaaaggtaaagcttgagatcctaacagtgaaatttaaaaagcgccctcggtggacacctgacgactatataaacatgaccagtgactgttcttctttcatcaagagacgcaaatatattgtagaaccccttagtaaagaagaggcggagtttccaatagcatattctatagtggttcatcacaagattgaaatgcttgacaggctgctgagggccatctatatgcctcagaatttctattgcattcatgtggacacaaaatccgaggattcctatttagctgcagtgatgggcatcgcttcctgttttagtaatgtctttgtggccagccgattggagagtgtggtttatgcatcgtggagccgggttcaggctgacctcaactgcatgaaggatctctatgcaatgagtgcaaactggaagtacttgataaatctttgtggtatggattttcccattaaaaccaacctagaaattgtcaggaagctcaagttgttaatgggagaaaacaacctggaaacggagaggatgccatcccataaagaagaaaggtggaagaagcggtatgaggtcgttaatggaaagctgacaaacacagggactgtcaaaatgcttcctccactcgaaacacctctcttttctggcagtgcctacttcgtggtcagtagggagtatgtggggtatgtactacagaatgaaaaaatccaaaagttgatggagtgggcacaagacacatacagccctgatgagtatctctgggccaccatccaaaggattcctgaagtcccgggctcactccctgccagccataagtatgatctgtctgacatgcaagcagttgccaggtttgtcaagtggcagtactttgagggtgatgtttccaagggtgctccctacccgccctgcgatggagtccatgtgcgctcagtgtgcattttcggagctggtgacttgaactggatgctgcgcaaacaccacttgtttgccaataagtttgacgtggatgttgacctctttgccatccagtgtttggatgagcatttgagacacaaagctttggagacattaaaacactgaccattacgggcaattttatgaacaagaagaaggatacacaaaacgtacccttatctgtttccccttccttgtcagcatcgggaagatggtatgaagtcctctttggggcagggactctagtagatcttcttgtcagagaagctgcatggtttctgcagagcacagttagctagaaaggtgatagcattaaatgttcatctagagttaatagtgggaggagtaaaggtagccttgaggccagagcaggtagcaaggcattgtggaaagaggggaccagggtggctggggaagaggccgatgcataaagtcagcctgttcaaagtgctcagggacttagcaaaatgagaagatgtgacctgtgccaaaactattttgagaattttaaatgtgaccatttttctggtatgaataaacttacagcaacaaataatcaaagatacaattaatctgatattatatttgttgaaatagaaatttgattgtactataaatgatttttgtaaataatttatattctgctctaatactgtactgtgtagtgtgtctccgtatgtcatctcagggagcttaaaatgggcttgatttaacattgtttttgtgttatttttgcttgaaacaacgcacacattttcaacaaccaaaaaatgacaatttctagtttagttaatttctacaaatcatcttatgttattagcaaggttaagacatcttttttaaaaaaattatagcttctaccaagagaaacactcaatttttctagagatttgcctctatcttcctttcctcagtcttcccagactgctatcaagctgtgtaaaaatttactttcactggaccctaaattattgtctctgctatctgactgccagtaattagtgcagaaaactaagacaggatgatacaggtttgaggggctggggagtgggaggggggagaaaaggaatgtatttaaacaatttccgatgcccatgatgagtttaaaaaccagcattgacaccatccccaaaattaaggctgtcgcttattgaatccacttgtgtccaacctcccaggattgttttatcctaatgtcacctgtatattcatttgaaaggacttggccctgttcttgggtcttcccgttacctgccccctgggtggtaagtttcctcctttctcaaccttccacgaggaggaaagaagtgtgcagtcattccacatggcctgttggaaggcctggggagggaactttgggtttgggacagatttttttttttgtttttggtatcattcacagcatacgatttttactctctccatcttcaccataagacagataatttggggttgctataatgctgtcacacatctcaaagtacattcaaatcttaaaaagaaattctcgtacttttgccatgttgatactgttcagcaaacaagctaccaggaactgtgaggctttgtcatttagcattagactttaaacaagaattaaaatcatgtgctgtatttttaaaatctagccaaattaaatagtacatgagaaattcagagtattagacagttttaaggcattcaactgagaaaactttatttgtcaaagtcagaaaacattttcatcttattgagagatatgtttttaaacttttatcatcatttgtaaatgtggaagttggtggattgctgtgtttttgcatgattagcatgggagtctgttggagcaagaggaacatgcttgttttgaaaactcgagatgatgagggtggtacatgcagtgtgttctctctttattggcttctaaaccagttttgtcctttaatgcatgtcaaatatttctcccatgcttctcttagcagaaaagtttttacctataagacagggcaccttttaactctaaaactagtgatactcagtgacatagactttgtcttataaacattttttcattttttattttgaaaaattgcaaatctacagcaaaagtaaaacagtagagtgaacaccatgtaaccctcacctggtgttaacattgtaccctatttgctttaagttgtatgtatttctgaacttggcaaaattggaaattaaaatttttaaaaattacaaatatacaaagttatttatcttagcacatttattatgtgtgactgcatctgatttatatttaaattggcaggttttgagggatttttttcttcatcataaatgtaaacataggattttagagtctatttccccaagcgccacattataactgtaaacttaccatcttctatgtagctgtgatatctcatctttctaaaatggaacttgttaaaaagtgttcaaacactatccctaatgcctgcggcagaatttatatacgatccattcattggggctcaaagtatcttttagacttttaaggacaatttacagcaaatgaaatttatgatgctgtgacaagaaatttaaagaatcaaaacgatggtttgaaaaggaaacctatgatacatgcaggagaagcaaaacccaagtgattggtgagaaatatagaaattatttaaattactttatagtaattattaaacactaatttttgtactgtcattgaaggtgttttatagagaaatctgagaaatcacattcacaaattagaagtcaaacatggccaggcacagtggctcacacctgtaatcttcaggatttcaagaccagcctagccaacatgacgaaaccccatctctactgaaaatagaaaaaaaaaattagccaggcttgcacctgtaatcccagttacctgggaggctgaggcaggagaatctcttgagcccaggaggcggaggttgcagtgagctgagatgccaccaccacaccagcctgggtgacagagtgaaactcgtatctccaaacaaacaaacaaaaagtccttaaacatatgtgaacaaaaattttgtgatggaaggattctagttaatgagtattgcatcaagatttacatctttcttactaaggaaaagagttaataaaaattgttctttattttacaggcagttactgaggctcttcccagatctcagtaaacagccactcagccttgaaaatggagtgttgttgtttctaaacatatatttatgtcatttattaagtacagttcacttaaataacataagtagattttctcttgtagtgatttgggtaggaagaggccatgtttcagttcgttttctctgtagggtcgattgaattggaccttttcagttgttcagaaaaataaaaataatttctcatattaaatacagacgctcctcaacttatgatgtgggtaggtcccagtaaacccattataatttgaaaatatcacattgaaaatgcatttaatatctcttacctgaaatcataacttagccaagcctaccttaaatgttctcagaacatttagcctgcagttgggcaaaaccatttaacacaaagcctattttataatgaagtgttgaatagctcatgttatttactgaatactgttgtgaaagtgaaaaacaatgattgtatgggtactcaaagtataatttctactgaatgcatatcacttgtgcactgttgtaaagctgaaaaaccgttaagcctctacgatttttaagtaagttggggaccatcagtttaaaataaatgcaatactatttcatgataaacatggtcactgtaagttttactcttttgaatgagggtgcgacagaatgcagttagaatcagttcatatcaccattaaaatcatccattcagaaacc

SEQ ID NO: 36769 - DNA, 36472 bp, Homo sapiens
ttccccggctctagcaggccggcttctctgtccaatgcccacccggagctgggaggaggagtctgcgtaatgtgcgtgtgaagagactgggggagctggccggggctcacggtgtttgacccgtcggtcgtgcgtgagaggaaagggaaggaggaggtcccgaatagcggtcgccgaaatgttccggtgtggaggcctggcggcgggtgctttgaagcagaagctggtgcccttggtgcggaccgtgtgcgtccgaagcccgaggcagaggaaccggctcccaggtgactgacccattccaggcaacctccaagtccgagggcctggcgccttaggctccctgtgccttgcagccctctacccccgcgtccccgcgagaaacttaacacatagtcacgtgaattccaaattggcagactccgaaccctgagtcttgcaagcggaggaattggctcagccatgccgacctgaccttcaagagatttgaacccagtagtcggcttgaggccttttcccgggagcgtttgctgttcagggatcccagaacaactggctgtcggcgcctccccggcatccccaccccccacccccctttttagagcaatgaggtcaagtagactttgtcatttaccgattgagactttaaacaggacgtttaagccctacgcctaagtttcttgtgtaaatgagggtgttatctgctcagccttccaaaccacagatgagatccatggatttgaatgcccagtgaaacagaaacggtgcagggcaagtaaggagtcggttggttgtgtaccagacacccagagaattggcccagacttaattggagatgcctgagccgtgtacttcttggtggtctttaaggcttcaaagaaacagtttgcagaacgcattgtattttgttctccattaagttgtttcatcaaattttagagctggaagggattttgtggtaaaggtcaacccactcattttatagataataaactgaggcacagagaggtgaaattacttgccaaaggtcacatagttaattaataggtagagctaaggatagtttgctagcctccaggtccttaatcccttcgctgcaactccatactgcttcctaaagttgacctcaaaaagttaagaatgaattcgggtctcttcccagtaattagcccattgtacatcagatatccgtgaatttatctgagcatggcttgagcctgcttcttttcgtactgcgttacttcatgggggcaatgaatgatccacctgtaggagttgctttgaaaaaaaaatcagtaatccttcaatgtccacccctagggcatttgcaatgtcagaagttatccttgaggcttttacaatacagaaacacctgggtgctttaaaaataaaaagtggaaaatattttccttgggttgttagggtctttgcaaatgtgcatttgaacagtttttccagttgctatgcacaatgaaaatgtttcctgataggtgtatttgagttatgtcctgggacatactgctcttggaacttaaaacctctgcttagcttttaaactaatgccttatcaatggatgtcatctttgagggttttgtgtattgaaatgatggtgctctgtgcttgttgcacagaaattgagataacctgaattttttttttttttttttttgagacggagtctcgctttgtcgcccaggctggagtgcagtggcgcgatctcggctcactgcaatctccgcctcccggattcacgccattcttctgcctcagcctccagagtagctgggactacaggcacccgccaccacgcccggctaatttttttttttttttttttgtatttttagtagagacaaggtttcaccatgttaaccaggatggtctcgatctcctgacctcgtgatccgcccacctcggcctcccaaagcgctgggattacaggcgtgagccaccgcgcccggcgataacctgaattttttcatccacactggcctttcaaactttgagtagttgttttgcttaagtctcacaacttttaccagcattctaaagtctgaccaaaagttctcatcaattaaatatgcatttgcaaagttaagttgatttattagacattggaaagtggttggtgttgttagaactactgaaaaatacagactcaaatggttttttccactgcatgtctttgtttgaaggcagtctactgtagaatatattcggacttcctgacatatccatccatctctttgcatacacttgttctttgtcctttggccgtgcaccaaagtatgacatcatctgcctttaaaaatgggtgagggtagtgttaaattttcaaaaagaagttctgatactctcattttaggaattaactctgttttgtggcttgattcctaactgcttttaatctgatttctttttcatgtagtagcatctaccgtgtgtttttgcacaggtgggaaagagcaaggttcgtttatacaccatttctccctccaccttacctttaaacttttttttttttttttttttgaggcggagtctcgctcagtttcccagagtgcagtggcacgatcttggctcactgcaacctctgcctgctgggttcaagcaattctcctgcgtcagcctcccaagtagctgggactacaggcatgcaccaccacgccgggctaattttttgtatttttagtagagacggggtttcaccatgctggccaggctggtctcaaactcctgaccttgtgatccacctgcttcagcctcccaaacctttaaactttaaacctgccttgcaactatctcgttgacatctgtcaccattgtcaggttcatttccattatatgttgcattctgccttaaaaccatgatagctactatttgtttatttactttatttatttggatgctctgcctccttccagagatgattgaaggtaactcatagtcatcactctatgtctgcattcagacacagaggagcagataggttagataatagacattttctgttctataatattttgtttggtcaccaaacagtgctgcccatgttatcaaactgatcaccgactccctgactttaggttcaaatgtttgaacgtttttctctatttggaatccttctcacctctttaaaaaggaaactgagctccttgtgggcaaggatcctggcttcctggacactgccaaatgtgacttcgttttgaagcctaaaagatgagtcttcccccgttgtttctgctgagacaaggctttgcagaagaaattctttggcagctcagccctttctgtaaccagttaataagttacattttctagaaatgttctaactttttgagggagttactgcatgtcttagctttcttctagatcatgtttccaaaagttgcctgctcatgtgaatcgagtagagaaccagttcctaaccttctccaggagataattctgggaatctgtattttaacaagccccttgacattcatatgatcagacaagtttggtatatactgttttggatgagtagtgactcttccccttctgttttgctgacgtaaggattaaaaaaccaaactgagcaatctggagtctcttgtgatttgtatcaagctcattttctcatattcagaatagtagcagccattctcctaaattaaacactacctgaggacatggattatgtcctatttatttttgtgtccttagcatcttgtaccatctctggcacatggtaaattctcgtgactgaaccctagtacagcattgtgaaggacttaactttgcagaagagagattttattttgttatctaaataatttttccttgtgtgtctttcatcagaatggttcacgctgtactatagttattactactctgtttcttctaaaattccagcaagggttgatattaaaaaattaaaaaaggctgatagctaggcgtggtggctcacgcctgtaatcccagcactttggtatgccaaggtgggcagatcacttgaggttggaagttcaagaccagcctgaccaacatggagaaaccccgtctctactaaaaatcaaaaattagccaagcgtggtggcacatgcctgtaatccctgctactcgggaggctgaggcaggagaattgcttgaacccgggaagtggaggttgcggtgaaccgagatcacaccactgcactccagcctggacgacagagcgagaatctgtctcaaaaaaaaaaaaaaaaggctgataaatagttgttggatcccttgtaaagaatcatttatctacaatggacagactatctaggcttgtcctgtgtttttttttttttttttttcttcaaacagagtcttgctctgttgcccaggctggagtgcagtgacacaatctcagctcactgcaacctctgtctcctgggttcaagtgattctcctgcctcagcctcccgagtagctgggattacaggcacctgccaccacgcccagctaatttttgtatttttagtggagacggggtttcactgtattggccaggctggtctcgaactcctgacctcgtgatccgcccacctcggcctcccaaagtgctgggattacaagtgtgagccaccgcacctggctgtcctgtgttttctccatgctggaaaaatcagtttgaccctcaggaaacaagtctcaagaacgtatagatctcttaaccatttaggatccctgggtgcctcaattgtgaagttgtgtttttggaaaacgccttttgggagtatggaaaaacaggaaatcacaaaacctacagaaatgaacttgctagtttagctactattctaatgctggtctatggtgtttgaggttactcatttatgattaagcaacctaaaataaatggaatctggctaaagctttttttaaaaaaaactcttaagtttattttttcattttatttatttatttatttatttatttatttatttttaagtagagacggggtttcaccatgttggccaggctggtctcaaactcgtggtctcaagtgatccaccaacctcggcctcccaaggtgctgggattacagatgtgagccaccgcgcctgccctggctaaaatttctttgcaaagaattatttaaaatgttcagttatccgggcacgatggtgcatgcctgtagtcccagctattctggaggctaaggtggaaggatcacttgagcccaggagtttgagtctagtctgggcaacatactgataccttttcatttaaaaaaaattttaatagtaataagaatgttcagtcaatatcaatagaattaggaagaatttctatttccttccttcattaattcaacaaatatttattgagcaaacatctgtgtgtcgtctggcgctgttgcacaggtcaaactggcttcttaagaatgaaatcctaagtgtgaggaagaaattgcattgtatgtgtggtctgactgcagaaaacctaaaataagtaaactgctgccatgatgaaaagtcaaggagtaagttggcttttccatgttagtaagacaagtgaaaaggcatgtttcagtcacgatgtaatatttcctaaaattttgaagctatggggagaaaggtttgggaggaatttcatagggaaaagaaaatgtggggagggggaatgtaagcaaacaatacttagtacattttacaaaattaaagtcactttgtaggtatataaaaagttttaaaagttggtttattaatgagagtagtgtattacatttcttttcaagcagtagtttaaatattaaccagtttacttttttttaaagtcaatttacttttccagcctggacaacatggtgaaacctcgtatctacaaaaaatagaaaaattagctgggcgttggtggctcacgcctgtagtcccagctacacaggaggctgaggctggtgaatggcttgagcccaggaagcataggttgcagtgagccgagattgtgccactgcactccagcttggggacagagtgagaccctgtctcaaaaaaaaaaagtccatttacttttaaatgcttttttcttttttttttggcaaattgagacaaaagctgctgaactttcctaaatctacactgttagtattatcagtttgtgaaaagcaagcagaaggagaataaacatgagtatgatattaaaacaaatttgttataatgtctgtatttagggtcttctggaggaataaacagaattaaaaaaaagaaaaacaaaaacaaaaaaaatttatttttagtaaatgaaccaggggtagaggtggaggacaaactaaattcattgaactaaatcacatggaacttttcctaaccagtttcattttctaagctctgagagttaccactttctacttctgatggttcattatttttgtaagcttctgaaaatcaaaagcttgcccagattgagataagtttctgccccgctcacgtttttattttcatgatttgtcattatttccaaatctcaaccattttatttcatgtggtgatgaagagttctaaaagcaggtaagaagaacagtaaagaaaaatacatttccttttctaagagtgtagatctaaagtctcttatctgtaattcagaaattgaaattgtagaatgaccaaaatttaagactatcaagttttcataactcatttgccagtaaaacctgacctgaactggagagaggctactttataatctttttaaaatatcacttagcgtgattggtcatattaatatgtttaactatgaattgctgccctttaccttgctaggtgtcactatgtggtatatgccccatatacttaagaccagataattcaaagttccaaattatacatggtccccaggatttcagatgagagaccacagatccacattgggcttgtttttacccgtctgtggcctaacgttatgaaagcaagggggaaattccttctctaatctctgcaagtatacatgggatgctactaccagtgtccattctgtttgtcttttaaagcctagacaggacagggacataagtatcagcctctagactaagcttgtccaacctgcagcccaacacaaatttgtaaactttcttaaaacattatgagatttttttgcgattttttttttttttttttttttttttttagctcatcagctatggttagtgttagtgtattttatatgtggcccaggacaattcttcttcttcccatgtggctcggggaagccaaaagataggatatacctgctctagacagatggttctcaatgtgtggtccccaccctaacagcagcagcagcaacagcagcatcccctgggaacttgttagaaatgcacattcttgagccccatcccagatctattgaatcagaacctctgggcctggggcctggccagctttgttttataaaaccttcagggcattgggatacactctcaagtttgaaaaccactgctctagatcggggtctgccaactacagccacaggccaaagccagtcagtcacctgcttttgtatgccccaggagccatgagtgggttttgcattttttttcttttttctttttctctttttttttctttgaaatggagtttcgctctcgttgcccagtctggagtgcgatggcacaatctcggctcactgcaacctccgcctcctgggttcaagctattctcctgcctcagcctcccgagtagctgggattataggcataagccaccacgcccggctaattttttgtatttttagtagaaacagggtttctccatgttggtcaggctggtctctaactcccaacctcaggtgattcaccctcctcggccttccaaagtgctgggattacaggcgtgagccactgcacctggtcttttttcttttctttttttttttttttgagacggagtctcactctgttgccaggctggagtgcagtggtgcgatctcggctcactgcaacctccgcctcccgggttcaagcgattctcctgcctcagcctcccgagtagctgggactacaagcatgccccaccacacctgcccagctaatttttaacggggtttcaccatgttggccaggatggtctcgatctcttgacctcgtgatctgcccacctaggcctcccaaagtgctgggattacaggcgtgagccaccacgcctgacctacattttttaaacggctgaaaaaaaaaagaatttcgtgacacatgaaaattatataaaatttaaacttcagtgtccataaagttttattggaacatggccacatccattcatttatgtattgtctttggctgcttttatgcagcatcagtggaattgagtagttgcagcagacaccaaatggcccagaaagctgaaaatatttaccatctggttctttgcagaaaaaatttgctgctctaggttgatagtcaacaaacacgaggagtaatcacagaataatcagagactgagaccttcctttatctgaaaatgtcagcgtctccctagaaaaagaaatctacagaactcttatatttctatgtacaggtgctgttatgatcatcacatcattacatagctctgcatagttttacgtcaaaataacctttgtattattttggaggagtaagagtcaaggagttgctggacacttcacattttgtcattataaaaaatatttcatagtccaaaattttttagttctttgggggagagaaactcattaaaatttttttttctgattttcttctgagctttaacatttctgtattccaggacacattacctttcatgcaagattgaactgtgtcctggttagagtgttgcgttttattttgtgcaagattggaaccatctagattactccttaaatggttgttataatgtcccaggtagcccatggttaactttgtatatctacctattcagtcatctctctgtgtttacttaatttatgggaaagacatgaaggaagaggtatttgatgaactgttcgtgtttttcatgatcttttctggaagctgaaaattttctcactggacagcattaaattttactcttaaaaacttcagcaacttaagagcgttcattcagctgtctgtagtatttatatatgcagttttgatgatatttttcttgatcatttaacggtgaatatctgtgggcaataagtcttgtacagtgcattgacatttaatcataaatatgtattaactattttatttttgtatgtgtgtgtcttaataaattatgtttcttaggcaacttgttccagcgatggcatgttcctctagaactccagatgacaagacaaatggctagctctggtgcatcagggggcaaaatcgataattctgtgttagtccttattgtgggcttatcaacagtaggagctggtgcctatgtaagtagaaaagcagcgtgtataaagaagctgccaaacagctcccattaatagactcgatagtattctgctttaaaacttttgcaactaattcccctttctccttttggaaaaattttcaaaaagccttctcttaagtgcctgctgcctaatatcttatgggagccaattctggaatgactgaaatttaatctcatgttgattgatttctgctcttttcacttgtctttttcttctttacttgaaagccactatgttttcctagattcgagtaacccacaaaattgtacctgttttcttggatgtcacacactaacctgtgaataaagtcaaaatccattgcagctccttagcacaatatttgattttgacctatttgtcagacattttatttcctcagcttgaggttcacattaaaaaaacaacagccttcaatcaaaaatattaagtgttcctaaaaggaaagctatccctgaatcttacccaaaactaaattacagaaacagggctagtatcactgattttagaatggagtttgtttgaggtgagaaatatggtgtttaattgctatgtagtattagcaccattatatctccttaaatgaactccgatcagcttagcaggtcacagaggaattattttgtgggtgtttttttcctaacttggcagggtttactgtgactaagccgatcagtctaaagttggatcctgtaaggttgagtgaaccaacttagataacacctagtaacacccttgattgaaggaagctgtttgttttacttaagccattacaagtttaggggtttttttctacattggtaagacaatgaatttatctttgttccttggttgctagcttaaagaaagggacatgaaaattatttgaagctacctatatcctcatcccctgatgtgactcccaaacggacaagaaaagtagatagttcttgcctattgtgagtcaaatcagagtaagaaataggcgagagctgtctgataatgtggtttgatgaaatacacattctgcaatcctggagcagcatttttttctttttccttttttagcacagggtaaccaaaactgcttctctgcctttgtattgaatgtttcttcattaatacttagtactctgtttccttttgtttctctcttggccttatctttacctacagttgtgcagtctcatcacctaggatccccttctagatcactagcatctacaggtgcttctgggaaagatggcagcaacctagtgtacttcttaattgtaggagcaacagtcactggggcaggagtttattatgtaagatgcttacactaaaacatattttggggtagggtgggtgagcccatggcactaatgaaaacttgatacattagaatatagtaaaatattcacagcatgtgctttctctaggtgtttattaaagggacattgtcagtcactagagagtcctcaaatctcattcttcaaactgttgaagtcctaccagatatagctaaagccacaagtctaatgatgatcacaaatcctcatcattaactctttctttgaaacttttgccaattttataatgattttgtatgataccaaattatattgtgctttagtgctgcatatctaacaagacagtctcagagtaaatgttaaataagcaaataaaggtaatgtgaacatcatccatttttgaatcattttaggtaaaatgtaatgtttgtgttttgtgggaaacgatcaaccagactttgactatgaaaaggcattttattgaatgcttctgaggagatccaaaaagccatagaaactgcaatattctccccatccacctttccacccacagcctctatttcaaagtaaattcatttggcagtgtccctttgtaatctctaatttggtcaaactagtggctgaagcggtacaagctaacacattcatgtagattgctttctgtaatgcctctcattcgtaattcagatactaccctctgagccttactttttgcatttcatatctctcaacttttcccatcagttccaccccattcattcaaaaatagatttaaagcctttgtgttcagtatgttggtaacaatttaaacctgataaattcctggtccgtgttgctgtaccagagttggatggcctccacagagttgaccatgcaaattttcttgatgccaagctacaagacagggctggtcactgttcctttctcctgccttagaaatatctaagaagcacaagttcctctcaagtcattcatttaaatgcctcattgtactctgtgtttatccaacactggtaataataaagctaccgtattataaagtggttccaggttaaatgataagcttttgtctacctacaactgttattgaactgttatgtacagttttgttttaggttctaaattattgaaaacttgatctgaggtggcttagtttttttgtccgaaattggtattagtctcaagagaactatgaacttaaaatcagtgttcagatttgatgagatatagctgtaagttgttgaacgtttgtattagtttcttgggctgccataacaaaacaccacggactgagtggcttaaacaacagaggtttattttctcatagttctgaaggctggaaaggccaagatcaaggtcacacagggttcagtttctggtgagggctctcttcttagctttcagacagcctaccctcttgctgtgtcctcacatggttttgcggggtgggggacggagagggagaaagagtgagcaagggaactccggtgtcttccccttcctgtatgagctccagctctatctgattagggccccacccttaagacttcattcaatcattatcacctccccaatgccccattgccaaataccatcacatagtgggttaaggcttcaatataggaataggaaacattcagtccataacagtgaatagcgtttcttcgtaacttttttctgtcatttgaagaaatgttcctaacttaagtataactattactttggcaattcctgtattgggagctctttacctccctcccactttaccctccaaaaaaagggagtaaactgccgacttttttttttttttttttttttgaaacggagtctctctgtgtcgcccaggctggagtgcagtggcgcgatctcggctaactgatacgtccgcctcccgggttcatgccattttcctgcctcagcctcccgaggagtagctgggactacaggcgcctgccaccatgcccggctaattttttttttttttttttttttgtatttttagtagagacggggtttcactgtgttagccagaatggtctccatctcctgacctcgggtgatccacccgcctcggcctcccaaagtgctgggattacaggcgtgagccaccgtgcccagcctaaactgtcgacttttaaaaatttttaccatgatctgcagtgagaaatacatttcttttacaacccattttatgactacaaatacataaaaagaaacaaagcttcaaaaactactcttactaggtatcatacacttactctagcttctgttctcttctatttgtgtttgcgtctaatgctggttgcagcctactaaattgacttcacagcccactaatggcatgcaaccacagtttgaaaaacactgatttcaacagtgcttctgctgctcggattgtaaatatgaacttctgattcgcattgatgggagagtttttcctctttttgctggtaactttccctaggacctgaggcagattcccaaatctcagtcctctattttttgttggtgggcagagccaaagtggcctttagaatagttaatgagatttagtatttgggccctttgctattgttaagctataggattgcattgcctcactcagaaaatgacctgtttcctttcaaatcccattaagttgaataaatgccaccatattcatctgtttagaaaagttgtcttcactaatatttttcataaatttgtagtctttcttaacctgacatgtattcatgtcattaattggaaatctgtgcaaactaggagtacagaaacccttgggggaaaggtaaagaaataaatacatttatatatatatatcagacagatcgacctcattcttgccctttccccactaaacctctagatatttcttggtctgctcttcccttcatgtgtgagccattagcaagtgtgagctgggcttaggctattttgggatattcctctcaatgaacatggcccctgtttatttctcttttcattcatgttgaccagagtaagccatctttttaggtaaaacttttcttttttttcttttcttttttcttttcttttctcttctcttctcttctcttcccttttttggaaaagctttcccctctaggttttttttgttgtgtttttgtttttgagacagagtctcgctctgtcgcccaggctggagtgcagtggtgcaatctcggctcactgcagccgccacctcaggggttcaggtggttctcgtgtctcagcctccctagtagctgggattacaggcgtgccccaccacacccaggtactttttgtatttttaatagagacgggtttgctcttttggccaggctagtctcgaactcctggcctcaagtgatctccacaacttggcctcccaaagtgctggaattataggcatcagccactgcgcctggctaaagtccctttcttaaaagaaatgtttttaagatatgagtaaatactggacttgtgtatagtatctgataccaagataaaaactcttcctgaaattaatgttaattgaattcatttattcgatacatttagtagtaaattcaaggagtaactattgtcttttcccatacagtacttaactttctacttcatttgtcacaacgttaaatgcttccaggttgaacccagctctcagggttcaggttcctcaattgcagcacattgcctgatgggctgttctggaaggaagtcatagaagtattcttagaatatgttttatggggccgggtgtggtggctcacgcatgtaatcccagcactttgggaggccaaggtgggtggatcacaaggtcaggagttcaagaccagcctggccaacatagtgaaaccccacctctactaaaaatacaaaaattagctgggcatggtggcgtgtgcctgtagtcccagctactcaggaggctgaggcagcagaatcgcttgaacccaggaggcagaggttgtagtaagccgagatcacgccactgcactccagcctgggcaacagagtgagactacatctcaaaaaaaaaaagaaaagaatatgttttatgatagttcctctgattgtctttactttctcctacaattaatctgagatttcatttgacatatgttcacctaaattcctgttttgttgaccctgtggggtacaaaagagcaaaagcattgtaggtttttcttttcttttttttttttttttttgagacagagtctcactctatcgcccaggctggagtgcagtgatgtgatctcagctcactgctgcaacctccacctcctgggttcaagcaattcccatgcctcaacctcccaagtagctgggactacaggcgtgcatcacctcacccagctaatttttgtatttttagtagagatggggtttcaccatgttggccaggctggtctcaaactcctcacctcaggtggtctgcccacctcagcctcccaaagtgctgggattacaggtgtgagtcaccatgcccggccaaaagcattgtaatgttaagtcattcttgcctaccttttctttaaaaagtctccaataggccgggcgcggtggctcacgcctgtaatcccagcactttgggaggccgaggcgggcagatcacgaggtcaggagatcgagaccatcccggctaaaacggtgaaaccccgtctctactaaaaatacaaaaaattagccgggcatagtggcgggcgcctgtagtcccagctacttgggaggctgaggcaggagaatggcgtgaacccgggaggcagagcttgcagtgagccgagatcccgccactgcactccagcctgggcaacagagcgagactccgtctcaaaaaaaaaaaaaaaaaaaaaaaaaaagtctccaataaactctggtactgtatgttaaaaaagaacaacacacaactggtcataatggtaaaattacccttttccaatttgaaaggatagagaagatagaatatttgaaatgtaacaggtgtgtttaagcaaggtgtttgaccccctagtaaatatctgtgtgtagtttttctgaatgagattccttctacctcgtgagtttaagaaaaggatagaccattgagggaatgatgggtaactctctaaaaatagaatacaggcagccatgtttctgaccactgtgtgagtacttagcaaaagccggaatgttgaccaggaaaacttatgtcccagcttcctacccgggaccctatagattgatttcacagctagtgtccagcgtagtccaaaccccgtttctgtgcttcatatatagattagccctttctagcactttattcttctagtataaaatgattttttcttttttcttaaactgtaccttcagaataaaatatggggagaattctttatagagagcctaaaaatctgaaactggaatattttcatctgcttacacatattttttccataccaagcatgtgcacacccagtattttttatttcttaagaaaacaactttgtcttagtggttttgacatagaggaactaacatcagatagacaaaagcttctcatttaattgaaagataatattacttacagtatgagctagctgtatggtgaaataaactttctccatgtttggatccgcaggcctacaagactatgaaagaggatgaaaaaagatacaatgaaagaatttcagggttagggctgacaccagaacagaaacagaaaaaggccgcgttatctggtgagtattcccttaagtcttgctatgatttgagactcacaaagggaaagttataaacagtttgggtgctgtgatttatggatgtcttgtagaagcaatggtggtatgagattgcaagcatctagaaagtatggtattaccctagaactgggagtgatttaaagcatttggctgaaatttgggtttgagaataaagctagtgataattatgattggttgtttatctgtatattaatattagtctcttggctgggcacggtggctcacgcctgtcatcccagcactttgtgaggccgagatgtgcgggtcagctgaggtcaggagctcaagaccagcctggccaacatggtaaaaccccatctatactaaaaatacaaaaattagccaggcgtggtggtgcacgcctgtaatccctggtgctcgggaggctgaggcatgagaatctcttgaactgaagtggcggaggttgcagtgagccaagatcacgctgctgcactccagcttgggtgacagagcaagactctgtctaaaaaaaaaaaaaaaaaagtctcttaaaaggcaagcttagcaaggaaaactattggaaaagatggaaaagagatgaaaaccttttttttttttttttttttttttttgagatggagtttcactctttttgcccaggctggagtgcagtggcccgatctcatctcactgcaacctccgcctcctgggttcaagcaattctcccgcctcagcctctggagtagctaggattacaggtgtgtgccaccatgcctggctaattttgtatgtttagtagagacagggtttcaccatgttggccaggctggtctcaaacccctgacctcaggtgatccgcctgcttcggcctcccaaagtgctgggattacaggtgggagccaccacgcccagccgaaagctgttttttaaatgaggaaattcttctagtctgttttgttccccttttgagtctttgcagtttcgagttgctaaaggtatatttgctttcctaaagcacataccctagccatcacttccatttcacatgattcacttcaattttcagagaggactgttttaatcctttaataagccccacaactctgggtgggcaatttgttctgcttttttcaaaagcacccccttattcttgaacattgtatgataatccccaattgacctcctggattttctccctttgttgctaacggaaggtgaaactgagcctgatattttcctggtgatcactaggaaattgatgggaagggcaaaagcctactgatgtatactttctaaatgttttagaagtaactaaatatttaagctatgtcctagtaccagttcagacctgatgaatgaatgacattggtgaaatcattctcctatttttcacttatgaaatgaaagggatacttgcttttcctctcccatcaggatgctgtgaagattgttaagattagcgtaggtcatatgttttgctagctttatgtggaggattgagacaagtgcaaggtgatttttttttaacagtggcaaagaatcatctgagacttcaagaagattcatccagtctgttctgttgctttcagcttcagaaggagaggaagttcctcaagacaaggcgccaagtcatgttcctttcctgctaattggtggaggcacagctgcttttgctgcagccagatccatccgggctcgggatcctggggccagggtaaggtgcatgtttttttgcttggcacagagggtacagtctgcaagcatttagctaatgtgaatgctttgacatttgccccttaaatgacttggctctgataagcgtcatgatttttatgtctgaaggtactgattgtatctgaagatcctgagctgccgtacatgcgacctcctctttcaaaagaactgtggttttcagatgacccaaatgtcacaaagacactgcgattcaaacagtggaatggaaaagagagaaggtgtgtttgcttatgtaaaatgagcctatcaacttcagctaagcacagagaataggttaggattttgccactgactgtgtacagtaataggagggatggcttggctgtccactagagtctactgtggtccacacttggtacagcttagagataacagtctacaaagggcaagagtcctggattctgttaccagatctaccaacagttgatggtgtaatgttggcctctgaaatactaatgctcctatttctggaacctttatgttaagcttctttaggtgaagatcaacttggcctgtattgtcacttctttttttatttttattttttgagatggagtcttgctgctctgtcaccaggctggagtgcagtggcgcaatctcagctcactgcaacctccacctcccgggttcaagcaattcccctgcctcagcttctcaagtagctgggattacaagcacgtaccaccacacccggctaattttttgtattttatagtagagatggggttttatcacattggccaagatggtctcgatctcctgacctcatgatccgccttcctcggcctcccaaattgctgggattacaggcgtgagccactgcccccagccatcacttctttatacttgcctagacatgtcctacaagagcagaagaaaagaaactttttaacggcactctctttgacagcctagcaggcatttagaatttcaggagtagagtaggaaggctgtaaggaagagcctgtgttagaatttttgcacgacagacttggagatacaggtccagaagctttttccttttgatggacaacttagatctcaattctagtaccatgttctttgggttccaattttttttctcattagtgacccctttgatacctgaccaaattttacaaacttacccttttccctcacccccactagttccattttcaaacaggatgtatactttcaattaagttagtggctaactttatatgtatacatatgcatacacacacacacacacacacacacacacacacacacacacatattttgagagacagggtctggctctgtcacccatgctggagtgcagtggccgaatcatagctcactgcagcctcaaactcctgggctcaagtgatcctcccacctcagcctcccgagtagctaggactacaggtgcgtaccaccacgtgccttttattaattaaaaaaatttttttctagagacgagatgttgctatgttgcccaatctggtctcaaactcctggcctcaagtgatcctcccaacttgggctcccaaagcactggggttatagacctgagccactgcactcagccaatattaatatattaactaattaatattaatatatcatagttgataactgcttgaggcagagtcttctcaggagctataattagttgttccattgaagagcaccattctggacaacccatttgggtggatatgtgaataccagctctttgggtgctccacttgttcttactttgaaatgaacctaaatctagagcaggatcctcagcctcagcactattgacatttggagcaggataacgctttgctgggggtggggagctgtccagtgcatcataggatgtttagcagcatccctggccattacccactggatatgagtagcatccctacccaagttattacaacccagattgtctctggacactggcaaacatcccctgggagcaaaattgccccaagttgagaaccactgatctggatacctgtatgtaagcaagtcatgaccatgatttaatagacttggagacttactttggaaaacgtcccttaaagtttctgataatggaaacagttttattaaagctacgggggaagctgataacagttccacatgcttataatattctccctctcttctccatacagcatatatttccagccaccttctttctatgtctctgctcaggacctgcctcatattgagaatggtggtgtggctgtcctcactgggaagaaggtgagctagtagaccgcttcttttgtcaggctctacgtacttgcccaccagccagtatggtgatgtgtgtttccattaccatttatgtctgtcctgccattgtagttcatcaaagaaggatcgagctgctttaggtttaataatgctgagtgtgtctttctggggaaagcactagtatcaaagcctaggttagcatgctgactcaacttgaccctaaaagctgttatctctcctatttgctcttctgcccttcctcatccttcctgttttcccacactaacttctctctgggattatcgatgagaaaagattgacaaatatgtattactcatagtaaaataatttgggcataactcagcacggaatatattgttagactttaaaaggtgagtgtctgagtaataaggtcagttattagcaggtatttgtggagtcccaggatggttttgttatattttattgttgttaatggcaggtactagagtgtgtgtgtaaactaatggcagtgttccaatagggacgcattctctgaaggagcaaagcccagagtagatgagatacacagcataagtggaaggattgtccttcgttaggaacatactcacttctcctgtaaggggacattagacagagaagatggatataggtttgttgataagccggtaatgagacatttagtgtcccctatgtgtaaacaacattcaggccctgccctctaggggctaactgtattaggcagaaacataaatacataatcataacacataggtgtgtagtaagagagatctgcgcagtatgttgtgggaaatactgggaagggtgcccagtagagtgatgacatcaggaaaggctttctggaggagaaggtcttacagaatgggcaatcttatggaatgaagaggcattcaccagactagagaagactgaagagcatccaagtaaaaaagaacagcataagcaaaagcacaagggcacaaaaaagcatgtttggtgccaggaaatagaagcagctcgatactgatagagcagttaggtacaagttaggaagtggcaagagatgaacctgagaagttatgcaaggggcctgattgtggagggctttgcgtgaaagagctttttctgcactggggagctgttgcattttaggcaattgaattttaaataatcaccattggccgtgaggaggatggatttcagtgagacaagactagagagagaccatttcagagattattgcaataatctaggcaagagatgatgagagcccaaattagaatagtagtggtatgatgatgatgaagaagaagaagaaagtaagaggtaaaatttgtatagtacctattctaatcttgtaagcacagttcttaaatgctttatgtgcaccatctcattttatcctcccaataatcttatgaggtaggtattatttccctcttacagagaaataagttgaaatttttaaaaataaataaattttaaataatttgcctaaactcacatagctagtaagtggtagagagagaatttgagcccgggtctgtctgagccacagaattggaacccagctattctgattccagagcctaagctattaataacatcagtgtacagtgtacagtactttttttttttgagacagattctcactctgtcgcccaggctggagtacggtggcatgatctcagctcgctgcaacctctgcctcccaggttcaagcgattctcctgcctcagcctcccaagtagctgcatgcgccaccatgcctggctattttttttttttgtctttttagtagagatggggttttaccatgtaggccaggttggtctcgaactcctgacctcaggtgatccacccacctcggcttcccaaagtgctgagattacaggcatgagccatcgtgtccagccagtattacttcttgatagaaaggtgatgagaagtagggaacacacttgaggcatgcttaggagtcatgcttgatgaggcttggtggttggttaaaggtagaagatgaaggagatggaggaggcaaagatgattttctaatttctagcctgcatgtctgagtggatggcagtgtacccacagctgagaaagacattacaagaggaagagctagtttaagggggaagataaaattcagttttggaccattaagtatgaagtggaatatctgcgtgaaggtgtcttctgggcagttggacatatgactgccacgcccaggggacttgggctcagatagagagctgagaatcatctgcatatgtgtagaagttgaaaccatgagagtaggtgaagcctcccagggagaactgatctggtgagaagaggaggaaggcaaggatagagccctggggaaccccaatttttaggaagcaggcttaagaagaacccacaaaggagactaggaaagaacttaaagagcagtatgaggaaacctgaggacaggagccaaggttgtagggagtttcaagaaaaagaatgtgatccacagtgttaccgtggcagaggaatctgggaagaaaagaaccgtaaaatgcactgtgagatttggcggttcagatacctttgggaggctgaggcaggtggatcacttgaggtctggagttagagaccagcctggccaacatggtgaaaacacatctctactaaaaatacaaaaattagccaggtgtggtggcgcacacctgtaatcccagctactcaggaggctgaagcacgagaatcgcttgaacccaggaggcggaggttgcagtgagccaagattgcatcagtgcactccagcctgggtgacagaacaagactccatttcaaaaaattaataaaataaaacagataccattgggaagttagaaaagagggtaaagcactctttcaaaagatttaaatgagaaaagagagatggcaatcggataaaagcgtgaagaggacatagaatcaaaggtgggacctattggatgggacaagcatgttaataggctggacgggggtggtggggagccctcatgcctcatgggaagctatggaagatcacatctaatggcttcatttgtttttgcaatacaatagaacataagatggttatctgagagcgaacaccgtgagggttgagtagcgggattggattgaagagggagcttaccaaggacaaatcaaaggaggctaaagaagctgcttatccatcagatctcagttcatgtcattgcctctagaaagctttacccaacccaacctgactagattgcacatgtcatatgttcccagcgctacctgcactgttcttaccacttacatcacatttgtcactcttgattattgttagtgcttgttaaattgtcttggccactaaactctgaaagcagcaaggatcactgtctcaacttgatacatagtaggtgcttaattgaatggtctcagctagtaaagagtggtgcaaagactggggccctattctctctgactccaaagctcaagctcttaaccataagaaggagtagggtgcaagggaattaaaggtactggcaaaagaacagtttgggtgttctaccattggcccaaattagttagaatggagcagctagtcaaataaacagagaaaattgaaagcaagcataggagacagactgagcgaaagctgaagggatggaaaattgtgaccaacaagtagaataattgaggtaggaggagaggtttaggagataacaagatgaggaaaagtatgagccaggttccaaggtcttcagtgaatcaggaggagtagccaggaggtggctcaaaacagtgattcgtaggaatataggactcctctgatgtccctcagaagagaatgaaagtacaagaatctggaagcagcagaccagtaacctcaagaagcttgcagaatgccaacacctcctcctggccttgtgatgtggagtgtgggggaacgaacagcctctatgtgtaagctctccttaagagagagccaagtttccgtgaaggctacaagttggagaaagcattctgtaaaaatgttgtagatgtaggagacttattaataaagtaataataagtaattccaaacagccatataagaaaggctgttccgattctccttttccacacatgggtcagggctttgggactgtcatgacttgctctaatgttgcctgccttctcattgccaatttccaacatatgactgcctaaaaaaactgggtaccagaaactgtggttcccatgattacttggatatggtttcttaaggatcgctttaggtcaagaactcattcttcttattgggctgacaactttttttgtttttgtttttgtttgtttttgttgttgtggttttggggtttttttgttttgttttgtttttgagacagaatcttgctctgttgcccaggctggagtgcagtggcatgatctcggctcactgcaacctctgcctcccaggttcaagcgattctcctgcctcagcctccccagtagctgggaccacaggcatatgccgccacacctggccaatttttgtatttttagtagagacggggtttcgccatgttggccaggctggtctcaaactcgtggcctcagtgatctgcctgcctcagcctcccaaagtgttgggattacaggcatgagtcactgtgcctgtcctgggctgacaacttcttattgacctggagttttggggtggtgatggaaatgttctgaaatcagatagtggtgatggtggcacaaccttgtgaatatactgaaatccacagaattccacactttaaaatggtgaatttgatgtgaattatatctcaataaaactttttcaatgctaattcatctctacctcttttgtgtatgtgtgtgactgtaccaggtagtacagctggatgtgagagacaacatggtgaaacttaatgatggctctcaaataacctatgaaaagtgcttgattgcaacaggtgagcatttctggagatggctttcttccctgatacagctcattcaagttttagagtccagccttctctatggaaggcattactacttaagaaaatggaaacccagactctctgaagtgagtgtcttctcttggtacaaaagctggctgtgtcaaagcatcctggatcaccagcccttctggatgatccttgctgttctcccggtagaggcatgaagaagttgcccttttttctctccctgcttaaccctcaccctgtgccctgtgccttgaaagtgatgtcgtttgtggcttcattgccagttgcaatcagaaaccaagagaggagacagaagcaatttatcaaacccatgtagctatgctagctggcaaatcctcatgagaaactagaagagaacatggaagccaaaagtaaggccttttggccacctaggggcagggtgtaccccttgaagacagactctcaaatctgcttctcaaaggaaactgacagaaagcctgctgtgaggcaagctgaaggcaaacaaagccttggtatcctatcctgttgttgccgccatggtgctaagtgaagagggctccacctttgtgtggtggagggagtattgtttgggctggctcctgcttgttgggctaaagggttttccttctcttatttccaggaggtactccaagaagtctgtctgccattgatagggctggagcagaggtgaagagtagaacaacgcttttcagaaaggtaattgtctgctttagtgttttccttgtgttgtttttgaagaagtagtataatcttgcagtccccaagtgcccacccgggacttgggagatccaagttctatttatggctcttctccagacttgttatctggccttgaacaagtcacttcctctctctgcacctcagatacctcactcaagggttttaagctcctagggaaaaaatggagtgtttgtattgcttgcaatagatccttctgattgctcttccatagttgttttttcctgatgtgtttgattcattggaaccccttacagcctcttggcatttttcattgcaagtgctgtgtagagacttctgagaaaaaagttaagagtacctaaataaaaagcaaggaggtgttctgcttcttaacactgtgcttataaaaactgctgtcatttttcagggataagatttgtcctgtctttttttttttttcgagactgaatctcgctctatcacccaggctggagtgcggtggtgcgatcttggctcactgcaacctccgcctcccgggttcaagcgattcttgtgcctcagccttccaagtagctagaattacaggcatgtgccaccacgaccggctaattttttttttttttgtatttttagtagggacgttttaccctgttggccaggctgtgtactgtcttttaagttcttcctagaacaaggcttgtcagcctctgcagtattggcattttgagctggataattgtagtgggggctgtcttatgccattgtagtatgttagcagcatcctggcctctgcacactaaatgctgggagcacctacttgccctgacaaccaaaaatgtcttcagatattgccagatgtcctcctggggaagatagggacaaaactgccaccaattgagaaccactgtttatagaaggaattttaccatgaagaaataaatttgcattaataacatagaagttataattgagtcactttatacaaggagaaaatttacttttgccaaagatttagaagaaactactttctagtattattatcctatgccccttttggaaattaatggactaaactgatgtgatcctgcagattggagactttagaagcttggagaagatttcacgggaagtcaaatcaattacgattatcggtgggggcttccttggtagcgaactggcctgtgctcttggcagaaagggtgagtattgaggagtgaccttgattttctttctctagtcttatatagcttttctgtgaatcccagagatgtgtttggcaggatcagtaggaagagtttaattaaggtttatttatttatttttttttgagatggagtctcgctctgtcacccaggctggagtgcagtggcgcgatctcggctcactgcaagctccgcttcccgggttcaggccattctcctgcctcagcctcccgagtagctgggactacaggcgcctgtaaccacgcctggctaattttttgtatttttagtagagatggggtttcaccgtgttagccaggactgtctcgatctcctgacctggtgatccgcccaccttggcctcccaaagtgctgggattacaggcgtgagccaccacacccagcctaattaaggtttatatagtgaaaagctaaacactgagattagttctggtgagggatcccttggtgaccaaaaagctgtcacctgagcaacttaacagcgatgcttttttttttttttttttgagatggagtttcactcttgttgcccaggctggagtgcaatggtgtgatctctgctcaccacaacctccgcctcccaggttcaagcgattctcctgtctcagcctctggagtagctgggattacaggcatgcaccaccacacctggctaattttgtatttttggtagagacagggtttctccatgttggtcaggctggtcttgaactcccaacctcaggtgatccacccacctcggccacccaaagtgctgggattataggtgtgagtcactgcacctggccaacagcaatactttctttcctttcttttcctctaccctctatgccaggactccttagaaataaaatattaaggaaagtgagttatgaagatgataagggcaatgcagactacagaattatgggtgtctttgaactgctgcttcctgtaaaatgccaaaaacttctttgggcacatgatggttcccagcttgagagatctgtgagctccagttggaatgtttcatggcaactagttttcttaatgttctttttcagatatatgaaatcagggcatcttttcaggaggatgcttcctattcagaggttgcaaagcacttatgtaagccttaggtgactgcatgggtggaagtgcacagagttcaccatctgaagcttaatctggggccagcagttctgatacctgttgtatttgcgttacaaatgaacttgagcaccgaggccctcatgcccactgtcctgtaagtgggcgctcggcctggattgcagctctgccctgtctgtagtgagggctgcctgctgctcctttacttctcttcctgtattcctaggattgacttttgcttcctgctgtaactactctgtttcttcttcccagctcgagccttgggcacagaagtgattcaactcttccccgagaaaggaaatatgggaaagatcctccccgaatacctcagcaactggaccatggaaaaagtcagacgaggtagagagactgtttctatatgctgccactctatttcctttgagtgtgacctaaggcaaacttcgcttctataggaacccccttgacataagccctatcacctggcctgtaaaatgtttccaccattctccagtcagctaagttcatctaggtgttctgaatcagatgccccaaattcctggaagtgctgaaaatgaaccatgggtgtaggttcttgcagctctccaaaactgcctgtgtactgataattggttttaccgtggaggagaccgctggtcagctttcctacttcccatgaaagtgatagccttgtaggctcactctcaggtcttgtttgcctttacagagggggttaaggtgatgcccaatgctattgtgcaatccgttggagtcagcagtggcaagttacttatcaagctgaaagacggcaggaaggtaaggaaggaaaagatagtctgccaagaggccttccagttctccactccccttgcctcatttttactccttcatttgacaccagtagattagttttcctggcagttgccattaacctgatataattttccgaattaaccatccctccattaaaacagaatgatgagagccagagtaggctcctgtgaaccactttcccttagccccattctatctgtctcacagagttttgagtcctggctagggtggcagatttctgttcgaatgacatgggggatgtgcatgggatggggtggtggaggcttatgaaatagaacttaaaatccatttatcagaggtaagttaacccatgattttttaaagtcccaattcttaatggcatgaagggccattgttacgcctgtaggcataaatggaaactgtggtaattgactgaattatttcttttttgcctcaggtagaaactgaccacatagtggcagctgtgggcctggagcccaatgttgagttggccaagactggtggcctggaaatagactcagattttggtggcttccgggtaaatgcagagctacaagcacgctctaacatctgggtggtaagtgtgctacagcatgaccaggcataattcattctccctagcctgtgaacaagtctgcccggtggtgtgctaaagctcatcaacagcctaaccaaatagggtcagagtgtttggaggctgagggtacagaatagaaatgtgtgaactgcttgattcagaagaccaggtatggcctcatctgcaagctagtggcagatgaaatgaacagtgtgcatgcctgcaggggtagagctcttccggttctacttattggcagcagctactggcataacccctggtgggcatgcacataagccttcagatggatctgctgttccctttgctcaaacttgaatccggaggatggaggatgaagcaatgttataacctgttccctagaaaggaaaattactctgttttcattttccttgagtactatttttagctgttttttacaatctattatgacataaacaagactatagtatgtaggaaccatgaggtaatttccccattgctagttacaagtgtattgtgtttgtttatggactctgcaactaaggacgtaggtaccttggaggaatttttttccccctccaaaccttgtttttttttttttttttaaaaaaaaaaagatgtactggatctttttaacctgttataaaagtaatacgtgggccaggagaagtggcttacacctgtaatcccagcactttgggaggctgaggcaggtggatcacttgagatcaggagtttgagaccagcctggctaacatggtgaaaccctgtctctcctaaaaatacaaaaattagccgggtgtggtggcacaggcctgtaatcccagctacttgggaggctgagtgaggcaggagaatcacttgaactaaggaggcagaggctgcagtgagtggagatcatgccactgccctccagcctgggcaacaacagagcaagactcagtctcaaaaaaaaaaaaaaagtaatatgtggtcaatgtagaagacagacaagaaggagagaggagaggaaagtcacctgcagcaaccattaatattttggtgtatttccttccctgtgtttccttgcatgtaggttttattgttggtttgttttattcgtggcaagcatactatatataatattctgctcttttccacttaacaccataaatgtaagcattttctatgttgcttcagactttgtaaacagtttaatgactatatattccattaagcgaatttcacagtttacggttgctcactcgttggatttttaggttgctttgggggagtctaaatagccacaaagatgaacaaagggttagagagctcaaatgccacatccttcatgaagctggtccagttcacccccggctggaggttctcgccctctgcttgaaatacttgactcctttaatctgtacctctcatatggcacactactgtttacattgctctgtagttgtgagcaaggctgtatctttctgtactaggttgtatgctcctcatagtcaaggtccatgtcagttttgtctcagcaacccggacaacataatacttttgtatataataagtactccataaatatttgtcgaatgaatgaatactgagtgacaaaaagaaatctaagaaaacatttctaggtgagaggcagtcacatccaaaaactggtttctacatatagaaaagaatattctgcaaatcatggttattaaatatcctgtctgttaaggaaagaacaggaagtagacataagtaaacaaaactatagaagatttaggttagctttatggaagcagaatagatttttttttctttttttttttgaggcggtgtctcgctctgtttcccagtctggagttcagtggcacgatctcagctcactgcaacctccgcctcctgggttcaagccattctcctgtctcagcctcccaagtagctgggattacaggcgcttgccaccacacacgcctaattttttgtatttttagtagagatggggtttcaccatattggccaggcttgtctcgaactccttgtgatccacccaccttggtctcccaaagtgctgggattacgggcatttgccactgcacctggcctggaatagatgttttaaaatgagatctcaggccaggcgtggtgactcatgcctgtaatcccagcactttggaaggctgaggcaggcacattgcttgagcccaggagttcaaaaccagcctgcgcaacatggcaacaccccatctctaccaaaaaaaaaaaaaaaatttagccaggcatggtggtgcattcctgtagtcccagctacttgggaggctgaggcgggaggatcatctgagcctggaggtccaggctgtggtgagccatgatcgcaccactgcactccagcccaggcaatagagtgagaccctgtctaaaagaaaaaaaaaaaatttaaatgggttatcagctgtttttgttagtttaagtacaactctggcctgtagatggaaaacatgaattagttaccattacaagtgttctttgagcccccaaagtttatattttgtctttaacttgctttttttttttttatcatgtgttcatgttatgtatttgtttccacaggcaggagatgctgcatgcttctacgatataaagttgggaaggaggcgggtagagcaccatgatcacgctgttgtgagtggaagattggctggagaaaatatgactggagctgctaagccgtactggcatcagtcaatgttctggtaatagtggtgtgccttggagacccaactgattacaactcagtatctctaggaccataacacagagttatggtttggttttattatgagccagttagcttcatacagaagggaaaaaagtccatcttatgtccacacattctaccctcaggtagccatctggcagaagtgtcctgtttagtttttcaccaaactgatccttttgtaaaacattaaaagagaaaaaaattattttaagtgttctgtctggcgtatgttagactaggtgaatgaatggagatggcaccagcacttccggcaaaataggtcagaggccgaggtgggcggatcacgaggccaggagtttgagaccagcctgaccaacatggtgaaaccccgtctctactaaaaatacaaaaattagctggacgtggtggtgcatgcctgtaatcccagctactcggtaggctgaggcaggagaattgcttggacccaggaggtggaggttgcagtgagccgagatcacaccactgcactccggcctgggtgacagagcgagactccgtctcaaaaaaaaaaaaaaaaaaaaaaggagtgtcagaaagcattccagtcctaaaagatgaaggctggtctggtatggttgctcatgcctctaatcccagcactttgggaggccaaggccgggggattgcttgagcccagaagttcgagaccaacctggacaacatagcaagagctcgtctgaattttttaaataaaaagtttttaaaagttaaaaaaaagaaaagtggaggctaaggggaaatactgtaggttaatgaagccataaaacatctcaaattctgaattccataaatgtggaacactctttaaagcttcaaaaagggaatttcaagacaaaagtagtgaatagcaaaagtgggaacctcatcactttccaaatgtggcatgggataaaagcacgaataaattcaagaacgtttcaatcaccgcatggatatgtggtcgtgtataatggctttttaaggaaaagtcaaagctattagggttaatcttactttctcatggtcatccctagatgctctagcaacagcagatcagttggcatctctcgtgatctgcatactaagttctttggttggcataagagtgcggtgttggtcgggtgcggtggctcacatctgtaatccctgcactttgggaggccaaggcgggcagattacttgaggtcaggagttcaagaccagcctggccaacatggtaaaaccccgtctctactaaaaatacaaaaattagccagggtggtagtgggtgcctgtaatcccagctactcaggaggctgaggctggagaatcacttgaacccaggagggagaggttgcaatgaactgagttcgcacccattgcactccagcctgggcaacgagtgaaactccgtctcaaaaaaaaaaaaatgcagtgtcatggagaatatgtgctaccgtgtcattccttacagtcccttgacagaacaccctcttctctcttcttaggagtgatttgggccccgatgttggctatgaagctattggtcttgtggacagtagtttgcccacagttggtgtttttgcaaaagcaactgcacaagacaaccccaaatctgccacagagcagtcaggtaagaaagtcctagcactcctcttggagagtgttgagaagcagtggtccagattctcctgaacaaggggtttctgtattggccagaggggcttgtcagtgaaagcctctcttcatgttgtgctttaaaagaaaccaaaccccaagtcctcactctttagtggtctgagatttggcaaaatcaggtatcctggtcaaagcatagattcaaatattgtgggtatctgtcctagacagtggacagtggctagctcaatgacactgctgttttgtgtgtctctgggaagacctttctaaggaagaaaacaagaaaacctgaactttttagattgcgtttttatttttctttctttcagttgtcatttttattattttgcttcaggcgaatctcaagaacacggcctgataggcttagcttaagactggctatcctccatgggtcctgcgcagggaggaactgggctgagtagttatttagctgcctcccattccatttggcagatcttagtgccaggttttctttagatgggaggcacctctcttggaatggacttctctcccacacatgtctctttcattaactccgagaccttattccttgaccttagctcaagttatttaacttctgcatccttttgccagaggtgtctcaagggcaaggtgctgtttaagaaggagaaagcaagacattatatggatatgtaggtccttttcctgtgtaattctaatgtattccatattccttaattctgatctctcctagtaacctagtaagtggattcatgtcactgctttgtcgactggacagtattatttggaggctggtggttctcagcaaggtgcccccttcctatgccacccttcccttcccctctttctctaggaagaaatgcctccactatggtttttccaaatggaagtgccttctgctttgtctaaagtacctgtctaatagcactgtccaatagaactttctgctgcgatggaaatgttccatctctgctctgtccagtacgttagccaccagccacatgtggcttttgagctcatgaaacatggtgagtacagataaggaactgaattttacatcttactcagtttgaaatgatgttcatttacatggctgtggctagtggctactgtatttggaccatgcagctctagaattatttcttagaggacaagaaccagccttctgcagtttgaagaaatccagataccaggaaatattcatagcatgaatttaaaatgagataataagggagggaagtttagggtcagactgaccctgtgcccaggagctggcaaggaagacctttccttggctttgtcactggagaggggctggtgaaggccagggtttactgagggggcatagagaaataaatcctctagaagtagcttgaagcaggcctcgaaagactgttggcttctagaatttcccaagctcataataactgaagttttgattttgcttccatgtttatttgttttgggggctggccacaggaactggtatccgatcagagagtgagacagagtccgaggcctcagaaattactattcctcccagcaccccggcagttccacaggctcccgtccagggggaggactacggcaaaggtgtcatcttctacctcagggacaaagtggtcgtggggattgtgctatggaacatctttaaccgaatgccaatagcaaggaaggtaggtgcctgtcataactcttagaggaagatgggaagtacggcttagaaacattcctgtaacttcatcgggtgccctgagatgcattgtcccccggccaggtcaaattgtgcctgagcagaacaaaggtatagccttggctcaggaacattctttttcacttgggacttggctgggtgacctgggagttggcaggctgcttgtttggggttagtagagaactgttcccacaactccctcccagtgtgatatggggactgccccaggtagccccattgtgtgggcatggcctgaacgcaatggagtaagttagggacctattgttactctctctccctcagatcattaaggacggtgagcagcatgaagatctcaatgaagtagccaaactattcaacattcatgaagactgaagccccacagtggaattggcaaacccactgcagcccctgagaggaggtcgaatgggtaaaggagcatttttttattcagcagactttctctgtgtatgagtgtgaatgatcaagtcctttgtgaatattttcaactatgtaggtaaattcttaatgttcacatagtgaaataaattctgattcttctaaattaaa

SEQ ID NO: 36770 - DNA, 10452 bp, Homo sapiens
gcggacgcggggcgccagcaggtggcgctggacgcgcaacggacaaggaggcggggcctgcagctggcttggaggctccgcgctctggaggctcaggcgccgcgtggggcccgcacctctgggcagcagcggcagccgagactcacggtcaagctaaggcgaagagtgggtgagtcccttgaatcgttctcactggccgtttgctcctcgagtccgcccgcgtgtccctgcaaggctgggcgcccgctcccagtcttgggaggggtgtagcgggtcgcaagccttctcgtgacctggacagcggccctcctgggcgagcgctgctcaattctccgcttatgcgcggctctggggcgcgctgccttccagcccagctgggttgtggccgggccgggggttggggagagccagggactcacaggaagccttttcgctaggggcttaaggttgtggtagattattaagtttgtgctcaggttggattttgatggcaagttttttaacgtggcaaagttgccagagtttgctgtgcattgacgaatgactggtgcacagtacttaaaatcgtgctacttctcgtcttcgggtttcctggtaacagaggttttcatttttagtccttagaacactggccctactctttcaggatctgggtggggttcaggttccctccaaaatagtcaatcaaggctttaaatatgtaattctggtcaaatccactggaaggtgtttgtagacataaattttttgtacacttccaaatttcttactttgttacttttgtaaaatacatttccctccacatcctgacgtgtaataaaaggttattcatttaacatgaatgttaagcacagagggaaagcaatgcttaaaaacagcccagtgaaaaaaaaaaacaaaaaactcgacttcacttagttaaatgtaaaacaagtgtgcacttgaaagtataaaaggttggaaatgcaatgcaacccacagtgtattccaggcattgggtttcttcatattctcaactgcgggacataaacatgagtaagttgggctgtgccaacatttaggaacaccagggcagccatcctggtacagcaaaacagcagtcgcattagaaatatgcttcactttttttaaaagggggtgaaagagaactttgggtcgaattctggagttcctaacattttaacaccaggttgttttctgttatttttctttttatgaaaagattttactgtagaacttaaatttcattttggttaatgtctgatggaaaccaacaaatttatttgactcatagtttattttcctggcttatgggcatagagttgactgtgggccacacagtcaacaagcttcctcactgtcatgggcttttccttggctttgctcttgagtgtggtctccttaccatgcagacaaatggctgggtaactctccagggccactctggttttccacccagactccgtttgtagtggccatcagtcagcaaacactgccaacctgctagctaccccaggactgggtctagaagacagcgctgagccttttcctctacttcccttcccatgccaccatctgcctgtaaaactttatcctcctctaggatacatcgctctaccatgcagttgaaatgcctgccttctctcctagacctcaaggtttttcagagcagaggctttatctcatttaactttgcattcctcctgccttacattgttgttcacaatatagttaatgaattcatattgaataaatgtaggtggatttgttagcatccttacgatactgcaaccctcaaagttaaaagatcttctaaacatagtgaattatttcttacatttgattatagtaggtgacacttccattcctagcacctccctcccccaccccacaaactattatgttggtgatatggtttggagctgtgtctctccctcagatctcatgttgaaatgtaacccccagtgagggagctggggtctggtgggaggtgattggaccatgggagcagtttctcatggtttaacaccatccccccttggtgctgttgtcacgttagtgcaggggtacccaaccccgtggccgcagactggtatcagtcagtgtccttttaggaactgggctgcacagcaggaggggagtggcaggccagcgagcattactgcctgagctccacctcctgtcagatgaacagtggcattagattctcctaagtgcatgaaccctattgcaaactgcacatgcaagggatctaggttgtgtgctccttatgagaatctaactattgcctgatgatctgaggtggaacagtttcacctcaaaaccctatcccccttcccctacttggaaaaattgtcttccacgaaaccagtccctggtgccaaaaaggttggggaccactgcgataatgtaagacgcctgctcccacttcaccttccgccatgactataagccctctgagccctccccagaagcagatgttgccatgcttcctttacagcctatggaaccatgagccaattaaatctcctttctttataataattacccagcctcaggtatttctttatagcagtgcgagaacagcgtaatacagttggttaagtcaccaaatgacttggaataatgcttcttaaggagatagagtgtcatttcctccagagcaggcatgagtgtcatttctatttttcctctttaatgttggtcacagagttgggttcataaatacttgatgattggcatatgctttactcagaattcttttacatgccagtggtgaacacccaaatcacactaacttaaaccaaaaaaaaagggaatgtgttgactgtctaactgaaaaattcaggatctagtctcaggggctctaaatactgaaatatgccgccaggactcttctgtgtctttctctgcttcttgttctgcttccgtgttggctttcttcttttctaatgaaaacatgttccttcttagagcatggagaaaaaagcatggcaggcttatactgtgctatcttaacaaaatgttaaagacatctcatctctctcttccacttccatatataaatatcagagaatgaccaggtttaagtagggttctgtgccatcgctaagccaatcaatgggaaaacaggaaactgcccaggcctgagtcatatacccacttctgtgaccagggaatgagcgttactattttacacaatctcccaaaatcacattggagggaggaagggcatttctccaaatggaggaaatgttttaaatcagaaaagaatgtgggcaaactaaaacaacagatatcttcatcatgaatgttctgtaattttgaaatagataatatctggaaaatattccaagagtacctcaacaaagtaaatgttggcatatgtaaaagcaactcgttattctttgttatagttaaacctttaaaacttggagaatgttttaagaacagtcatgtctcttcatgacaggatacattctgagaaattcattgtaaggcgggatttcattgttgaggaaacatcatagagtgtacttacataaacttagatggtacagcctcctacatacttaggctagatggtatagtctattgctcctaggctactaatctgtatagcatgttactgtgctgaatactgtgggcagttgaaacacaatagtaagtatttgtgtatctgaacatagaaaaggtatagtaaacatacatatatcgtacaaaagataaaaaattgtatatttgtacaggacgcttactatgaatagaacttgcagaactggaagttgctctgggtgagtcagtgagtgagtagtgagtgaatgtaaaggcctgggacattactgtacagtactatagactttataaacactgtacactaaggctaccctacatttattgaaaaatttttttctttaataataaattaactttagcttactgtaattttactttattaacttattgtttttactcttttgtaataacacttagcttaaaacatagtcacattgtacagccatacaaaatattttgtttatgtacttactccttaagctttttttctatttctaattttttttttctttttagacttttttgttgaaactaagacacaaacacacacattagcccaggcctacccagggtcaggatcatcagtatcactgtcttccacctctatatcttgtcccactggaaggtcttcaagggcagtaacaggcatggagctgccatcttctatgataacaatgccttcttctggaagacctcctgaaggacctgcctagggctgtttacagttagctctttttttgtaagtagaaggagtacacttcacaataataataaaaagtatagtattgtaaatactaggcaataggaatttttttgctccattatactcttatgggaccactgttacatatgcagtcagtcgttgaccaaagtgttatgtgacacatcactgtattttaaactattcctggaaacagctttccacctaaaaaagtactacacgtggtctaaaattcagaaacacttgggatattttctgtcaatcaaattgttgtatatctaatctgtttttctcattgaatttcataaagtgtaaattgaagatgtgttcctctggaaataaattcagaactaataaaaacaatgaatagtactgtgacatatgttttctttccctaaaaaatgttacaccaatcctggatgaggatctgtgagtttgctaaggaaaagattcttttatcaagtgagaaatttgaaaagttgttttccacagggttgaccagaagactgggcacatcattaattcggcacaactcaccattcccactggaaacatactagcaattcacatcttccaaacaagcaccaacctcttactccaaaagaaaaatggtactctgaaaatactgtttcagactccagtgtcaaccccaaaattctgttaaacataaatcttatatcagctacctccagcctccattgatgacattattactctcaatataatacattcctaattatatttgccattgaaaggagttggctttcctccagatggaaacctgaaattaaatcttcctcaagtaaaaggcaacatctgaccctttgtaatgcatacaggcacctgggttattcattgaacaaataagtagataaagaagagcagttactgttgataagagggcattggtttgaaacttacagattataatatgaagttaaatgtataaatcagtcactatttccatttttattgtattttatctgccattctagtctttaagtaagtaaattttttatattgttacatcaaacattcacatcataagtagaatggacatgaaagtaattatttttatttttacaggtggctgaagccatactattttatagaattaatggaaagcagaaaagacatcacaaaccaagaagaactttggaaaatgaagcctaggagaaatttagaagaagacgattatttggtaaaatattaataataacaataataaataataatttacatctttaaacataattcagatgccattctgtatctcctagtgttatgaaagtgatttttcaccctagtctgctgatatctggacttggattaccgtcactgatactgtgaaggacagagtagcatatgtgagagacatagtaccttcactgattgtcagggacttagctgaataaccttgaataagttactgaaaatctggggtcttagtttgtttataccatgaaagccttggaccagatcatccccaaggcccttccaattctttctaacagtctatagttctaagttaaaaaaaaaaaaaagtcatcaatgcccatataacagtaattttgtaagcaagcatttttgtcatagacacagtggcagcttaccaagagatcagtaaattgacgattcactgtataaccaaataaatctacttttggataagaatcacttgttccacttttggtcaaacacaggattaagtgtttcttactacattttttgactgaaaaagtggcagaaattttggttccaaacttccaaattatctcaatggaagttttagcagaaattatttatttaatcttaataattttaatagggaaaagtaattaataaattacaagcatatactttataagagtaacaatgtgcataaaatgaaataatttcatttttcaagttaactgtcttacctgtctgaagcatgtatttcttttgtcctaaagacaaaagtctttcagtgccacatagactatgctatcttcaactaaccagtattcaaaagcaagattctgaatgcccttattcaatgagaagcacaatgattgagcaataagtaattagttcaagagatatcccattgttttgttcaattttaagatgttaattttctttcctttgtagcataaggacacgggagagaccagcatgctaaaaagacctgtgcttttgcatttgcaccaaacagcccatgctgatgaatttgactgcccttcagaacttcagcacacacaggaactctttccacagtggcacttgccaattaaaatagctgctattatagcatctctgacttttctttacactcttctgagggaagtaattcaccctttagcaacttcccatcaacaatatttttataaaattccaatcctggtcatcaacaaagtcttgccaatggtttccatcactctcttggcattggtttacctgccaggtgtgatagcagcaattgtccaacttcataatggaaccaagtataagaagtttccacattggttggataagtggatgttaacaagaaagcagtttgggcttctcagtttcttttttgctgtactgcatgcaatttatagtctgtcttacccaatgaggcgatcctacagatacaagttgctaaactgggcatatcaacaggtaagatgacagtgttgacactgttactaataaaaagtctaagtcacctaacaaattaatcatttctcattgtaatatcaataccccaaccctgttgaaactctgtgttgaaaaagtcatctattttaaaatttttattataattacactagggcttggttgtcagtcggttttatattgagaaatgttttttaggctgaaaataaggtacaactttagcaacataagaaacattttgttcatggacgaggccatatttcaaacttctaccaccctcacaagattactttttaatattgttgttcttctccttgtttaccaatatgcatgcacattacagttctatccaagtaaaccatcaaataattattagaaaattaatagattatggaagtgttgcattcaagaaaaaaagtgatagctcctatgtcatttgtcttagaggaatgcaaaaaaaaaaaaagaaaaagtcataaatttgtggagacctgttatcagggcttcatagtaggcacagggaagagtgtagaaggagattcacattcaggaaataactgttgtttgcatttcttctttctttatttaccttctggtaggtccaacaaaataaagaagatgcctggattgagcatgatgtttggagaatggagatttatgtgtctctgggaattgtgggattggcaatactggctctgttggctgtgacatctattccatctgtgagtgactctttgacatggagagaatttcactatattcaggtaaataatatataaaataaccctaagaggtaaatcttctttttgtgtttatgatatagaatatgttgactttaccccataaaaaataacaaatgtttttcaacagcaaagatcttatacttgttccaattaataatgtgctctcctgttgttttccctattgcttctaattaggacaagtgtttcctagacataaataaaaggcattaaaatattctttgttttttttttttgtttgtttgttttttgtttgtttgtttgtttttttgagatgaagtctcgctctgttgcccatgctggagtacagtggcacgatctcggctcactgcaacctgcgcctcctgggttcaggcgattctcttgcctcagcctcctgagtagctgggattacaggcacccatcaccatgtccagctaatttttgtatttttagtagagacagggttttcccatgttggccaggctggtctcgatctcctgacctcaaatgatccgcccacctcggcctcccaaagtgctgggatgacagttgtgagccaccacactcagcctgctctttctaatatttgaaacttgttagacaatttgctacccatctaatgtgatattttaggaatccaatatgcatggtttattatttcttaaaaaaaatattcttttacctgtcacctgaatttagtaatgccttttatgttacacaacttagcactttccagaaacaaaaactctctccttgaaataatagagtttttatctaccaaagatattctagtgtctcatttcaaaggctgctttttccagcttacattttatatacttactcacttgaagtttctaaatattcttgtaattttaaaaatatctcagatttactgaggtttatcttctggtggtagattatccataagaagagtgatgtgccagaatcactctgggatccttgtctgacaagattcaaaggactaaatttaattcagtcatgaacactgccaattaccgtttatgggtagacatctttggaaatttccacaaggtcagacattcgcaactatcccttctacatgtccacacgtatactccaacactttattaggcatctgattagtttggaaagtatgcctccatctgaattagtccagtgtggcttagagttggtacaacattctcacagaatttcctaattttgtaggttcagcctgataaccactggagttctttggtcctcattaaatagctttcttcacacattgctctgcctgttacacatatgatgaacactgctttttagacttcattaggaatttaggactgcatcttgacaactgagcctattctactatatgtacaatacctagcccataataggtatacaatacacatttggtaaaactaattttcaaccaatgacatgtatttttcaactagtaacctagaaatgtttcacttaaaatctgagaactggttacactacaagttaccttggagattcatatatgaaaacgcaaacttagctatttgattgtattcactgggacttaagaatgcgcctgaataattgtgagttcgatttgttctggcaggctaatgaccatttccagtaaagtgaatagaggtcagaagtcgtataaaagaggtgttgtcagaacaccgttgagattacataggtgaacaactatttttaagcaactttatttgtgtagtgacaaagcatcccaatgcaggctgaaatgtttcatcacatctctggatctctctattttgtgcagacattgaaaaaattgttcatattatttccatgttatcagaatatttgattttttaaaaacataggccaagttcattcacttcattattcatttatcaaaatcagagtgaatcacattagtcgccttcacaactgataaagatcactgaagtcaaattgatttttgctataatcttcaatctacctatatttaattgagaatctaaaatgtacaaatcattgtgttgattctgcagggatcctgctataagtaagactcagtccctgattttaggtatcctgtgataagcagaattaagacaaatacacaagagacaaagcacaaaaaataaatatcataaggggatgaacaaaatggtggagaaagagtagacaaagtttttgatcacctgccttcaaagaaaggctgtgaattttgttcacttagacagcttggagacaagaaattacccaaaagtaaggtgaggaggataggcaaaaagagtagaaagatgtgaatggacattgttgagaaatgtgataggaaaacaatcatagataaaggatttccaagcaacagagcatatccagatgaggtaggatgggataaactcttattgaaccaatcttcaccaattttgtttttcttttgcagagcaagctaggaattgtttcccttctactgggcacaatacacgcattgatttttgcctggaataagtggatagatataaaacaatttgtatggtatacacctccaacttttatgatagctgttttccttccaattgttgtcctgatatttaaaagcatactattcctgccatgcttgaggaagaagatactgaagattagacatggttgggaagacgtcaccaaaattaacaaaactgagatatgttcccagttgtagaattactgtttacacacatttttgttcaatattgatatattttatcaccaacatttcaagtttgtatttgttaataaaatgattattcaagg

SEQ ID NO: 36771 - DNA, 5468 bp, Homo sapiens
tcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggaggtgaggagtgtgtgaacgcacctgtgttggagcacggtgtcccactctggcgggtccccagggcctgagcagcagcgatagccctgtgacaatgtgaagggccacagaactcttgtattccagtcaggggcaaagagtggagacggaaggcctgtccttctgacaagcagccccttccactgtctgacagtgggaggtcacccccactgtagcagaggggtggggggcgggtactgccaaggaggagctttggagtgataggcggggcaggcctgggacccttggtctttcccaaagggtggttccctttcgaagttgctattccaaaggtagcagtgaggatggcacacatttatgtagccaggccactcctgtttgtccgtggagtggagaggagccaccctcctgccctctcagaggtccaggtgtgctcactcctatttgggaagagagaaggggcacagcagccctgcaggggcccctggctctgctcgtgtttctgggcttctgctggtagggggtgccaccttcccgtttgaccctggactttctttctccactgcccactttcacccactgggcagctcaggggaggggtcctggcaggagccacagggcaggagggtccatgcctgtccatgctgtcctgggagtgtcttgagatgcccctgggggggccgccctgtaatcatcctcctctccccctccccactggctcgaaggcaggactcgggaggcttcatcagaggactctaaaggatttctggggattctccacttttcgaccctgacccaggaggaggaaggggaaggatggtggtgctgggtgggagtggggatggtgtgtgcttcatccccctctgaccgaaatcctaatcttgtctctagatctgggggctgcagcgttgtgtacctgtcacccttagccttgctgctttgacctgtattgtctgttctgaccctcctgagactggaagctgggggtaggggacacactctccttccatcctgttcctcaggagcccagcaggggtgcagaaggggaaggcagacatgagggcaggtggagtgggggtagaagcagggccagagacagaaggtggatgcctgtctgggatggtggtgcaaaggctgagacagaggctggggtggatggaagccaggatgcagggctaccaaaatcacctggtcccagctgacttgggggtttggaccacagttctttgtgcaggagtccttgggtggttggggagcgggggtgggacacacagggtgaagggagggattggctgtttgtagctgaacagcagaacagagcactctgcctttggggtctctggcatcactggcagggagaggggtggctgggccaggagcccacctcatccccagtgctcagagaactgggtcctcagaagtggtcctgcccccactttacacataaggaaacagacgcaaggaggagagggatgcccaatgacgggcacttcgatgagtccgtgtgaactctgttccgtgtgagctgctgcgcgctcagggaatgattgtgagaagcgggtggaggctggagtgggcagcaaagaactgacattttgaggtcagtttttcactccttggtcaagggcaggctctctccctggtcattaccaggagcctggctccgggcagcaaagaactgacatttcgaggagctctgctaagggccaggcagtatgtgagggagttcacagacaccgtcccattttcacagccctctgaggttggtaacataacccccacttcacagatgaggaactccagcccagaaagcctgtcagccctgagaaaggaagggcagggcatcgggctgggcagctggcctgggaccagtggggtgtgatagtgttggctctgcttcccgcgggtggggtgccagtggggaggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactcaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggtagagaggaagaggctgggggaggaggtgggcaggaggacagggtgctgggacagggagagggaatgaccagaatatgccacaactaggggtgtgcttgcccgcacacagcagggatgggatatgccgagaataacacgccacgctcacagggcccactgagaggcctcccttgaattggggacaactcttggccctggtttggccatttttttgtgagagacgggggcaggccctggcttggagtcttgtttatacgttcttgatgttcatctcctctctcctgtcttctcacaggcaaagacatggcagcagtgcagaggaccctgatggctttgggcagcttggcagtgaccaagaatgatgggcactaccgtggagatcccaactggtttatgaagtatgtggcccccagggagcttgggtctccgcatggggtgggaggtggcttgttctaaggagcttgcgggaaggattaggggaagcagatagccaagaaaggataaagtgagggtctgggatggggaataatgggtccttaatactccttgacccctccctttccaccctcctgcgctcagtctccctagcctatgaggcaagctagattagggaaaaaaagtgcaacaggaaggcaatgggattgggctaggacgtaacagagggatcagaaaacgggtggaaaacacacagttctaccaagtctttatcctggttcctcctcttctaggaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctc

SEQ ID NO: 36772 - DNA, 19191 bp, Homo sapiens
cgacgcgggagccgcacgcgccggacgaggctcgctgcgctccctgttgcccagcgcgggcccgttgaggcggagccctcagttcccggccaggacacggtctgggccgccgaatctccggccgaagagcggcggcggcagcggcggtgaggagaccgggccggggaaaggcagacatggcggggctgtgggtatcgggggagggtggtcccgtcgcccctgcggccacgtcgaaggctcgctggcgggcggcgcaccggggacaggggaggggcaggggatggaaccaggttgcatgggctccggctcggcgccagagcggggctgcgggccgcgagggcggcccgcgaggctttccgcgggaccctcggcgggcgcctgaggaaaaagacgccgcctcagggctcctgccacgtttcccacagcgcgttacattccgcctccgggtgggcgacaaccccgcggcttcccaccctctgtccacccccttcgcgtcggtgttttttctggagctccgcttgtttgctggagagtcgcgcctccgggaagccgggtcctcgaacccagggccgcccgccggggacagcggacccgcggggcaggcgcaccctggcgaggatgttgtcggggaggctgggcattgggcgccagggcccttccccttgaacttggggaaaaccgggattgcagaagttgggcgcagctcaaggcggttctttcaagagcgggtggagatgtttgatccctcctcacctacctctctcaaaaccccagcgggagagcctagcagcaggtttcgatggcttcagaaagtccaactcttagccccttggaaaattatttcccctcttcatggctttgtggcgccgctgaggtcgggccggggctcctcaccccacgggccagtcttctcgcgccctccaccttgggaacgtctatcaggagaaaaatgtgttcctagaaacgtttgcgattagcttttcgttacaagggagggaaaagtacaaaagttataaactcctgcgaggccgagcttgattctggattccctttgggttttatccacgcagccgtgagcagaggagccttgtggaacaaagtagaacttgaggagcagccgccgcggtgacgaggtcccaggatgacgtcaccgtgcgatatttaaaatgggagccttttgctctgagtgtgggtggaggacgcctacttactcaagacgcctgaggtcttcttggccctgcttgcctctggtggttcttgccctgactgtaactctccctctttcaccttttggtactcctagaatactggtgggagtgggcttatttttcagctgttcgagctatcatttcttcaaacggggaaaacaaaagtccaaatgagtcatcttgtgttacaaccaaaagcaaccactaagtggttctttccttcttttctatttttttatatgaagcagagcaaacagaaacaaatccagaactcagatatgtggcacatagttggcaaatgtaatgaatgaggagaaagatctagttaaaagattcagtacatttctttagtgtggttccttgtttgctttgctggagtggaggctaatgtagttccatcagcaaaactttcttcccaacccgtatattaaattgccttgggttttcttttccatcgtatcgtggtggaatataaacgtagctttacaaagtggaaatggcttacatttttcaggaggaggctgcacagcagtcgtggtgggctggggttatgtatacgtgtacactcgtgtgtggacccatgcccggtgcctgctagctggctgtagaaggtgaatttctcattctagggttctgggaggaagatttgtgtgccttcccctccatcaggctatctgcggctgccagcacacctctcagataactgtgtagaatttatttcacagtgaggttccttgtttgaatttgcacttggaataaaggagtcatattctgaagagagactgaaagagcagtttgagaaaagaaagctaacaatcagctttatttttttggaaatgtgggaacacaaactactgctaggttagttgtttttatgctaaacatagcagaggctgtatgtttttaatacgtaattggctcccaaaaaggtgatgttgcttactaaaggcagcatcttaataactccaggttacagcagccagatgaatgagctcactgagtagagacaacatacatcaaaacaatcttaggacaagggtttgcccttaaggattaatcaatgataaatcagatataccatttttaaagtcctttgaggcaatccaaaatgtagctaaatctctgattatttcttttagtttgtttttctgcgggtgacctgaatttccatttcttaaatatgtcctgatagatccactagtttttgtgtctcttaacttgtggataaatgtatctctcttcctgaaagagtactttcggaaagtcaatgctgaaattttttatgtagaacagttttgggatttaatttatataccatgcaattcacccatttaaaatgtacagttcaatggttttagtatattcacaaagttgtacaaccattactatagtgaaatttagtaaatatttttatcacctcaaaaagtaaccctgtacttattagcaatgctccttttcttggtttcccacttccccgtaggccactaatctgtcttctgtctatatagatttgcttattctggatatttcatatcaatggaatcgtacaatatgtggtcatttgtgactggcttctttcccttagtgtgatgtattcaaggttcacccatgttgtagcttatattagtactcattcgttttaactgctgaataatattccattacatgtatataccacagtatttgtccattccttaattggtaaacatatagattgtttttactttttagctattatgaatactgctgtgggcatttctgtgttcaaggttcacccatattgtagcttgtattagtactcattccttttcattgctgaataatattccatacgtgtgtataacacagtatttgtccattctttagttggtaaacatattgttttcactttttagctattatgaatactgctatgggcatttctgtacaaggttttggtgtggacatatgttttcatttctcttgggcaaatagaagtagaattggccgtgtcatatgataactctgtgtttaacctttctaggaactgccgaacttttctgttataaaatagctctacagttctagattttaaagtagactttttttatgttttaaagttcaaatcatttcacagaattttaaacttagattattgcagctaaatattgacacacacagtaacatctatgtcgtatcatttattatagtgcttctcttttactgataggtgtggttttattttagccaacaggagcaacgtgctatctttatggaatttcttcatgaagctaagtgataagatttttaagtagtattttataataaggcctttatggcataaagataagtagattgttctctacttcagatataagccaaagaaatacaagataaaattggaaggaggaaggggagagctgtaaaggaggtatatcttacagagcttcatcttcccagtttttatattttgtttttctgagaaaacatgttttatctttgcagggaaaaaaatgaagaatgaaattgctgccgttgtcttctttttcacaaggctagttcgaaaacatgataagttgaaaaaagaggcagttgagaggtttgctgagaaattgaccctaatacttcaagaaaaatataaaaatcactggtatccagaaaaaccatcgaaaggacaggcctacaggtaaaggattagattggattaagcagaggctgatcaacccctgaggtgggttcaaggccggatgattgaagggtgtgcagaccatgcctacaggtgtttcatctgcaaaatatagaactctggggtgtttgtatattttctccttactcattttaaaacaagtatttgttggcggagtggtggagtcccactgcctggacacaggaggccaatgctatggggtcaaaggagttagtcttttgtggttatagcctggctcctaacagtgcatttctgtttatcacaaatacttagggattttcacaattctagaggacccctaataacacattaatgggcatggtaggagttgaaagaagtgaatcttgcatctaaaagtaaattacatgttatatgttctttgaaaaaaaaaaaagtatggaaaaagggaactaagattatcagacacctgatatgtcgttaatacaagaataatctcatttatatatttgtggtagaagtcagtgtaactattttctagatgaatgtgactcacctgtgatccacgactagtaaataatggctctgggatttgcttttctgggagttttttttttttgtggtattgtttttgctctgtcacccagtctagagtgcagtggtataaccatagctcactgcagcctcaaactcctgggctcaagcaatcctactgcctcagactccaaagtagctaggattatagacatgtgccaacacaccaggctaatttaaaaacaaatttttttttgtatagatgggatcttgctgtgttacccaggtgagtttcaaactcctggcctcacgcgatcttctccctttgcctcccagaatgtgaggattacaggcgtgagccaccatgcctggccaaggttctgggatttgaactcaggtctacatgaccccatgttttcatgggctttctgcacaccacagtgttaccactgttttggcactgagaacgaaggtaattctcacttggagctgtcttttgtactctgctgtataaggtacatttacagcttaaagtaaagaagagcagactcctataaaacatgccctggcatgctcactgtagtatttatgtgactgctcaggaacctcagttgagaatgttctgctaaactcagctgccaaacattgtcccattttgtggatgtggccacgagaaataaaagtggaacagtgactatagtgataactacagaaatactcttttatttgtgtatattgatgtccccaaagtttcctacacaaatcaacactttgtgctttgatgtcagaaggacttcctttctgccactgggctcttgcaagtacagcactattcaaggagtctaaaaaggaggtaaacatattatttgctaatttctcatgtactgaaagtcaagtgagcttgtgttctattgacaagaagagaatcaaaatagtttattttccttttcatttttaatccaaagaggtttccagtaaattggaaaatgaattaaaatagaaatgtgcacgctaacacaggctcaagtcattttttatcttatctcttgattatcttaattttttttttgcatattttcatttccaatagagtgaacagctttcgttaagttagaactgttgaggctttttactctgatttaactgacattggatgaaggctttttggaagtgccaagccaccatactattactgaaaaaggaggcactgtcaagtaaatatttaaaggtcagacagtgtacaatttcatttccattaattctaaaaacttgagaaaaaaactgaaacgattaaattggcatgtgatcagaagtatcattactgagtcattttaaagctgtatttgaagtagaaaaaatagtgggttgttactattataaaaatgaatagaatataagattaaccaagttagtagagacttcagtctgtagaataggtggagtgttctttctcttacaaaatgtttgtaagttgaaattgtttttctgcaatataaataagatacttgtagagagcaatttggcaatattatcaagatctataaaaatattcataccttttgaacagtaagtctcccaagaatctattctagaagtataattagaaatgcagacgaacatgtatgaatatggatgtctcttacactttgtaattgcaaaaatggaaagaactaaactgtcaacattaagtaaatgatagaatatttttatgcaacttttaaaattttgtttttgaagagtagttaatggataagtagtatgtagagtgaaaaaaaatagtacaaaacatgtaaggtatgcagattttgttgaagcatagtctctgtttaagcatctatatttatatataatttgtaagcttagagcctgtatcaccttaattgtagataagaaaaacacatacatctaagatatatctttttatccttaactgcttttggtcccagagcacatgggatctttcaaattaccctatacaatattagaatctatagcataagaccatgtttttaaaaggactaagcagtattttacatactagaaaataatttttctcactttgcctttgttatattgttaatggtgacgctaagataggtacgtatatacagggttgagtattaaggaaataacttgctctttggagtctagtggcctggatttgaaccctagatccatcacttagtagctgtgtaatgttgggaagttactcaaactctctctgcctccttttttctttatgctgaggaaaaaagtatctaactcacaggatgatcatgagaattaagagttaatacatgcaaagcatttaggaaattgtccattgcataataaattttttaaaatgcttattattgttaatattattatgtagaaacacttattcctattacctgttgagaactttttcattttttaaatagaaattaaaaccaactaataatttaacttttacaaaaactttaaatagcacattagtctttatatcattgtattttacagcgtaattactattcatcaattaacttgtatttccatgttttatagttacaggtctgaggaagaggtacagtgacttaactaggcttacctgataaatactaggattagtgctgaaatccaagttctcttgattgattcttgattgtaggcagtaaatacttttccttcataggccctatttccctacttaatcagaatgcttatcatttaacagaatgcatattttttatttattaaacattccattaggtagatgtcgtataataggttaaaaaaagatgggacagaggctttattggtttagaaattttcctcacttaattttgacaactatttaaataaaagtgcttgggtaaatagaagttaaatgaaataagccaataacatgttagttaggtattttaatcataagtatatgatatgaatgaatctgtgtccttcacttatcctgtatttatagaacaattataggtaaagcaagggtgtcctcttaccactttactatctgagatataaaagcaagttaatgacagatcagaatttgtcgtaagcatttccaaataccatctgaaacattagatgaggccttttgttagagatttttttgtataggaacttggcctatagaaacttttaccttcagagttctaaaatttcgtgcaactttcatactccgtgctcatttaatgtacatgggtggtcaagtctctgggtagactgaggtagacccagtactagtgatttccttgggctcacataggtgccatctttttttcaggctgcctctgtgcctgtagttcacatttattatctgtttaggatagatatgctcctaggttctctaccagggtatttttttattactattttattactcaccttggcaagtatgaatagatattacggcgtttatgattaaattcatttaaatccattaacgtaactccactttgttgtagatgtattcgtgtcaataaatttcagagagttgatcctgatgtcctgaaagcctgtgaaaacagctgcatcttgtatagtgacctgggcttgccaaaggagctcactctctgggtggacccatgtgaggtgtgctgtcggtgagttctcaagtttagaggctgaactgatgaccatgctggaactaattttatgacattctgtcatgtacggcctgcctgtgtatctttatggccaggagctggtggtttaactctctcagatgtaaattttatgaaatacttttctggaggtgatgttgaaggactagttagatttctgctttatagccgaaaaaagaaactgattaggcgggggttttctagtagtgctttgccaagaagcttattgtagaccaagaagtagacacctagattccgctaggtgtctattatctttaattggtggtgcacttgtctgtcttcaaattaagaagctaatcccaaataatactggataaccacttttggtttgtttctgtttctgtttattctccctctctcctctttttttttgggacggagtttcactcttgttgcccaggctggagcgcaatggtgcattcttggctgtctgcaacctctgcctgccgggttcaagtgattctcctgcctcagcctcctgagtagctggaattacaggcgcccaccactgtgcccggctaatttttttttatatttgtagtagagatggggtttcaccatgttggccagactgctctcaaactcctgacctcgtgatccgcccgccttggcctcccaaagcgctggattacaggcgtgagccactgcgcccggcctcctcctttttgattatgtaagtgactgagtgatacttcgtggttttatttttataatggaagttatttttcacatctcctaatgaatagagttgtgaaagatcagtgctaggtatgaaatctttttgaactccacttgctcaaaaaccattatttgtggaccaggcactctcagttgtagggttttcaaaaacgaaagcaacattctgcttttaggtaattcagtttgaaattgagaagaaaagtaagcaaattacattgttatctgatttatgttagaaatgtgtacaaaatgcagtggtaggttgcacaaagtagaaagttactgcatctggtgaggagtcaggagactactgagtaggtgatacttgagctgggaggtgaaggatgagccatggttgaccaggtgacaaggtgggaaggatgttctaactagcaggaagaagatgaacagaggcatggaattcctgcaagaattttcctgtggctctgcctttaggatgtttctatttggttttgaggtacaattcacctgaccacctggcctctttattgattgtagtaaagttgctttttgaaggaaccctaactatgtactcctaaggtggtcgcagactgacctgattccagcaatgaaggtggaggtgaagacaggagagatgaattacatgattattcttccattaaattttgtcaggaccaccgcttgaggttactacctgatttgccagtggttggtgtaagtttattgcttttggaaaccagatgtaggtggtagaggtttgtgataaacattctccaatacttctttctcgggtagaaaaggagcaagctatctcaaatttaggtctgagaaaataaacatttttagattctgggactaattaaggacctgctttaggctagtttcagacttggaaaactttggccactgaacctgtgcagaagacctccatttataagaaatagctgtcaaaaagctactatattgaattgtttactttttaatttgacctgcacttagatcctagttggctcctatttaacacacagttaagttagttgtgtggtttcttaacccatgaaatgtgagaagcagcattttaaagagggttgatgagtcagacgctaccaaaaaatgtcatgtggtctgacatagaggcaaaaatgaaaaagctaaaaaatcagcacgattatgttatcacacaatcaaatagtttacgttcaatataatgatcctaaaccatcaggggaaagtttttatgtccaaggatgtttaacaagttacataattatataaacattttggacctatgtatttaaaatgcttaaaataagtctcagtacctgaacataaaaactttagttatacggacattctacttcagtagacatttcattacttgatgatgcctggtaggaaaaaactgctactttgctttcatcttattaatcttagaaaaccttttcattcagtaggcttctaatttatatgtaaatttgccaaaaattggctctgatgtgatttttttcacagctaatagaaatcacctgcgagtgtcaggtgttcattcaataacagaaccccaaaaagaaagacgtattaatcgtttagtagaggtggttgatataagttaacagaagaaaaagacattgagaaatattttttcaccaaaactggaaacatagatattttgaaaattaaagctgatctagcaagtatacaattgatcaaatatctgagaatctttaaaaataataactcattggtatactagagactaagattgtaaaaaaaaattgagatgcactgagaacattcttcatagtcttcacttactctgatagaataaaatgctgcaagagtacaaagagtgccatatagttagaaaggttatcacttcgtgatacagaatagaaaataaatcttgcctatgatgagaagttctgagaacagatgccagcttatctactcaacatattttacaactttttttttttttggtgatttctgccatcctttttttcccccaatagagtgttaaatactattgattgtttctaaataactaaattagccttgatgttttatcagtgatcattgaaaaatggaaagtttaaaagttgtccaggtgtctactaattctcctaagatatcgactgcacattgtaatgttatagtagtatagtcagcagcttctcttaccatgaagagagagccttcataccaaaatagtacaaagggaaaaatgcagaaccaaactaggtgtcaaagaaatctgagttaataatgctgatccttcaatcattagatatttgcccttggttgaggtttctgtttacaaaggcaggaatttttctcaaatttcttgcctttccatttttgaattttgattccattaatgggcaaaactgaagataggcctaagtcattgttatattagtgtcattaacacatgaattaacccttgattgtcttgaaatttgttgagtcttccaactgtggaggggacatggagtaaatgtgtattgctaaaaccttatgctaagtaaacttgaaattagagaacacaaattttatgttgtgaggaactcaattgtttaggaatttattttttgtttgttttgttttgttttagagagagggtcttgctgtgttgtccaggctggaatgcggtggcatgatcatagctcactataattgtgaactcctgggctcaagcaatcttcctgccttgaccttccaaagtactagaattatagatgtaagctaccatgtccagcttctgtttaggtattttatactacgaagagtcaccagccgtagatcaaccactatctagccagctccagcttcctcgtccagcatataggaaactaaggcctagggaaattaagtgacttgcctctggtgaccaagctagtcagtggcagagccagaatgagaaactagtctaatgccctttctaccatcccgtagcaactttttttttttttttgagacggagtctcactctgtcgcccaggctggagtgcagtggtgcgatctcagctcactgcaacctctgcctcccaggttcaagcaattctcctgcctcagcctcccgagtagctgggattacaggcgcacaccaccatgcccggctaattttttgtatttttagtagagacagggtttcaccatgttggccaggctggcctcgaacgcctgacctcatgatccacccgccttggcctcccaaagtgctgggattacaggcatgagccaccgcgcccagcccctgtagcaacttttatgaggtaaactaaaaaagaatacaaaagcgaagttatgtactatatttaagtagtatttatagtttcatttggcctataggaatggaagacagcatagctatctgaagaaatagaactcatctatgtgtgatctctgagactgctagatttccacatacattttcttttctgtttttttaattttttgttcttgtttttttgtttttttgagagacagggtctcaccatgttacccagactggtctcaaattcctgggctcaagcagtctgcccacctaggcctcctgaagtgctggaattacaggtgtaagccactgcacccagcctcatgtacattttcaaaggctttatagcagttaagccttttactttataatagataaccattctgattcagaaataatttgagacgagtgctatcttgaaatgaattaacttcagctaactattgaatcaaaagcttgacattatttctacttagagttacttatttttatcttttttcaaacttagaatcactttaattacatttctaactgtatgtgttttgtaagaaccgcttaacaatatcctttgtcctgatgctagaaattgtttgatagtgttgacactgtgcaatctatttaaatagatttgtggatttctcctatgtccactgaataaaaactcttggttttacttgagtttattacactattttcctacagttcagaatttttttttaagtaaccagcagcatatgttacatattttgacaacttaaaaaaaatcaaaaatcttcaaaaatgttttggaagaataacaagattttttcatcttaccttaaaaaaaattaagatgagaggtgagtagttatcctaggaaactctgaagtaagcaatataatttaagcaaaacctctatattcttcaacaactatcttttttctttaatctcaataactgcctcagttctcatttttgtgagtataaataacaggcccccttttttatttaattggggttaaagtcaattttataggaaatttctagttgatctgtgacttgaattactagcatatatgttacatttataagtacagctggggctgggcgtgatggctcacgcctataaacccagcactttgggaggccgaggcgggtggatcacctgaggtcaggagttcaagaccagcctggccagcatggtgaaacctcatctctactaaaaatacaaaaattagctgggcgtggtggtgggcacctgtaatcccagctacttaggaggctgaggcaggagaatcacttgaacacctgggaggtggagattgtagtgggccgagattgcacccattgcactccagcctgggcaacagagtgagactccgtctcaaaaaaaaaaaaaaaaaaatcagccagtggcgcatgcctgtaattctagcactttgggtagctgaagtgggtggatctcttgagcctaggagtttgggaccagcctcagcaacatggtgaaaccctgtctctaaaaatgtatataaattagctgagcatggtggtacactcctgtagtcccagcctcttgggaggtttgaagttggaggatcgatcacctgagcccaggaggtagagtctgcagtgagttgtgattgtgccactgcactccagcctgggcaacagagtgaaacccatctcaaaaaaataaaaatacatcagaatgttttattgtacaaccaatttcattggtacatacaaaaatgtaatcaaaacaatggactttttttgatgttttaaacaattttttttttaggaattagtagaaagaaaataagggaaagaaaatggggttatgtttatgaatacttaaatagaccagaagtagaaaactgtggtttgcttgctggcattgagctgtattaggatattaaatgtgtagggtcaagttctgtgatgattcaatctttgccttgtattgatggcatgtccagatctctttgtttttatggacattttttgctttgctgatgtgacttcaagatttgtaagtttttaattttattcttaggtatggagagaaaaacaatgcattcattgttgccagctttgaaaataaagatgagaacaaggatgagatctccaggaaagttaccagggcccttgataaggttacctctgattatcattcaggatcctcttcttcagatgaagaaacaagtaaggaaatggaagtgaaacccagttcggtgactgcagccgcaagtcctgtgtaccaggtaaccatgaaaacagctcagttttaaagggatgtgcagggattgccaggacctttcaggtagtcctacttggcattgcccaaggtttctgacttgagattctggataatagttcttgcctttccccatgctaagggaaagctgtttctctggcacgtaaataggcatcctgagtcattttatcaaaggtcagcttcactatacaataactaggataaatatatttcagaaaaattggcaaaaagtagaaaattcatgatggtaaaacattcctgatattttaaaatctcattcaaaagttaccacttattttttgtagtatgtaacactttgttttgtacctttgggtttaactttctattctctcccgttccatgattaaagagaaacctctctaaatttattatattataattaatattttactcaagctgaaacattgtctccctttttgctttactagttgaaaagtcatatagctagtgtgcctgcacttacagatccattcactgatttactatttatatctacataccaaagaacatttaatcgactttaaaaaattgttgaccaaacagcattcttcaacaggaaagatattttaaagtcataacaatttaaagagattttttgagttgagccttattctgtaaatgtacttattactaatttttaaaggttatctatttttacttacttgctttgattaaatgtgaaacataccaggtttgtggtaaggttgagctgaaaatgaaaatttagacctaatgagtaagaagcagaatattggagcttttagtatgataaactaaacttttaaattcagcatacatttacataatgaacattatttcagtgtaacttaatttttggttttctcatttttttctcagttgaattattcttcctagactttaggggaagattatttctgaagattatcataatttaggattctatgtatatgtgtatgtatatgtatatgtatataacatgtacctggctttatgaaacttcaaacagtacaagacagtataatagtgagaagtcctctttctccccaaccaccagtccctatgcatttccacagagacattcattaccaggtttttttttcttttttttagtatccttccagagacattccctatataaataagtaaacatagtatttgtacttcaggatcatttttaaaaaccttgccataaatatttgaggcattttttttctctgtgtgatggattatatattgcaaattaggtatattgaattttctggaattcatccaaatgtgtggcaattttacctcagaattttatttgttgttaagcaagaatgtaagtctcaaattaaattgattgctgctaattttttacaagcaaattaacctttaatttttaggatttcttttaaaattaaattgcatttattttccctcatgttgaaagactattaggataacagaaaggtatggaaattgaggtgtctcttacgtgctttttaaggaaaacatttctccttggcctaatactcattagcaaaacattttataatagagaaacactacttgtgtgaaagctagtgcaaatggcccactttgattttcttctttctagtatcttgaatctggcattgccacaagctttaaaaaagttttatcaaataaggacaacaaaatttctagcttggaatttttgttctctactgttttctaaaaggtatcccaagagaggggataaagaattattcatatcttaaaaaacgaagaaatgaagattgtgtcagttctcctgaaatagatctgtagatccaattcagtatcaatgaacatcttaaaaggtttttttctggaaagtgacaaattgattcaaaattttaaaaaaggaggatcagttggagggctcacactaattcaaagctattatatattcatcaagacagtgtggtaatggtttaaaaacatacaaatatattgatggcacaggatagagagtccagaagtagacccacatacatacagttagtcttttttctcccttttaacaaaagtgccaaagcaattcaatggggaaagtcttcaagaacttgtgctgaaacaactggatgatctgtgtaggaaaaaaaacgaacctaacttagctgacaccatacacaaaaatattgatttgagatggattgtgtacctagacataaaagataaatctctgacgcttttagaagaaaacatagggaaatataatctttattttgtgacaggcaaatatttcctctagagggtcacaaaaagtaactaataagggaaaaaaattgacaaactggacttcatcaaaattaatcatctttttgttcatcaaagaaaccattaagaaaatgggcaaaccatagactaggacaaaatattctcattacatatatctgtaaaggacttatttccagaatatactttttttaaaatcgctcacaaatcactagtaaaaggtaaatgattcaatgaaaaataatgggcatatcctgctgtaatctcaaaaaaagggcaggaggagcaaaagatgtgaataaacactttacaaaaggagttatgtgaatggcctcatttatgatcagaggaatgcagattaaatccatatgaaacactagttcttccagaactgcacaatttaaaagcctgacagcatgaaatgttagcaaggatgtgaagcagctagattcataaacttgctagtcatgtaaaatagtaccactactttggaaaactggaactttttaacgttaaatgtgtaactcttctattactcagcagttccactcctaagtattaaatatttaccaaaagaaacgaaaatatgcctataaagccttctattagaattaactgtgctgttattcattgcagcattgttttgttcgttgtgtatcattgtttttttaatagtaagagactgaaaacagcctcaatgtcccattactaggagaccatttaatttatagtcattgctatactatctagctgtagaaaaatgagaaggatctttatgtattgatatgtttctgaaatgtattattatgaaatgtaaaaagcaggatacaatccagtatacatatatatttttaaagtgtgtatagatgtggatagaatatctctaaaggtatatttaaaaaaatgtttggtgtcagttgcccttgagaagggttaagataaagaagataaagggtgagataaaaaaagagggactttccacagtttacccttttgtactttttgaattttctatcatgaatgcaatgctatacacaatataatttttttaaaaaaatcctatacttagaaatgcagatttgagatcagcaaaatcagaaatttaagaagatgtggcattctaagcagagaggtctaaaactgctgataagaacactttgaataatgtgaacctgacgtgcccacctgatttatgggataatctaaaactattattcccaaatactaaactggctacatcagaatcacctggggagctttgtcaaaatacctggcctctagttctgagattttattattgttcattagaccagtgctagggcatgaatgttttgtgtttatctttttttttttttaacttttattttaggtttagggatacacatgaaggtttgttccataggtaaacatgtgtcacagggatttgttgtacatattatttcatcacccaggtgtgaagcccagtactcaatagttatcttttctgctccttttccttctcccaccctcccctctcaaatagactccaatgtctattgtttccttctttgtgttcataagttcttatcattacctcccacttataagtgagaacatgcggtagttgattttctgtttctgcattagtttgctaaggataatggcctccagctccaatgttttgtatttaaaagcctccaagtgactcctggcttagccagctgtggaaaccactggactaaaacaagcatgtccttacaagcttccattcgttccatgttttggtcttttttggttgaagttgtttaggaagtactgtgtttgagtttattcatttctttatgcattcagaaaacattggtcacctgttatacattatacgcctattacacatgaggtttttaatgtatttagacctgacaataggagtgtcacttagatgtgatctcagtgttgtgggtaactttgtttgtctttaatgagaaatctggaacatagatgatgattttttcctttgaattaacttaatgtgttctcttccctacagatttcagaacttatatttccacctcttccaatgtggcaccctttgcccagaaaaaagccaggaatgtatcgagggaatggccatcagaatcactatcctcctcctgttccatttggttatccaaatcagggaagaaaaaataaaccatatcgcccaattccagtgacatgggtacctcctcctggaatgcattgtgaccggaatcactggattaatcctcacatgttagcacctcactaacttcgtttttgattgtgttggtgtcatgttgagaaaaaggtagaataaaccttactacacattaaaagttaaaagttcttactaatagtagtgaagttagatgggccaaaccatcaaacttatttttatagaagttattgagaataatctttcttaaaaaatatatgcactttagatattgatatagtttgagaaattttattaaagttagtcaagtgcctaagtttttaatattggacttgagtatttatatattgtgcatcaactctgttggatacgagaacactgtagaagtggacgatttgttctagcacctttgagaatttactttatggagcgtatgtaagttatttatatacaaggaaatctattttatgtcgttgtttaagagaattgtgtgaaatcatgtagttgcaaataaaaaatagtttgaggcatg

SEQ ID NO: 36773 - DNA, 4668 bp, Homo sapiens
ggtgccacttctcttcccttcattcttcgccaggctctctgctgactcaagtgtaagtgagaacaggtgtgagtgagtgggccggcgggcttctggtgggtcgggcactgtggtccctggcctcagagaaggaagggcctcgaggtcatcatccttctcctagcaggcagctatgcggcggggcagggacaggggaggaaggagggccatgaaggggaggagggtcagccaagatgctgtgagttttggagcgggacactatctgagtcctggaggcatatgaaactgtccataaaggacggatgctggggtcctcagtgggggccagggaaagggtgggacagcccgcgcttgacagcgcctgcctcagtgctcgtgttcactgggggtcttcccatcagccccttcacccacgaggtgaactgccgcggagctgtgagggtgccgtttgcattccaattgtcgggactctttcacctgagactgagactcagtgggtgggtccaccgatcgttcctccatgggagtttaagtgtgaagaggagctggtgggcttcaggagggtcgggcagcacagtccgtggcctcggaggaggaagggcctcacaggtggtggcgccgccatgaccttgtggttgtggcagggctggggcgagggaggaagttgggccacggaggggagagggatcagatggagcaaaacttggggggtactttttgaggtatctttgagtcccagaggcacctgaaactgccgaaagaggacaggtttcggagttctcagtggggacctggggaggaggggacctggggtggctgtatattaaaaaatctcttcataatggagtttagttatgaaattaagtctctttaggaaagaccccatgttttgatctaggacttgaagatcacttctctgccgagctggctgtggaagaaacaaagcagtttgcagatagatttatttgatgtgattggaaaccaggcgtagttattattaactcaggacctattatggaaatctcacaaaattaaaaaaaattacaatcagcagatggccatggaaagagtcaagtataattactcctttttattgcagtcttcagttcacgatcttctagttgcagcgatgagtgcacgagtgagatcaagatccagaggaagaggagatggtcaggaggctcccgatgtggttgcattcgtggctgtgagtacatttcagtatcttatttccattggcagaaatgtatttttctgaaagaaaatctaaaacattgttaaccaatatagatctgttatataaaggacttccctgctgaaaatagttgcaaactaaatcacattaatgagacattgagcaaggagacttattttctgatattgtctgcatatgtatgtttttaagagtctggaaatagtcttatgactttcctatcatgcttattaataaataatacagcccagagaagatgaaaatgggttccagaattattggtccttgcaggtaactccttaaagtatattctatataggaagaataacttttcttaagagtacttacagagaagataggaaaaacctcttcagatttatttgtgactagctaccttcacatagtatgtatatttgtgacttctattgccatgatattaataacaatattctatttgcatctactctcccccacctctcaaaagcccggtgaatctcagcaagaggaaccaccaactgacaatcaggatattgaacctggacaagagagagaaggaacacctccgatcgaaggtgagaagggcatggaggagcattttgtgtttcatgtatgattttatactagtaacaggaataaataaaccatcccctaaaaattggctggaaacctgtaaagtaatccttggtaagggaatagtgtagttttcagctgctgtagtccttgtgataaattttctcttcagcattttacttatcttatatcttaagagttctttggcatacttggaaaatacaatccttgccaagactctatattagcaaacaaaaggaaactacattaaatttagacaaaattgtaaactgtttcatgagttaaacttggttttattgggatattatttttctgggcataagtcattgcattaaaagtttgagcaaaccatatattatggttagatcttacatagcaatttttagaaaatgtcataattcagagaaataaaaatgtgaaatccttttagttaccgttaaaagtcttcaatacttttgtctttctgaaccataatctgtttgtcatatatttattttttaactttttacttagaaaggacttaaaatgtaaggaaaagttatccaagtacagtgaactcctgtgtattcttcaccttgattcactgattgctataacattttgccatttatctccctgtttttaccatattaatatattattgctgaaccacttgagagtttcaaatatcacaactgtttactctgtaagtaattcagtatgtatctgctaaaaatatggataatctcttaaataacctcagaacagttatcaaattcaggaaaattagcattgagaaaacatctaatatatagtccattgcagttttgtcaattggcctaggaatgtcttttataggatttttttcctgatccaggatctaattcaagactactcattgcatttagttgccatatctctctggtcttctttaatctggaagtgttcctcagtctttctttgcatatcatgacattgacaactagaatccaaaccaattgttttgtgaaatgttctttaatttgggtttgtcttatgttaatatttttacagacatttttttcattcatttactggggcttgctaggtgccgggtaatgtactaagtgctgaggatataaatgagataatgatttctgccttgagctcacaatctaatcagggaaattcatgtaaacaaataactgctgtaatgagtgatttacagtaacagaagtatatgtagattgtgaaagtgacaactaagttgtcttaaacagtcgtaggaaaagaaaacttcatagtagagataatattcttccccattttctagtagaaaattccaatgcccattgcactcatgcatcacatttgttagaatacaagcctacagagctttatttaataacactaatttataatttactgcttacttatatcaataacttttttatttatataagaacgtaaagtagaaggtgattgccaggaaatggatctggaaaagactcggagtgagcgtggagatggctctgatgtaaaagagaagactccacctaatcctaagcatgctaagactaaagaagcaggtacgttattcattcggaatggaagtcatggggttactctttttctataatatactttaataacaagtctcgcatacaaatattatttgaaaggtagttcagacaccaaatacttgattcaaagacagtgtcaggggaaaaatgaattaggtcaaagccatgttgttgaattataaaatatgaaagtattattactttggagtagaaatcttccaaaactcaaggcaagtgatcaaatacttttaaaagtatatacattacttaacataccccaggggcaattgggtatctaaatgacacatagtgttcctttaagaaaaaaatttgctagaattgtttatcacaaatcgcttttaggcactaacaagtaagatagatctgtatgttttgaattttccaagttggtttgttgattttttaaaaaactgtgagctagactgagaaacagtagcagtttccctcacattttaatgtcatctatatggtagtggcttaaataaaccaataagaccatgtatatattttttaacgtgcatatctggcctccaaccatgtaatttttatcatctaaatcaggacacttttgagagggaaagggaatgctatgaatacaacatcaggttaacaggtgccaatgagacaaatggccaccctggtataaagaatccacataaagatttaactagatcaatgaattatttttgcacttttgctcaaagagacaaaccaaatggaatggcattctttgacctctctttagtcagctaaacaattccttagctaatatataattagcagaaagtttttagtcaatacatttgagtgacactgtgtttgcttgcttgttttttgcttcttggactttttgtttgattaaaaaatcaaaacaaaacaaaactgaaatcagtggctgtttttgccctctacttaaaatgatctttaaatgggctcatagcatttaatctgttctggcttgagaagtctttgtttccttgtaccactagagtgaggcattttaaaaattagtacacatatgcctgaaaatgtacattagcatagaagtctatgcagtggttagcgttctggttttaatttcatcttaagaaaccaaaactagtgttctttgtgtgcttttagtgtcatctcagtaaagttctgctaagtaatgaactcaactgttatgtttatattttaggagatgggcagccataagttaaaaagaagacaagctgaagctacacacatggctgatgtcacattgaaaatgtgactgaaaatttgaaaattctctcaataaagtttgagttttctctgaag

SEQ ID NO: 36774 - DNA, 108572 bp, Homo sapiens
gcagaagcggtcgtcaggggcgtggcggcagttacttgggcggggccggtagcggcgggagctgcactggccaggggttccggctgtatatccatgagcgccgctggcagccggggagctgcaggaaccagactgggggcgagctgagcacctgtagtcaatcacacgcaggtaaagccacggccgagcgagctccgcggagcggggatcgcaccccggacccgtcgaaccgaatctccgagccccgaggtccccggcgtagctcggcccatcacgccgcagcctgaggggatcctggggggcctgtcatctggcgccgtgggggtcccaggggctggcttgcccagtggtggggacagcccagatcgcggcgggggatacgccttcctgaggccctttgtccccttctgcccgaggaaccgaggttggggacaaccccgaccgcggcctttcccccattggtgctcactcctgggtcttcaggggcctggggaggggtctgccggttcaggctcggcgaagaaggtccgggatccgcacctggaaggagagggccgaggggcctgattacagcccgagatacccgagaggcctctgtgtttcggggctccaggggctcacgcaggaccagtgggtttaagttctagaaaggcagcttttgacccacttggaagcacatttaccgagttcggccccgcgaccggcactgttctaggcccttcgtgagcttttcccacagctagagctgtccagcagcgcaggaggctgcctgccaggccgggcagctagcgcctcgaccttggcgatgtccaagcagtggcctgatgacagccacctgtgtcggatgcttaggactcccaagggaggactgcatgacccatctgtaagggccttctctacccacaaatgcactctaagtggcctttgatgcctagcttgagaagagtacttctgggggtccattaggttccaagtggctgttgaattcacccataatgaattttgaggtttcagctctcaagagtgggtgttagcaaagagactggattatacaaaaagatagaggtttatttagccactgtgaaactccttgtatttgaactaccatggaccgctctcttaatcttcccaatctctcttttttggttgctggacctccagtttgtcagtttcacctgcattccagtaaccaaatccaaaggcatgttccaagaacaggctccacagagggacctggagagactgcaggtttggcagagtcaacaagatctgtgcccagagcttttcgaaggccgtttccttacagccacattaagcagagtccaaaagagaaatccttcactaccctctgtcatttgccggaatagagagaacataataatctaaaggtcaggaggcagagaaagaatcttaacacaccttgctgtgtgttttaggatgaattaatctttgaacatctagtcagaaagcagtccatatacagctggtagtcagcacggactgtgacattttagagctgaaggcaccttagatagagctcatctctatctaagtctaattaggtggactctcattcagtctcctcaatgcacaggtgaggaaactgaggcctggggtggtcacagggctggttggtcatcacaggcccatgactaagggttgatctcttgactgtatttagatctagccagtgcatgacttatttcactccaagcttagtttgcccattctcagtgttttaagttctaggggagtccagagaggttaggaggacagattttggtgcctgagtgcctggatttgaatcccagccctgcctcttactggctgtacaaccttgggcaagctacttaacttctctgtgcctctgtttcctcacctctaaaacagaaataataatgatacttatgttagaagattgttttgagaagtgcatggagttactacatctgaagcatttagaacagtacctggcacagggtaagcacaatagatttgctagatatgatattctgttgcctttttgtacatttttcttcatatccaccacccaatactctatcaagagctaatttttcccccagtccccttccccccacccccaaattcatttaacatattccagatttcattttaacacagacagctgcaaggggtttccaagtcacgttgcattttataccttacttatttttgtgattcaggtaatttagtttctatgttagttcccccttgcagttacattcttcttaggctctgaaccctttaaaattatcgttaaaagcaggcagtgaggggtgggaatccctcgaaatggtaaagtcctggatgatacccgtgtccatggtgtccttccaaatatgtattccctctcttcagccctcctcccaagcgatgagtgtgatgcagcttgattctaaatggatgaacatttttagattaagattttatgagccactgtattaagtgcttttcggaagttcagggatcatgtgtcaactgcatttaaggaagttacttagtcattcgaatagggggagcaccagcagcgcctgcctggcctggcagaagcaaaagtgtgtgactgatccgtgctggcaatctagctggttcactggtttatctgtgtttttcctgttcttttccaaagcttgaaataaaccagatggcaagtacaagggaatggtctttttcctctcattttagtcagggtcgttcacttttttccctttttactctcaccttcatttcctttatcgcctgcgtgggtctgacaaataggcactctcagtgtgccagccaattcccttttgatgaaaagatgcctgccactttcattttttgcaggaatccagtcacctttgattttctcttctgtttttacttgttttctagattgaaccaaagattatcacttcattaaatggcaccttctcatgctttatttttcttgagttgattctgaatttcggtttttgtttaagctgttctagagatcagccattttagaataatagttttcatttctttgcttgtgtattaatatgggcccctttctctctttctcactctcttttctcagtattttggtggatgagcttctcatttgctgttactcgttgctttaagcatttacgccttttcctggtaatctccggcaggacccataacctctgtagtggttctcactgcccttgttcagagctcctgccccgagcaggaaataatttctttggtcttatgggagacaggggtagagtctgtcttattttttgcctaaaatctggctcttttaaaagccccaggagagagacatttccaatataattgaattttgtgtggcagaatttctaccatgacctacagcttacagtattcccatttttattgcattgtgagttttgagtactccatgaccagtttcagagtatagatgatgtggggcatgagttgctttagcctttctgtttcatcttgggctaagctatccccaggaacagagcaatgagaagttcagggtgcctcttaaatgtgtctggtgtcaggattttatagcagcttttcatggttcagcctttttggccagtgcatgagtaggacatttttaagccctgtgctgctgtttctttgttgataccatacagatgctacattatctcctttcaggattttcatatctgcagattgatttttgttgtcttgtccagggcatcatatttttggattgaatgttttctgtttgtaaaatggttggtgtggacagacgataagctccaccattacccctgaagcttgtggactggggccatttgggtgaggggcttgttacacaccgactcattgtctgatctttcacaataaatagcagacaggtgaagagctttttagagaagtggaacgttggtacccttggatttgcctggtttctgattttcttttgttgtctttaagtggaggttcattaagttcaacaaattaagcatctggtgtgtgccaggaacacagttgacaagattaacaaattagtttggtttgttgcttaaaaactattttgttttaaaattgtttttaatagaaattttaaaattttttaattcaaattttagtttttaaaaataggcaatacattcacatgatgaaagaaaattttttaaaggcacaaaaggttaactagtaaatacatctgtgtgtacccctgacccctgatcctcagaggcaaccagtattagcgatttcttcatcctccagaagtggtccctgaacttccaagggattttatacatctgtaagcaaattcgttaaacatattctgtacaccacccctttttgcagaaatggtagcacactgcatacatgctatttggaaccttgcctttttcacttaatatttcttggcagtgtgaaaagagcttccacgtcattttttatgaaggccgtctattttagatatctgttttctgtttctaaggatgctaaaaaacagtcttatttaggcagcagctttgctggagatcttaaagatcttgtgaatatttggaggcaaatatttttcttttctgtgagagcccgggggaggtgcaggggagcttctaaaggtcagctgagaagggagagctggggcactggagagtgaggaacgcattggtccttgggcccttcttcgccttgccgtctgtgcagaatgtgctagcatttccagggaaagtttgccgtttgctctctgttctccagagaagcttcctggcctccccaagtcacatttccagcatcttttttcattcttttttttttttttttttttttttgagacagagtctcacttttgtctcccaggctggagtgcagtggcgcaatcttggctcgctgcaacctctgcttcgcgggttcaaacgattttcctgcctcagcctctcaagtagctgggattacaggcacacgccaccacccccagctaattttgtatttttggtagagacagggtttcactatgctggtctcaaactcctgacctcaggtgatcctcttgcctcagcctcccaaagtgctgggattacagacgtgagccaccgtgcctggcctcatttccagcatctctgttgcatttcatcccgtctcctgcaccacagcatcactccatttgtcctgcctttgggcgtccaagaggaagcctgccctttgtcacagcactttctgtttgggtagctttaagtgtctcaccccttcttttctctcaccccaggaaaaaccagctctcacacctgctcctctgtaaagcgtcttccccaagcccacacgtaattttgttgctgtccttgaaagtatttcccaagatctccaaaccgctttaaacttccaaggtctgagcctgacctggcctcgctaacaaagggttccactgatgccgactctaagaagaaagttttcaaggttcttcgtatttgaactttctatggctaggcttatgtttaaaataaccacactgatttaaacatggtcttatagtcttcagtggctcccaggtcttgcctctcgggttttttttcctctttcctttgaatgtgccttaaccttcgtcttgcttttatttacctctgagtctggtttagagccacctggaaattgaatggaatctttagtctattagtctaatctagagtccttaccttctggcctttgctcattgcagagcccccacattattagtcagttgtaccacagatactgtgttacataaggtgaggagagggaggtggtgttatcagttccactttttccaggctagagtgcagtggcccgatctcggtgcactgcaacctctgcttcccgggttcaagcgattttcctgcctcagcctctcattttatcttggataaaagagaagctttgaaagattgcctccctatgtgtacagtcactgtaggcatgtatttgtgtactgtttacttagtcatgtcaatgagggcaataaaaaacaaaaatcaggaagcccaacatggattgctacattttaattctttcaaataaggaaatacagcagggcttggtgtcactacgcctgtagtgacagcactttgggaggccgaggcgggcggatcacctgaggtcaggagtttgagatctgcctgatcaacatggtgaaaccccgtctctactaaaaatacaaaaattagctgagcatggtggtgtgcgcctgtagtcccagctacttgggagactgaggcaggagaatcacttgaacccaggaggcagaggctgccgtgagccaagatcgcaccactgcactccagcctgggcggcagagcaagactccgtctcaaaacagcaacaacaacaacaacaaaaacaaataaggaaatacaaaagccctgtcatctaaaaagatattttagcctgggtgcggtggctcacacctgtaatcccagtactttgagaggccgaggcaggcggatcacttgagaccaggagttcgagaccagcctggccaacatgatgaaaccccatatccactaaaaatacaaaatattagccgggcatggtggttcacactcagaatcccagctactcgggaagctgaagcaggagaatcacttgaacccgggaggcagaggttccggtgagccaagattgagctactgtactccagcctgggtgacagagcaagactgtgtctcaaaaaaaaaaaaaaaaaaaaaagatattttagcaccaaaaatgttggaagatcaatatctcagattaaagagcaccttctaaccaggacatatttagcttactaaaaaggttgagttaatggccattgaattatgctgtttgggagggcctaaagtcgaggattctactcaaggagaggttcctcttttgcagtttccttaaacaatgctcgttactctttttctgggaaatcaggccattgatttagtttagttaacctaactgcagcagcatttggcggggctttgcgcccagtttttcaggtggtacagactacacaatgttgatatgcaattgtagcaccttatagtgaggtgaacttatactggaaatcgttctttgaatcctgaagcctggatttgtcatgtttgaagtgccacgttttagttcttaaggactgaggagtgggagggggctgaggtgagaccccagcaacctgctggaattaagtaaggctcttcagtggtatttacacataagttctttggaagcatgtacttaaacttactaaatccatgatttggtatgcccggtaatggcccagatggcttctgagatacagcatgacctctcttccgtgtccccaccacactttttgctttcctcgtgtagcaccatcacattcattttgtgctatggatttcccaatccagggctgaggatgtgtccttgaggttccttgggttctcattagattacaaactcagacgttttggtttcgtgttaatgataattgaaaatgttttacaagcctgtcctggaatgttgggatacctaattataatatcaaggtgcacccacgtcgtctcagtgcctcccccgtttgtatgtgaatttctgatgaattgaagccaggtaaaccccactatagagaaaaatacagagatgaacttcgcgcagaaaagatatgagagcatcatgtgaagtcaaatgataccacacagcactgtgtaaatgaaggctgtagcagtggtcccagcgagaaaaggagtgtgagaatggacttgtcacactgtacctgtcagtgtaggctctcgggatccatagaacctgcccaggcacaggcaggaccacactgacattgtctgcaggtatttcaggtctgaaaaatggcattagtctcattacattaatgtagctcatctgaatttactgtttgagtaattttatgtttttataaatgtgcctggatctctgtaatcgtaaaagtgccaaaggaagtttatgctccatactgagtactatttgtactgtttgtgcattttaagaaataatataataaataatagttggataaaagtagtttaatttaaatttaagaatggaacacaaagtaatgtaaccaggggcatctggcaggactagtttttcccctcagaggaagccatttggtacctgagtttgaaagaccccagtgcaggaatcgaagctctgggaggcagacagaggtttccagtcatgtttgtgtcattcatatggctcctttccatgtgctgaccatttgagaaatattagctgagttgaagagttaattgacataattggttttctgccttgaggtcctgtctgttcggaccctgaaagtgataaagttatttggagaacttgagaaacactcccaaagagagtgacaaaagttacttatgggtttgggaaagacactttacaggggagcaggtacaagtcatcatacccgtttgtacgtgcagccaacacttaccttctacattaatgaaaggaagacttccaaaactaatttctctgtttctttttgtttgtttatttttggagtgagtgataaaggtttcttgttgatatttgcgtgacctaaactcttgccagaattgcagtagctggcagcagcctcaagtttattttccacaggcaactcatcagcccagggacagtagaggcttgatcgcagctgaaagttggggtgagcttgggcctttgtgactagcaggactgtttgtcatattgctaaataatcactcattcatttattagctttttattctgggaattttaaagatatacagaagtagagagaatcatataatgaacctccaagccccacaaaacccatcccagctttaacaataatcaactcataaccactcacatttactctgtcttcctagctacttctcccagctcacattaattttgaaatagatcccaaacatcatatagttgcatctgtaaatatttccatgataattcttaaatataaagactcctttgttaaacacccattattactctttgaaaaattaacactaatcctttaatatcatcaaatatcatcattgttcaaatttccaattgtttaaaaatggcataagtgtttttctccttaagcttaatttttgtgagttaggattcaagtaaggattagacattatgattgattgctctaccatttatgtctcttttaagctataggtccccttttcttttcttttttcttcttttccctgtaatttgttggagaaactgggtagtctgtccagtagaggtatttgtttacttttgacagataacgcattcatgtgttataacattcaaaaggtacaacatagtaaagagtggaaaacttcctcccaagaagcactcaatgttactagtatcttgtatattttttcagagatcttttatgtgtgtcccagcaaatgtgtatgcatctatattctttttctttcttttttatataactggtagcatattgtacatgttgttctgctccttgttttagtcacttaacatggaattatacatgttagcaaatttcttgttttttcttttttgagacagtctcactctgtcacgcaggctggattgcagtggcaggatctgggctcactgcagcctccacctcctagactcaagtgatccttccacctcagccttcccagtagttaggactacatcacacccagctaatttttgtgtttgttgtagagatggggtttcaccatgttgcccaggctggtctcaaattcctgagctcaagtgatccacccacctcagcctcccaaagtgctgggattacagatgtgcgccatggcacccaggcaaattttagcaaatttctacatatattgtttggcatcctattactttttctcatgtattcaattatgtcattactatttcctaaaaattgagggacatacaatattcctaggattatgtgattgtgctagagtcctcacagctgggaaatgttcttttttctcattcagagaatgagaaaaattcagagttcagcaggcatttattgagctctttccctgctggacgctgtgccagacactctgtcctgaggagtttccctggggcctgaacaccctgtgccccactatgggccatagaggaggctttccacagtgctaactgagcttccaaccccttccagctccttgtgtggcctgaactgtattcacactgtagacattagcttctcaggttccaaatatcctggctgcagttccctcctctattctgatcatgtaaataaagtgcttgctcattcttgtcaatgatgttgacaaatgtacccttctaaatagtgggatgatggaaaatgccgagtagattatagccaaggatatttttcccaatttagaaaacatagttcctttccctccatctatcattaatatcacccatcagtctatttattgactctacatataaattctggatgttgcactgacatcgcaagagaaatcagcactttgccacaaaagagcttataagaggaatgcagatttctttaagtctcttatggatgagcagagaggcctcatggagcttctgtaaagctgaattatcaaggctgaagtgatcagaatccatccagctctgcaaacagcttataagatggatgggtgccttgcttctctgtattcctagagcctcaccagggcctggcacagggagggtccctggtcctcagtttccttgcctgcattaatagtaactcacagcggttgtgagcaccaaatgaggtaatgtcggaggatgcactttgtcagtaagttaggcattcagtcttcactgtcaacacaaatgcattctgtgacatgtttgaggagtaaatgaggtaatgtattaaaatcacgaacactttataaacgatagagctacacaaataggacattttcttatcatccagctttgttccttcatttaaagttatcatgatttggccaggctcagtggctcatacctgtataattccagcacagtgggaggctaaggtgggaggatcacttgaggccagtagttggagaccagcctggaaaacatagtgagactccatctctgcaacaacaacaacaacaagaaattttaattagccaagtgtggtggcacatacctgcagtcccagctactcgggaagctgaggcaggaagatcacttgagcccaggagttcagagttgcagtgagctatgattgcaccactgcactccagcctgggtaacagagcaagaccttgtctctataaattaaaataaataaataaaaggcggggtgcagtagctcatacctgtaatcccagcactttgggaggccgaggtaagtggatcacttgaggccaggagttcaagaccatcctggccaacatggtgaaaaatataaaactaagctgggcatggtagtgcacacctgtggtcccagctactcgggaggctgaggcatgagaatagaattgcttgaacccgggaggtggaggttgcagtgagccaagatcatgccgctgcactccagcctgggcagcagagcaagaccctgtctcaaaaaataagtaaataataaagatacagtgatttaaagataacagtatcagagccaaagaacaatactagattctaggatgagagtctttaccctaacttatggttcacagatttaatattttgtctgggcagccggtagaggagcttatggtctggaatgggagaaggaacgtgtgtgtgatccatgttacctgtagaagacatttaaattagcattgatcatgattgctcacaggcaagtcaagaccagactaaccaggcttgaggacccagacatttggctctggactgggatcttccagccttggtgaatgaagtctctcctttgtcttctctggtgagcacaccactcccaagttcacattgtgttgttaatttttttttttttttttaagagacagggtcttactctgtcacccaggctggagtgcaatagtgcgatcatagctcactgtagcctcaatcttctgtgctcaagtgatcctcccacttgcccgaagccacacaactagtaagtagtgtagctgcagttcaggtcaaatctgtctgtgtccagatcctgcaagtagcctctctaccccaccaccaatgtacatctacagaaagcatctcaatgaagcagaaatctttgtagaaatatttttccattctccttagatgttaaaaaggaaccttattggccaggcaaagtggctcacgcctgtaatcccagcactttcggaggctgaggtgggtggatcacgaggtcaggagttcgagaccagcctggccaacatagtgaaaccctgtctctactaaaaatacaaaaaattagccaggtgtggtggcgggcacctgtaataccagctactcgggaggctgaggcaggagaattgctggaacccaggaggcggaggttgctgtgagctgagatgtgccattgcactccaccctgggccacagtgagagactccatctcaaaaaaaaaggaaccttattttataatttcaccagccttttaatctaggttaaactacagttaatggtattgagttttatattttctggaccaaataagctcatgtcagttggagaataccatagacaattttgttgcattgtatattttggagagaatagcagaaatcatgagtcttctaatggtatttcagtatttaactgaatgtcaacaatcaatgggtagatttccatctactttctatttgcgggcctttcctttcttctgctacctccaacatcctgttttagctttgaatatatttctttatttgtgagacagcagtttctggagtagatctttgagcccagtgagatgttcttgagacaaatggggaaagtgtgaaagaaatatgccttgggacagtaactcctctgagcagtggaaagtgaaaactctcatttttggatggataattatttgcttgaactttgagatgttctttaaatatccaaaagctgctgacagcccaggccacagtgagctttctctcctgatgtacagtggcgtggcaattactcataaaggcctgtacctctccgcccaatgtaataatctggtaagaaacttctgttcagagaaccacaatgataatgctttaggttaatgccacagacttagtcaattagtaaatatttacagtgtccactatgcactcaacaccctaaatttaaatttgtgtagaatttaaacatgaggactgaattacaagtacataggtcagaacccccaacagagatgaaagagatatgaatcatcacttttatgcagagaagagactagcaaatgttctagttatagagggtggttacacagtgtgaaggtgagaaatagtatgatttttagggcctggaggggatgggcccccagtgaatatctttgtatggttcagcaggttgtacaaaactagttagatgccatcaagggcttgcagtggggctcaaatggtgaacgtcagtgcttgtccaacatcgccatgggtcaggttacttgtagccaagtaaatgcttctcacacctatgacctcacttcagcccctcatatgaacaacagtgcacagccctatgcgcacagccaaggcagcacctgtgtagcgtcattttccaggctgatgtctggaattccccttgtaagtaaagcactgaagcttcattccataatgactcactgccactgctccaaaacacacccctcttgtccatctgcccatttcctgaccgcccagcattcttgggccttggctcaactgtgagcccagcctgacgtctgcatccacccctccttctcaccttctcttctattccatctcttccagtggttcccagctttgagtccacctccttcttctttctgcctcctttgtttgaactcctctagtatttatagttggtacttcagagtttagtacttcattatatacagatttgttgtactattttccaattgttttatggatgctgtgtatcatacttctttcatagcccccacagaggttagagtgatgtctttcgtccctgtggggagtgaggtggaatgtcaggagggcgtagtttgcaaaacatccctcccagtggtactgatgccttttcgcaggttctgtcctcttcatttgcaagccactgctttatccacgagggtgctccctacttatgccagtgaattaatttttggtaagtggggtaattttctttcctaatctcagagtaatatttctgccattttttatgaaaccatcttccttgatggccagttccttgcctcccaggaaactgatgaggaggcaagacgaatgtattgggaaagcccagcggaggaagagctcctgaggagtgagtggcgtagctatctgcttcatgtggggcgctcctgctctgcagtgtagagtattttttaggtggactaggagcaaatgcctgcctgatacaggcaacgtttgcacaaaaacccaaaggaagaaggctgctggtaggctaggggtggcaggtgggattgcccttgggctttaaagaaggctgagaaaacttacttccagagtgggaggcaggaggagtgagccttggaacaatagtggagtgtttgtggtggacggacgggagagaggaacacttgagggcatgaacttacttctgtctctttacttgaaaaagcaatccactgagctaagaccctaaaatacatcaacccagagggcttcctttcgagtttttagtttttagatcattcggtatcctcaatgcaaagatgtgataaagtcaagctcaggactacttggggaccaattctcatcctcctcatgtgttacaattccttagcagttgctttaaaactaacatttttctaatcttgaaatatttaataaagcagctttctgctaaagagctgaaagcattttacgaaccttatcttgaggatatccgtgcatattttattattttaagtcattttttttagcctacagaatttcatcaacttctttccttcagttacacgtaaagtaacctcccttcccccattttatagaagaaaaaacaaatcttcataatgtttagataattcacccaaggtcacttggcagaatctggaatcaaacgcaggtctcctggttccaaaaccttcgcccctgtgtcattcagttatatcacatggactcttaagttaggcctcaaaatcctccaaaagtgcaagtgatctgcccagagctgtacagcacagaatgttcaggggggtaagggttggaataactccagatggcactggagacaagtagtgtagagacacaaatgggatcctctccctcctctgacatccagaatccagaatctctgggtctttccacttgggttgtgacctacaagttgggggcaaagctctttagctctcataatcagcaggactgatggcggaagctgggcagggctccctggaggcccagtgttgggctggcatgttcagcaccagataggtgcctatctcacaatatccctttttcatttcaggcacagatgaatccttcatatttatctggatttagctggtagcatttgtctcctaagacttggtcacagaggaatccatgtgaccttcaggccttctgctctaaactggcaggagatcctgtttctactcacagcgtccgaggtatttataaaacagaaataagtaaagcatgcctcaaaatgctgtgcacactatgtactgttgcccccagaaccttctcttggtcttggagggcaaggatcacagagctttttctgctgtctctccctgtgtaacagggtctggtggccgagccctgaggggcgctgttgctcccaggtggcagaattcagcatcagagagccacacagctgaaagagatggatgggtgagtgacctcagctttgcccagctggggtgagtgggccgagcaagtctctcctttggcaaaatcatctgggcttgttctcatccctgctgaattggcaggggaggagagggtcgtggcccattggtcattggtcgggtttcctcacaaatgcctgccatggtgaaatgcaagactgttagagtgataatgggctgcacgtgttaatgctgtcatcacgggccccacagtgtgtattagccaagtactgggggcactgggagccttgtctgctcccagtcggcgttgggaaaccagaacgctcaggaacggtgagtcccagttatttttattttctcattaactgagagtagctgtaagtccttttctgttgcaggtctgggtgaaactttcttctttgcctgccttagggagttagatgggttgagtggttcttcaggcaacggttgtgccaggcactgggtcttgccctcccacccccatctccatttcctccttctggaagcttatttccagacatagaagagtgggtggcatctctatggtgcccaggacaatcaatctggagatgccctcttcttcagttgtatccttctcttaaaaattccagtaaactaggcacttgagctcattgggttctggtaaactgcaattttgcttctgatattacagaatttaattatggtgtagatttttaaaaatatgtttaggataaatctcacaattcatatgcctgttctcttagaaaatctagaacctccctagaggaaacacctggcgtaagatttttttgtttgttctcaggtatggattcatggtttctcagtgaaagagaaaacaattttgcctgtgattttactaagtgctttacccattcgttctctcatagccagtactattctttcagcagggttatttgctagtggaagaggccagcttcctttcagtattttagtaagggcacgtaaaagtgcccgattaaatgttcctgtttaactggtgactcagtcttcagacatttttagtttggtaactttctttgtggaagctcatgggttagtagccattcctgacatttaaatgtgaggttcacgttttcctgcattgggtaacttgactccccctgagaacttgtagactattttctgaaattccagcagattgagtgtgtgaccttatgactttgtggaagaaatatggctaaataaaactgttatcacatgagtaggtttgcacagaaagacaatttcaaggacttatcttgaatacaacaaagggcaaccttgccgtaaatacatttaattatctgtcaatccctccagttctcttctactaaattgtgtgtgacttgatgatcccttcaccttgtaggacctggtttgtaagagatggactggatcaaccaagggctttatccttccttgttatggtaacccactcccgccctttcagggcagtccctggcttgagttagttaatgttcaaaaatcagtgtttctcagcatctctggaaaacaggattggccctattgtttccagggctttcccatcccttctggcttgaggtggtggtggtggtgagaggaggtcttttttttttttcttttaaacaatagagacggagtttctccatgtcacacaggctagtcttgaactcctgggctcaagcaatccaccctccttggcctcccaaatggccaggattatagatgtaagccactgtgcccagccgagaggtggtcttttaaaacccagagtattggccaggtgcagtagctcacgcctgtaattccagcactttgggaggccgaggcaggtggatcacctgaggtcaggagttcgagaccagcctggctaacatggtgaaaccccgtttttactaaaaatgcaataaattagtggggcatggtggcacccacctgtaatcccagctacgccagaggcttgaacccaggaggcagaggttgcagtgacctgagattgtgccattgcactgcagcttgggcgacaagagcgaaactccatctcaaaaacaaacaaacccagagtatttgagcaccgtgatgactccattccacagaaccctctgtgggaggacacgtggtcctagaccaacaccgatttgctaaaaggtgggtctgtgagctgctggctaaggtgctcactcacctcattagaccttaccgagagtgagaacagggccgggtcgccagggctgtgcagttcccgaagcctcctggctatgttctgaggctctcccatcccatggcagtgaaagactcagaggacacaaaggcacaactcagacggggatggctaggccttctccccaaaatcatctgggcttgttttcgtccctgcagaatggtttttttccccctatgatggctctgactaatttagttaaatggcagataaagtggggagaaggtggcccatttcctccttactttctctccaagggtgtcatgttgcccacatttaaggttgaccacttttatctggtgtagcaagttcaatagtgaccctccaaaatttatgtcccatctgaaaccagtgaatgtgaccttatttggaaattgggtctttgcagatgtaatcaagttaagatggggttgtacttttatctaagctgccaccaaagaggctgaaaaatcagaatgacatgggatggaaacagaccatgtttttggggtggtgtgctgtggccttctgctgtccttctcctgacatcctcacagggtactttgggggacaaagttttatctcagggcattacagtttgctgggagatccaggctaggcaagaggggatttttacctgcagggaagaatgggtagtctttccatgggcaggagaagcccctcagcaggagaggggtggtgtcaggagcaggggttccagctgtgcactgccaaggatgcattttagcacagaaaacaagaacaatgcatcttggaactgtttatgggacatgatgatcaccacttagtatccagtgatttattaagtctaacatggttccattttagaagatatggttccattttagaagaatcaagaagagtatgtcctggaattaattttaaactcattggaggaggcccaagcagttaatcagctagtgagttcattgctaatgagacttgtgtgtcagttaggaaggagtatgttttgtggtcgtttctatctgtcaacttaggttgtttactgaggcaaaatggaggaaagtttaatagtggagatggtaatagcgaatattttgcggtagtaccccaaaatattaaaaatacggtagtattgtatgccggcattgttttaaaatgctctttatgtattaacatgttcagtttacagatggtgttcagagggattaaggaacttgccccaggacaaacactgtggctggatttggcactggctgtgtcactgcaggactggaccctaaatgaaatttacatcttcaaccagatggaattggaacagagaaatcctttaggggtttggtttggttttccttgagaggtatttgccttaggacccataagtatcaaagcttgttgtgctaggtccttgagggttgcaaggaagagagatctccccctcccccagctgtctgtgtcctctgagctctctcactttgctgatagctaagaggaaaggaaaggatggttctgatagctgaatcacagaggcaaagaagccaagccaataagtatttattcacagaatgcaatttgtattatgttaagaagtcatctgtgggtgttcatgtcagttagctgtcatctgaattgatgggagcgtgtctgagtaacaagggtcctttcagaaggaagtggcaaacggtcccttcagccactaaggacaggagcgtggaactcctgagtcatgagaggtaatttgggcatattctctcaccattctagaagctagaagtttgaaaacaggttttacaaggttggctccttccttaggctctgaaggcaagactgttccctgcttgtctcctcttctgatggttgccagccatccttggcattgcttgctgtagatacgtggctccagtctccacttccatcttcacgtggcctcctcccctctgtatctgtgtctttgtatccagatttcacttcttccaaggacaccagtcatggggttaggactccctccaacgagtacgaccccatcttaacttgattacatttgcaaagacccaattccaaataccgtcacattcactggtttcagatggacatgaattttgtggggagggtccctattcaacttgctacaccaggtaatgggtttcctttgtttgggatctctctgctctgtttgttcgtgctttccgcactgtaagttgtgtcctgtcagtgaatattggtgttccaaggctgaaagcatcacgatcccatgcaggtggaatgaatatgatgaaattattggcacagctgaaagaaaatatataactgtttaatttatttgaagaaagaacaaaggccctgagggttgttagttcttaagaattttactgtgtaatcatctatgaagtaggctggaaaatggccgttttctgttacaaagtacagcgatagttttttcctgtgctctttagccgaggaccgcaattctgtccctagaatctcagacatttctagctgaaagagacctttggcatcatctacttctaatctaaccttctcattttacagatggggcctttagggcccaaaaagattaagtgccttgattcaaggtcatcagccaggaaagggcagagcagacactaggacccaggtctcagagcccccagactggagcttttcccagtgcagtggcagtttctcactctatctgtgcctccatctgaaaataatgcttttagccaggggagagcagaaagaggcatgggagacacagctcaggccttcacctctggtggaaataccagtcaagcttgtcttagagaccaggggcaacactgggagctcctttggtgactagatgttgggcatttggtagcaccttggtttcctttgttaatgcggactataaatggaattctgactaccatttacagcacctaaatcccattcataaaatggcagggaaggtgtgggctagccgacagagaagggattgccacagggacacaggaagcccagcccatcatgaaggtggagctgggtttggggtgggggtagggagacgcttcctttccatctgcgacatacccagccctccagctgttctctgtgacttcttttccctatctaggctgcctgatgttcattttaactggatttcacctgtctggaaagtggggagggccacacaaaataatacaatggaatcagagtttgctgtatctagaacaagttcagaatattaatatatagtgacaagtcagacttggggaaaaaagaataccataaaacaaaatgcagcaagataaagtgaatgtgaaaatttttcttctaaaattacttatctcctcatttaatacctatgtatatgcacgtacatgcacacactcatacttacacatgcttctacattttatacagtcgttcctgtatatccttggggaaatagttccagttcccctgcagataccaaacccacagatgatcaagtctgatataaaatgacatagtatttgcatataacctatgcatatcctcctatatacattaaatcatctctagattacttataatacctattacaaagtaaatgatgtaaataatttaaatactgtattgcttttatttaaatttttctttttatactatcttttctcttattttctttttttttattttttaagacggactctcactctgttgcccaggctggagtgtggtagtgtggcaacctccacctctcaggttcaagtgattctcctgcctcagcctgggattacaggcacgtgccaccatacctggctaatttttttgtatttttggtagagatggggtctccccatattggccaggctcatcttgaactcctggtctcaagtgatccgcccgcctcggcctgcaaagtgctaggattacaggcgtgagtcccctgcacccggccttattgtcttttttttcaaaaattttcatctgattggttgaacctgcagttaaggaggaacaactgtacttcattcgctaaggctgggttctagatctagctgctccatgaggacttccttgcttaatttttttttttctggactgatttttatctaagcttctaaagtacagatagccttaacataaatttcttttctccctggttaaaatgagaatttacttaactgccaaccttcacagtgctaggtgcacaggaggtagtcaggtacttaattaagcctgctgaaactccagggagtacccccagggacatgcagaactgacctgtacctcaggacttcaggttgaaaccttggatcgaggctgtgtagttggaccacaataattataaatctctcatagaattgccttccctgaattgaattgaattttaaaaccttggcattttttgagggttgaggaaattaattctctactgcatttgctatttaaaaaaagttgtgggaggacattgtctgtcacatcactcaaggtccccttacataaagtcccacattttttttaaataattctgtgccagataagccctgtttccacagagtttctcttatgccactgggcgtaagagcacaatatatgttagctctctttccattttggaaaccataggtctgactgggtttcccttttccccctgacagtcagaaagctcagataaattaattaaagcataatcacatgcattaaagctttatcacatatataattgttgtgtatgttgacatacatattttcctttccagtgttttaaaatttctccttagattttcttagttgctattttaaagctttgttctaataataaaaatgtttgtagtcattatgaattttgggaaatagaaaaaaagaagtcgccaatactcttataacgcagtgattttagcattcataaagatttgaatatataattttccttctatatctttagaaattgccaagtaaaacagtctagaagtcacagtggcttcaactgctcattctctcatgtaaaagaagtcctgagataggcagtctagatctgatatggtggctccattaagttgtcaagaattcagatttctgtctctctgccctgctgtcatcttaatggggctcctagagagacttcaaggtcacttcatggcccaagagggctgttagagttgcagccatgttttctgcattccagggatgcaagaagggaaaagggcagacaaagggtgaactccctgccctctaaggagctttcccaaaaattagatctacccctccagagctgaccagaatttagttacatggactcacctagctaagggaagccagaaagcattcaccagtcttatacatttccatatctttccctatgcatatagattcagtaagggtgttttcttgaagctgtctcaaatagtttgtggaaagagttaaggtataaataaacctcaatgaaaatatcaataaataaaaggcactacatcttgttatcctatcagcattgccactctgcctttccatcattttttctagggattttttatttatatatatatatattgattgtatatttttcaaatattcagtcaacacagaccttttcagggctagaagggaccttagatgcttttctccaaaggttgcatattcagatgcttacggggaccattcaggtaccatacattattaaagcgggccagggatcagtgttgaggtcaccactaatagggagtggtggggactgtggccacctggagagagcttgctgggtctgaagcggggcagccctgctcagctctgtccattgttgccgtgtgagaatgctggccctgtgttgccaaatcttctgattttgtttccaagagaaaccagaaatctagatttttatctgaaatctcctggtgttaataatatggcaatgaataaattaattttttttaaatgccagctgaatgcaacactgcctgccccatgggctgccagtttaggatctttgatctggtccatgccctgtttttcatttggcagccaagcctgtggggtcaggtggcctgtgatgtggctgaagactttgctcttccggccccacctcaccacagcctggtcctctatgactaatttgtctcagaatagggacagataataattggaagctgggcaagactgttctgaaggttaattgattctttccttcaatgggctttgtttttcttctgaggtcattttggtgtggtagaatcagaaaaaagaaattgggcttgaatcccagctctgctgtttacagctgtctgactttgggcaagcctctggtgtcttgtgtgtgtctcctgcaccatccattttcttgcttgcctctctttctttctcacttacctgccttcaagtagcacagcatggtgattaagaggaggatctcttgggccagatatgaaagctggcttttctacccaccagctgtatgacactgggaaagtaacttaaactttctatgtctcagttaccttgtctataaaatggggtaataatagcatctacctcatagggtacaggaaggattaaatgagctaccatatgtcaagtttgaagagcagagcttagcacgtagatagtgctgcataaacattgggctgtttcccccatgttctctcttttgcttctgctgctttggaagccatagatcttttagcagcttcttgcactaggctcagctcaggtcccccatctgacagcaagcacttttagcttctggcgcttctcagcagccagcctctggccatagtctgaactcagaccctacaagcaatgcaatcccctaccttttgcttttggccctgttctgtttctggtactttgtttttgagcccatctgtgccctattacttttctcagctcatatttttttctgtccctgctgtatgtttggaagagaacaaataagtcgactggctgtgctgtctcgatctcaagccttgctaagttatttcattggtcacacagagatgttacctgtcctgttaggcatttctggagattatgttgtgagataaaggttcaaagcagtgtgaattggctttagccagaattaggaacacagcagaaaacttgtcctagaaaccagagagagcctgtcagtcttggtggattcacaaagccttcccgcagcaggcttgttaaaaaggccaaacattcaagagtgtggcatacatgttaattaacaaaattgtcttttccctaaagactttaaatgcagaggaacttgactgtgcttacgtttcaattaaactgcttctttttcgttctttaaaacattaccatccaatctttttagcttttaggtttgtttgaataagagatctgacctgaccggcccaactgtacaactcttcaaggaaaattcgtatttgcagtgggaagaataagtaacattggtatgtattgctgagactcttatttttgtttctcctccccttatgttaggaagcagtgaatagaagtgggaagggaaggactgacttgtttaattcaacaagtccaccccaaaccaacaaggaaactggtagaaactacttgctgcattaccctgttctgtttccaacaaaggtgatgaggaagaacttctagttcagttctgtattaccagcatatagtcagagaatttctggtggattttagttttggtcctctaatagaatgtggagacttaaaagcctatattaacaagctgcatcatcttggacatttgtttagcctttgtttggcatccgtggcagggtttggacaaggtgaggaatggcagccacaggttaaacctattgggcatcttagtgcagtgctatgtacttttttaggccacagaccctttttagagaatctgattaaagctgcgaaccctctgcccagaaaactgctcatgtgcacaaactttcacatgatttcagggggttcttagaccgcaggatcccacagggaacccacagaccccaagttaaggatccttgttttaggggtttatagacagctttcaggggatatgaccccaggagtgaggaggagtgtcaccagaagttaagttttttttgttttgttttttgtttttgtttttttgagacggcgtttcgctcttgtccccaggctggagtgcagtggtgtgatcttggctcactgcaacctatgctttccgggttcaagtgatcctcctgcctcagactcccaagtagctgggattacaggcatgtgccaccacgcccggcaaatttttgtatttttggtagagacaggatttcaccatgttggccagggctggtctcgaactcctgagctcaagtgatccacccactttggcctcccaaagtgcatgattacaggcatgagccatggtgcccagcccagaagttaagttttaggaaaactgtctcctcacagaagttcagtgtagctgagtttatattcatggcctagccttgatttgaaattgtgtcagtaagtttttaaaaatccttgtcttgccctgatggtggaagactagttacggagctgtgatcttttacttccattcattactgaattaggaatccctgccagagattttctgccaaagtgacctcgagtttagaaaagggtttctgagtcctctctggacttactgtaggtcttaggaaagttcagtcggttataccccaaacacagttggtggagattgttttgttctgcctgtctctagcactggctaccagagctctcatgatgactgttgttagcagaggctacttgaaaccattccaggggaagctgttgccatagctaccttggctatgagagttaccattttctcttttttgttagcttgtgatttccctgatttttaaggttaacagctgatgttctgtttttctgccgagcagcaaggaaaatactggatttttgttgctgttgcttttgtcattgcttatgtttggttttatatgtttggaggtatgtgtgtgtgtgtgtgtgtgtgtgtgtgtgtgtgtgtgtgtgtgtgtgtgtgtgtgtgtgttttgtatataaggtaaagttacttcaaaagagaaatattgggagagcttgggaaaggccagatgagcatatacattttctgtattccaattttagattttgacctagtggtcaatttggtttacttttaacctaattttggactaatggctatagtcaggtagcctccgcagggggaaaaaacaaaacaaaacaaactagccgagctctatttcattcctgaaacccttagtagccaggatcgctgcgacctgggctgagtctgacccagactccagcactggggagcctgtggggagcagatggctgagtcaggctgaggttgctttatctcagcctgctctgcaaataaaggggtgaagccagcaggcagtacaaccacacctggtggcaccagcagtcctttccgggtttctgttcaaggctgtaaacacaacatttaacacacacctggggcaccaggtgcaggttaagcctacagagaggaaaaaaaacaaaaggatgacctgttaacaaaaatcaaagtgctacccctagtcctgcagccacctcttcgactgatcttatttttccccctccgataaaggacactattcttagcatttttcaattttctgatttgctcatcttagaaatgcttgtgaaattataaaaagaaaacacagtacccagtttatccatgctcagactgtttgtgatttggattatggccagttgattagtagctgtaagatgctggtggtgtctgcctgtcaggagcctgcggaaacatctgaattgtgacacaccgtcactggcagtatctcttagcccaccatgcgtctgtagggtggtgggcaccacccgtcctcactgtgcttgtaaacttagacctgtgcctctgctccccagatcaagatgaatgccatgctggagactcccgaactcccagccgtgtttgatggagtgaagctggctgcagtggctgctgtgctgtacgtgatcgtccggtgtttgaacctgaagagccccacagccccacctgacctctacttccaggactcggggctctcacgctttctgctcaagtcctgtcctcttctgaccaaagagtgagtagacctcatgccctctgtatgctcagctgctgatgtatttggctttgtgtgatgttcaaagaagaaacttctctcatcgtgtccttaaggcatcaatgggatatgacgtcactggtgttaaaatagccacagtctgattgcagtctagtgtttgaatcctggagggtaggagagaatcagatctctgttgcctgaaacattccttcctctacagtgtgatgtcattatccatgacagggactttgcagaaaatagtagtcatttttaggcagatatggaaaagttggacaatattctagtcctttaacgaatgctttgttgccagttctaggatggagaaactatcctcacccaaaataattaataagcaaaaaagcacagatccattagttgagtactctccatctgccttgttgaaaaatgtaccaagcattagctaagagaatgcacttaaagagagtgctttgtatgagtgaaccaggtttccctatagaagcccagatctgtatttttttttagatagagtcttgctcagtcactcaggctggagtacagtggcatgatctcgactcactgcaacctccacctcccgggttcaagcgattctggtgtctcagcctctggagtagctggaattacaggtgtgctccaccatgcccggctaatttttgtatttttagtagagacggggtttcgccatgttggccaggctggtcttgaactcctgacctcaagtgatctgcccgccttggcctcccaaagtgctgggattacaggcatgagccactgcaccttcctccagatctgtattttggaggcagcaggggcgggctctgcttctgacagaggaaactgtagttgtaaaatgaagggaatctgcactctgtgtcacacatactgttttcaagagatgcagtgttcactttttctctatagatgtcttctgaatgactgtgtcttcctccagggctcaggccaagcctcgtgcacagtgggtctgaattccccactccttttgtcatgctgcttcactcgctttgtgctttttcaagcttactccattctgcctgtgccttctcaggctgcagctactcagagagatgtcttcctcaagtgtgtccgttcagcacatgactaatgcagttgctaagacccagtggtggtagaagctcttccctgcatcctgatagcacctctcatcacctcttttggctgttggggacactgggtgaatgattctcttctaagagcagacaaataggcaatgaacatctgagagtctgggcccctgctttgtgtagttgtctagttaattttcacatgtactattatgtgctttaggtgttttgggtgtacatgggcggtattcttatgcagttttctcatagttgtgacagtgatgtcatgaccccaagtcaagagagagattgcgtaatagtggtggacactataaatgtcatcatactgaatttggaactgcccctgctgaggggactttttattacagtagcctccacagccaggcacaagagcaaggacatggtgttcttatatgcagtgtttgcagttaaaaatcagctctgtaaagggtgtgcacggtatatgttttgaaaatcatccagtatttgtcatagtcatattttgaatgtttctttttttctttcttttttttttgagacagagtctcactctgtcacccgggctggagtgcagtagcatgatctcagctcactgtaacctctgcttcccaggttcaagcgattctcctaccttagcctccccagtagctgggactacgtgccaccacgcccagctaatttttgtattttttggtagagacggggtttcaccatgttggccaggctggtcttgaactcctgacctcaggtaatctgccagcctcaaaagtgctgggattacaagcatgagccacggcgctcggcctgaattttttttaatacttaatttagatcaataacttcgactgttactgaaatttgcactcactttcagcttacagtttgggtaggactgctagacccagttcttttgtcatctcattcttagagagctcttgaaaaccaaagtatttaaaaccctgcaagtttctgtgcagatgagtgcaaatttccacccagcattggttcctgagtaattagaggaaggaagccatgcaaaagctgctattgcccaggctccagaaaaacatcatgtaaggtttgattccatactaattgttcaaagtgtaaaagaaagctgactgtggcagtttttacctccttttcttttttttccttttaaaaataatccagagacattaagcccaacagtttctctttgcttttttccctctctagcacattttcttgatgagtctaaggtgtgacctctactgaaatggctcccacccacctcctcctatggaagtggatccccagccccatctccttggacctcgtggctgtgtttagaaaattagcatcagcctaagccaggggcatcagcatggagccccctggtcattggctgattgccaccctctctcctggtgaagcccgaactagggagtggtggaggtcagcctaagttaaaggcaaacctgatgattgtttatgacttagctatggtttgaaggtgtatgtgaagggacaaattctccagaaccaatttccttccaaagcctctccctttgatgataggaccagccctcttagagcatgttggagcattacttaagcagctaaattctaaacacccgagcaatctgacttgaacatgacaaatgactaaagggcaaaaggattcactttattgcccccccatccttcaactcacctcttatttctgatttagattctaattttaggaatcactgtatcctgtgttcatgtctcatatcaccaaaatgttttcacattaccactctcttttgtccgcgttactactgcatttgaaatttgttgagtacctttcatagacgttatgccattcagtcttaccaaccttaaggttggattcatttttcctttcattttagggatgaggaaactgggagtagcagagagggaaactgaactcaaactggagtgtgacaccaggttggctgccttcctatctctggggaagtgaacagggacttttcttgggtacaagtgagagaactgaggcagaggccagcccctgatgatgacagcccctgggtgacctttgattcccatctgaccctctttctgtttctgtcactccactggaagctactgtcccccatagtctttttctgtgtcacatgactataacaacctcccatgtgttgaaagctaagggcaggaaacacgtctgttatgagggaaagtgcttctcctgggactttgaagatttttttcctacaaggaagcctgtctgcagccttcacaagcactcgcctaggctggaaagttctgttaactgatttacaacaagctgtgaatattagtcagtaatcctgaccgcgggtagctggttatgatgacatgcgcggaatcaggacgtgtcttcttactgttctggtatagaaaaaaagttgatgaaaggtgaacatcgaaagcatgctcgaggagcagggattactgttttccccctcagcattaaagtcaatttgaaaatctgttctaagatgatttacccaaagatacattataaattaatcttttaatgtctggaggaaaactttgcttcagtgggatgttatgtctcctgttctcttagaaacagatcaatatttacctagtgattcattttttgttctcatgaagtgtttacttttagtgaaacaagcagacgcccagttcggaattatgacaaaaatctagatagtcatacaaatctttttttttcaataaaaactttgatgcatattcatttttttaaatggaaaaggtagagcacacaaaaattatctataaatgttatagctctttcttttttcttttttgagacagagtctcactctgttgcctaggctggagtacagtggcgcaatctcaaatctcggttcactgcaacttctgcctcacgggttcaagtgattctcctacctcagcctcctgagtagctgggattacaggcgcatgccaccacacccagctaatttttgtatttttaatagagatggggtttcaccctgttggtcaggctggtcttgaactgttgacctcgtgatccgcccgcctcggccttccaaagtgctgcgattacaggcgtgagccaccacactggccctatagctcttttggaatttgtctaacaggtttttcagtttttagcagaaaacctcccacgtgaaaaaaaaaattataattctacccagagataatgcactattaatatgtgggcaatcatccctgtggttttccttctccttatacttgcccccacaaaatcacggtgatagatattgtttagtaacctgctttcaccaaaccatgatgaacgttgccatgaacattcacccatgctgctacctgtctactcacgtttgacttttttatagcttcagaattctgtcattcattcaaatttcctgatggctgctggcaacagttgggcagagaaagagctttgaattgaaatttgaactaggatgcaaacctaggtcttctacctctaaactggccacagaaccctggataaaatgatagcccctctggtccttggtttccttctatgtaaaatgaaataggtgtgtctcccatggtgcccttcagcacggacatcttctgattctggtacccttgctttgttagcaaacatcagagtggtctttttaggggaaggaccctgggagagggtccctgactgcagggtaaagagactggttttcttgtgtgcttgtcttcttctaactattcccagcccccgtactcctggacaggctggcactgtctccctttggcttttttttttttaagtactttttaaagctatcatttacatacagtaaaatatacaaatcttaagtatatagctcaggggctttgtgtatgtattcagctgtgtaactaccagtcccttgggtgtttacaaaagtgtactatgacctccctgcctctgacctacccatctgtcataatactactcgagttggcttcctcaagcaggccagcagccgaggcatgaacctacctgtccagcctcattactcacagcattctctcattgcctgtgaagtacctgacctttgggctgttgtttccccactatcccagatcccctcttttttctcagcaccaaaatgcctcttatcctataagaaaacttaaatagcatcaattctgcttttaagagacagagtctcactctgttgcccaggctggagtgcagtagtgcaatcgtaactcaccgtaacctcaaactcctgagctcaagctatcctcctgcctgtctcccaagtagctgggactacaggtgggcaccacaacacccagctaatttttaaaattttttttatagagacagagccccattatgttgcccagtctggtctcaaactcctggccttaagccatccttccaccttggcctcccaaagcgctgggatttcaggtgggagcccctgtgccctgccttaaatagcatcagttctgagatactattctctaacttgccgccctactcctctttagccagaatgagcccttcttccatcttcctaccatgtttccccaacatataacttctgtgtccgtttaaaatgttccatcttgttttatgagaatttgtgtctcttttctttatcactggaatatacaccccaaatcaagagccgcatacctggggagacagaacaggattcctggtggttccaaatctcaagtacaatgccattctgtatcttgttttccataaacaggtgtaagtgaacgatgttctcattttggcagacgccatgtgtgcctgcccaggagaaacaaactgcactgtatccggcttgttcaatggtgctctagggaatcaggtgtaccttcagctctgacagagctttgttgatctgggaaggctctaccctgtttctggaagaagatggattgcttatggtcttaaattaaggcaggacaaccccaggcatatgcataatggcagttcacagcctccacccttccctctgggcctggctgaagttttcatcaccaggtcccggttgggaagtagagacaggcagcaggtgccctgtctctggaagcctgctattaaaatgtacatactgccctgtgggaagccaggctgctgctttttcactcgttagcaagcttgccagtatgggctgtcttatagctaaagatgaaggcatttaggaggagtgtgatggaggacttggctaataggccgaaaaacagagagttgagttgtcttcactggatccaagagacatctagaagcccctgcagagtccagagaagggaggcagtatgatgaaaaccacagccacatgtatgtgggtactttcttccccagagatgcaaaggtaatcgctttcttctgcaaccagctgccacctgtattaaaaagaactggacattattgttctctgtggatttgagagacacctgaaacttaggggtgaggggcatacccactaacaccaagccaaaaattacagttggctctcctatgccatggtgccctctctggacgtgtccgcctggaagctgcttcaggtagtcataagagaatgggaggagccctgtggcccttccatagaccataatggattcatctccggtggttttccctttttctcttcactcaccggagtacaagctccaaacggaaatccaattggaatgctgttctcatcataatgtgtccaaacctttagtttcctgccaattagtcatccatcagccttggttagtgagcatttgaggatctacttctctgagactcatcgtggggaggcatttgtaaaagatcagtttttcaagctttttaattacggaagttttctagaggcactttttaaaaatcagtttcctcacaaatgtgcttcctagttatttctctttttttttctcctttctttctttctttcttttttttttttttttttttttgagacaatgtctcactctattacccaggttggagtacaatggcacaatcatggctcattgtagcctcaacctgctgggctcaagagatcctcccatctcagcctcacaagtgtctggaaccaaaggtccacaccaccatggctggctaatttttaaaaatatatttgtaaagacagggtctcacctgtgtcaccatgttgtacaagctggtcttaaacccctgggctagcgatcctccagcctcagcctcccaaagtgctggggttataggtgtgagccaccacacccagcccctaattatttctaataaagcagagcaaatctacttttgatttttctctcaaacagtaccaactccctctctattgctgttgtacatacttcttaacagtaaatatccatttttcttttatctgccccaaataagagctcagttctgtgtgtacgaacactatatttgtcatagatatgcaaaatatgctatttttgtcctagtgtaccaaggaagtattaaataattagaaatacactacagaaaagcactcattcaaatctctctgatagtgcaatatatggagttattttctggatctaaagagcacgggactccatatatgaaacggccacttcttccattttcttttctgcctacttgttataaagctgtttctttgcagaggcagtaccaatgcagaggctggggttaggagctttgagatggacagttgttgttttctcaatcttaaagcatcaggcaaatgcaacttcacacactctcttccagtcagattgccaccctaggcccctcctaggtaaaaaaaattctggaaccagcacagcttatttatttatagcaagttaaagctgaaaagaatttcattatctttgacttaaatttctcttaattccctcttgctcacagacattccacatcagatttagatcctttccttcttggctgaacactaaagctttgtccttttcacaggataaattcctaattgccaagagccttaattccatcgacctgattttatctgttttaagagttgtgcagactgggcatgggggctcatgcctgtaatgccagcactttgggaggctgaggtgggtggatcacgaggtcaagagatcaagaccatcctggctaacatggtgaaaccccgtttctactaaaaatacaaaaattagggctgggcgcggtggctaacacctgtaatcccagcactttgggaggccaaggcaggcggatcacctgaggtcaggagttcgagaccagcctggccaacatggtgaaaccccgtctctactaaaaatacaaaaattggccgggcatggtggcaggtgcctgtaatcccagctaatcgggaggctgaggcaggagaattgcttgaacccaggaggtggaggttgcagtgagctgagatcgtgccattgcactccagccttggggacaagagtgagactttgtctcaaaaaaaaaaaaaccagttagttgggcatggtggcacatgcctgtagtcccagctactgaggaggctgaggcagaagaatcacttgaacctgtgaggcagaggttgcagtgagccgacattgcgccactgcactccagcctggcgacagagggagactccatgtcaaaaaaaaaaaaagagttgtgcaaatatttctttggatatttctggtaaactattaacaagtgattggcagaactgtagtgttctgatgtgcttattttgtagccaccagaccttcagagcatattcacctgcaaacttatattgttagaaaattcctgaaaaatggaagactcaaaatcatcttgattgaggctaaatattaagggctagcctcaataagtcaaacttttaggcaatttcatcttaaaattgctcatgtttctggtgaaatagcccaaaccaaaactgtcaaagtaagaaagttaaactgctgactctgggacactcttttattacttggctgaccaaacattccagtttgctcaggactggggcatgggactgtcagtactaataccggggaattccagggcaaacagggataagttgttcaccctctcaactactcactatcttggatgttgcctgcctgccctgtctctgctgtagcaggtcatttatgcaaggggccagccacatcaggaagaaaagtgccgccatctttgaggtctcctatattgaatcaagatcaccaagtctgagtctgctgcagaattcatccaccttctctaacctagatacagattgtagcttcttcttagagactttatgccttcttataggaattgccgaagcctgaaagatctaaaaaaaggttcggaatccaaaatagtcaagactcccgtgatttagttcagatggaaaaaggctcatcctttatgtgccgagcattctttaaaacaaccaattctggtttccaaaaatgtatgacccttataccgccctattcatcatacctgagtttactcttcagggccctactatgtctccaaaaaaggagtatatgtcttccaaaaggaagtatatgctacaactgattccatcacgtggtatcaaattcagtacatgtggacggtaagtgggccttggctccacgtgtaaggtcctgttttgagtcacccctctgtgtcaccccttcccagactcgatttcagaatccaccttggttcaccattcatccttaacttttagcttacacctcatttgctttacaggacttacatggaatcagatctacttttatactccttctcaatgtgtggttgactgaaaattgctccactatccgggagcaggaaatggaccttgttttctagaaagtctcgaatttctaaggatagccaacttttatcagcctctcatgttttactgaccctgtgaattcagaggttgccaattttgatctccactgttctttttctctgcctgcttctcagcatgccctccttcactatgatagtacactttgtactacaaaatagtatatactttatggtaaaataaaattaagacagtaaactgacttggaaaatatattctggagggtaagtaagaatttttcctaaactctcagtgccagtgtcatgcagtgatgtggagagtgaagagctgacggctgtttacgcttttctttgtctgaagcaacagtgagtgaagtgactggctttagaagcccagtcttcttcagcagcatcaagaatacttccctgcaaatggagtctgtttgggatcctgagctttagggtcagaatttattagatggtgtaatgtttacttaaggaaagcattttcctgagtttataaggaaatctacccctccatgaaattctagaaagctataactaatacagaaggctgtagtccttgaagacttgattttatgcatgattggatgagatgccattgctgtttgctaccccatgactgtcagtagtcagactgagaagtgccctctaccaagtaccaagggccgggtactcctcagaggccctccatctgcctgaggtagctgcctgcagtgtagtatcacggtgagccatggaaatgagtcagccattgtggcagcttgtgaaccaccctaactctacctgctgtcagtttctaatcatagagtgagggctctgggtcagcgtgggtgcatggcatcaaaccagatggcttaacttctgaggtagccattataagagtctgtaatccaaaacatttgggaaccctgcctggagatcagtggttgatccagaaccatctgtagcctcccaggaagggagagatttgtgagaaacagcaggttatatgtttttctacccttccactgagtactaatgccattgccatgaccaacctgactttcctgtgatatgtagcaccaaatcctcctgctggcaagaccctgaactggtgttttcagccagatcacaaaagcttgaacagtaatttcttactgatgtaaagtgagaaactccataaatgctttttaaaatgttgacacctgccaagccacagcagtatggacttttccttccttgggatttgaataaaggaagattcttctcagtgaatatatatatatacatatatatatatacacatatatatatatatatatgtatattttaaaaattagtcaattagtaatatttagtaacctgctcttccagtctgttcaccgtctgtacaccatactcagccccttctatatcacacacaatactttttctcacatttccaccttctctgtctgtcagaatcctcaggccttctcaaatcgtagctcttctagtagctcctgacttttacctgtctctgtctcattggctcttacctaaggacagggatggaaacaataactttccacatatgtatctctcgtcacacctcaagtgtattctgagaggcttaaggacagagactgtcttaaaaattctctgtcttccctgtggttgctgcttcttgtagagtcagtacacactaacttcagtagagtcttttggtaggaacatgtgattgacagagtgagtaattcaggtaagtgataaaggaatttagagaaagaggggatattcctgtggtggcttgactgatgaggtcttccataatcctgaaagattagttggctttggatagatgggacaataggagagaaggcacagatgttggtgtgagcatgaaccagtaaaatcaattatttaaacaagcactcatggcagaaaactggctttgctgcccaggccaacacttttcacccatccacctttgtccttttgtcctgtgggccttccaaccagtcagcaggataagaaggtggtagaggccttgctgccattgacacatatccacgttgtcaatgctttgccgtcaccacagctactctattcttgtctcctaattccatggatcttcatttggctagactttgattgtctctcttgtaactcccaaaaatgatcttggtgctgcttgcatcatgtttggccctgctacccagtctgccctttgctcactgtgccctttgattttgtttgctaatgggttttgggccccatcactggtctggtctctatagttgcttcgtggccagctcctcaccaggtccctatgccacgatctggtgagctgagagctgtttgattgtagcagagagccctatggtctgtgggggggaggaagaggagatcagatcacgaggagtctctaattcccagagaggaagagtttgggcttgatcctgtgagcactggtggtaggtggttggaaagggaaggatgggacaaattccagaggtcttctaaggtggaatcagtggtattggtgggtaatggaatggccttgggcatcagaggaaagggctgaatcacagattatgctgaggttactgagcggttgagagaatagaatcattgacagaaatagggaagtctaatggggaagctgctttctcaaggaaagttgtttagcttggggcttgtccacaggatgtgcacagggttatgtgcaattatggcattagaacttaggtgggagctcaagaccagatgtgtagattccagatcagctgcaggtaggggaggttgtgggggtgggcagagagagacactaaagactgatggctgaggcaggccatggctagggtggaagagacagagacaggcagtaagaaaggtagggagagaaccagcagcctccagttccatggcagccagagaaggaaaacattgaagagggtgtcagaaactcaggaagaatgagggctgaccaaaggccatctaccttggccagaaaggatcagggatttttgagaatgtgttttcaggagtgaggtgaataaacaggtcagcacaatagcaaccaaagaagtgagtcaggaaacaaacaccagagaaggaaggagaaaaaatggaaactggaggagaaagccaaattgattgaaggtttttcccctaagattgagagggtaaatccaggggcccaagtgagagggtgaagttagcgagctgttgccccccgggaatccagagtccagatcagcagtgagacccacctgggctcagatgccagccctgccccctgctggccagtggcttcaccttgccgagcttctatttcctcatttgtaagatgggtataatagcacttatttcataggttcagtatgctgattaaaaaaaaaaaaagaacagcatgtaagatgatttataggatacttggcatgtgtaagagttcagtaaatatagctgctattattgtagctatttttattttaatattatcagctagatcagttgtacaaatagcaaaagacataatgtacacgaaggtcacacaagcacacctgaatgtcagtaggacatcagtgggtaagtgggtaaaagatgtgcctagataaattccacataaggaaatacatgtaataagcacctcataatgttaagacttggtaacaatgaagccttaaaacatgaaatattatttgatattcagaggaaaatatggcaatattgtcaaaattatattaagttggacatcgtattagtcgaagtaaactagtttatactgtggtaactaattacctctaaacctgcacatcttaaagccacaaatgtttatttctcactcatgctacgtgtttatttcaatgggcaggagggctctgctgattgtcatcccaccaggaccccagctgatggaggtgacatctcaacacctgcttccgtggtcatcaccgagccaggaagagcaatgtcacacctcacacactggctcttacaggctgctaccggaaatggcacttggtcatttcctttcccatttcattggtttgggtgtccaagggagataatacagtcatgggttctcagtttctgtttctggttggtccggtaaagccccttcctcatccctgttttttgcttatcactagagacagaaactacaaaccatggctttaggctgctaaaagcctacaaaagaaacagaacaataacaacaaaataaggcaggttggacaagcttgagagcttgtccagcccatagcccacagactgcatgtggcctgggacagctttgattgcagcccaacacaaattcataaactttcttaaaatattatgagattttttgtgtgattttctttttcttttagtccatcagctgtcattagtgttagtgtattttatgtgtggcccaagacaattcttccaaagtggcccagggaagccaaaacattagacacccctggtttaaagcaaggctcgtgcccatgcctaacttgagaagcagcacacctgtgtccagagaagaggagaataatcatggccacaggcagcagcctgtgtcacgtgggcctccttccttctgtccttcactccatctctccttcagtgcctctgcttcactgcaggacgtcatcagctttcacctggaagaatgcaatagctttccctccattctctaccctttctaattgatcttgcaggccaccaaattatcttcctaaagcacaaattcatcatgccatgcccctgctttaaaccaagtggctcctcactgtctgtagggcgaggtccagcatcagccctcgctccttcttccctatattccttgtgttctagacacatcagatctctccacattttctcatactgcatgttctctcttgactatgtcttacatttgcaatgccttctacctggaatcccttcatacctccacacagcctctttatttgagagaacataatcaccttctttctgatgaatgctttctggacatttatggttctcttctctgttgtctgatagcatctggtgtggccttgggatctaggacccagcagagaggtgaaggggcaggatgggaagcccttccagaggggaacaggcacagggactcctcagtggtgtgtccaagaaaaagcaaaactggtttctgactattgagagactaacaggtcccctagagtctggagacaaattgatgattggcacatagaaaactaagctgatgaggaaatgataaaagtgataacttgagggaaaataaaaaatttcacaaaaaagaatacaacatatgacttctttgtggctaatatttccataattataattttataaacactgaaaattaaccataagtgttgctgtaacagtgttgaaaagaatgggcgaggggaaaatgtaagtcttaggagagacgtaagagagctagcaccctccagagtaggaagttcaataggtgctattgaaaactgaaattgaagaaccagcataagcaggataagcatggcattaagaaataaaggcaagtgtgggatggtagggacgactaaaggagttaagaatagtcatctctcaggggcaggagtcaggagacagatgaggcatcctgttggactttttaaacaggagttgaaaaacatgaaaaaaaaattcaagaaagatgaaaacaaaatatgtaaagatgttttgctggcattgtttattatagtaaaaactgggaatagcagcatccaacaatggaggcagcagcaagataatgcaggggaaagaaagagctgtcgggtcagacacacacagagttcaaatgcagggtccgctgtgcagtaggctgttggacactcagtttctgtctgtaaagggggtcctaataataagaatcgctgtaagggacaaattgaattatgtaacatgcccatagaaggggctaaataaatgtttgctccctcccttaactatagctaataaacaggatagaattttatgcagacgttcagaacttagcatactaattatctataaaaatagagaataagtgaaaaaagcagaagacaattatatatctctatctgagcaccattgttgtaactatgtaaatactctgctttcagatagatatagatgaaaaggaaacaaaaatgagaatatttttgcaaggcttgtgaggatatgggtgatttttaagcttctaatttcttatagctatttcaaattgatatgaaattaagaggactctgaatatgcatttcatctttcatagttttgaaagccattatcttgttcattcctaataataagcagtgacaccagcactgtcctttgcatttgtcctttatatgtaaagagagatggactttgctttagtaggactttctagaacatgcttatctgcatggtttggtggcgctctctcactttgtggacaagatgaaggtctggtgcctaagctggggtttctcaaggatggagttgttgaccatctgagaaaatgttttcctgtgcccacataccgtaggggagggctgccatttcaacagggctaacccacagccatcaacagtggcttctatcagctttttgtaactgttcctctgacggaaagctccagggcagctgcatcatttccttcctcttacatttgtgctcaaggctcaccctggtcaagaagcctggctgcatttcccagaggttcttttatcagccagtagaacctatgaccttgtaccctccgtgttgcccttgctgtcagtcggctcttgtttatccttccatcttttctttgtgaaatatcactcagagatttgtccataggagtgctgaaagagcttcctccatttatgtcttgactgcttcgtattccataaaaaaatagtttgtttaaccagtctcctagatagaggtttcctttatttgtaatcttttgctttcacaatgttgcattgaatgcttctgtattttcatcacgatgcgcacctgtcagtataggataaactcctagaggtggaactactgggtcaaaggggatgtgcatggaaaattttgctagctgttgtcctcaagcctctccacaccagcactgtgagcacatttccccaaaacgttgccaacatcaggagttctactttttgatatttgccaatctggtaggtgaaaaatgttttctcactgtggttttaattagtctttctttgattaaagagactgtgtatcttttcatattttagaactctttttatttccttttctgttcactgcctgttggtggcctctaaccatttttctgatggtcattggtctttttcctaatcatttgagggagctctttatgtactagggaaattagccctttgtgatatgaattgcaaatatttgttctcagtttgtcatttgtcttttgactttgcccatagtggtatttgccatgcataattttttttttttttttttttgagacagagtctcgctctgtcacccaggctagagtgcagtggcgtgatctcggctcactgcaagctccgcctcctgggttcacaccattctcctgcctcagcctcctgagtagctgggactacgggtgcctgccaccacgaccggctaattttttttgtatttttagtagagacggggtttcaccatgttagccaggatggcctcgatctcctgacctcgtgatcctcccgcctcagcctcccagagtgctgggattacaggcgtgagccacggcgcccggccgcataattttttttaatgtttgcataattaaatttttcaattgtttcttttgtggcttctgggatttctggtttccttagaaaggtcttcttcactgcaagattatttttaaaagcctagaatttcttctagcatatgaatgatttcatttttattttgaaatgtttcatccttccagaatttatcctggtgtgaggtgtggctccaacataatttttttcaagacggctacactttgtccaacactattaaacaatccatctttaccccattattcaaatgccacctttttcaccaactaaatttcctggatgtatttaggcatatttccagtcttttgtgttctgttgatggtcctgaacatataccatcagcagattgcagctttgtactatgttttgctgtgggcagtggggcgatgctcataccccagcactgcttgttttcatacttttcttggctattatagctggttcatttttccaaatgaactttagaatgcttgtttaattccacatataaaaatcttattatttttattgtgtatctcttaagtttataggtaatttagggaaaattgacatgtttgtgatgccaagttttccagtgcaagttcatttattcaagtctttgagcccgaaagagcattataaagttttcttatctccttttcttgattgtgaactccctgggagcaagaatggggtcaagttttgagtatggcttattagtaatgatctatataattactgacaaaagaaacataattttcattaaatatttgtagaacctactttttcctaacatcattgcttgccattttatgagttgttttctgcacatcaaagaaaggcaagatgtagtacaaatgctgatgtcaaatgtcagcattttaatccttaaagtcatctcttgattggtgtgttctttctttatttatttttaataaaaaattgtatttgcttagaagcattcagaatgtcaacaaaatggctacaactttttcttttttttttttttttttgcaattacagagtggtattcacttaacaacagtcattttatataagctgcatcagagacaactgaagatgaaaaaactaccatccccatatataactaatttgtgccatgcactaacaagaacctgcttttaatttccatgccagtttacaatccccatactgtactaggcaaggttggtggctattgaaaataccaccaggacagggatatctaaagacacatttggtagtgtgttaactatacaaaaaaaaaaagacattgtacagtttaaaaacaaatcttacacagccttacatttcagtttttttctttaaaaggagtgagttatgtacaggttaaatgctttatagacgagaaaaaaaactacactagaaccaacttattcatcatcatcttcatcttcctcctcctcattcttatcctcttcatcttcctcatcttcctcctcttccttctttttcttgcttttttcagccttgacaactccctttttttgctgcagcaggctttcctttagcccgatatgcagcaatatccttttcttacttttccttcagcttcgcagccttctttttataaggctgcctgtcatctgcagcaatgttattccacatctctcccagtttctttgcaacatcattagtggacaggccagatgttctcctttgatatttgggcgatactcagaacagaacagaacaggacagaacagaacaggaagaaggccgaaggaggcctcttgggtgcactgggatcctttaacttttttttttttcttttgagatggagtttcccttttgttgcccaggctggagtgcaatggcgcaatctcagctcactgcaacctctgcctcccaggttcaagcgattcttttgcctcagcctcccgagtagctgggattacagacgcccgccaccatgcctggcaatttttttttttttttcagtagagacgggctttcactgtcttggccaggctggcctcgaactcctgaccttaggtgatctacccgcctcagcctcccaaagtgctgagattacaggcgtgagccaccacacccagcctgaacgtcttttttgtctcccctttaggaaagatacaggttttcgtttctctttcgtatgggccctgtctgcctttgccatatcttcgaattttcctttctgtttagtaggcatggtcttccacctctctgagcacttcttagaaaactctgaggagttgactgaagcatctggatgtttgttcttatgtgcctccctacaagtttgcacaaaaaatgcatatgatggcattttctctcttggcttcttagggtctcctttgcccatgtttagttatttttcctcagcaaggcacagaattgcccagtgcccatctggctctcacttgccccagtgctatctctatggagctcattgtactgcaatggctgtgatatcgggagccaggtgcagcctcctcactctctccgctctataacattgctctccagccagcgcagctcctagttgattagcgtgttcttaaaagagcattctgtgtaggtaatccaggggcttcacatttaggtatttgagttttcctccactaggaatagtggcaaatataatgtgattttccagctctaatcttccctccccataacgctggcacagattttgaggtagccttggcctgggaagtagccaaaaggcactgtgttggacaaagagcagaccattggcatctatgtgcatgtcctcaggagagaggtgactaggcagatggggacaagacacgggtgctctgtgttctgagcgtcagcgtacatcctgtttggttagcacagagtgagtctgggaactttgcacttagcaccttggcagcccaggtctgggaatagtggtgccttctcctaaagttaggtcactaatctttgactggctgtttgcaggaccagttctctaacggatccagggttccagtggaaccctggagactggaactctggagcttcttaataaactgcctccctacttaaagcatggtgtcaaaaccaggttgaaatgcaacgtgaggagagaggactgtgctttggtgtgcctagggaggatgtgaccagttccgcgtgctgtttgtgaacaggaagatagtgggatcagatgcatttaacatgtggatacagttctgaggggttttaactggttttctttgaactttagaaaagcacatttatttttccttggagcaaaaaagtagtttctttttaagtggttttattgtaactcatggggctgttctcctaacattcatattttatagtttgcacgatatgcacaaaggtcacagatgtaccagcctggcccagtggcctccgtcctgtatttagaaaccagttcgggaacggaagaggattgctcttttgtttcctcaggccacttttggtcatttcaggcagaaacagtctctgcattggaattttcctgtgcagatcctgcaattcaggaatagagcatttagcaacaacagtgaaaatgtaatgtgtgacagctgtggagaagaatttgcctccagtgaggggaaaatgctgtgttcaaagtggatttctgatgagcctattaatgggtgtttgggaagctgaatatgttgctgccattttgagatgaaaggcccaaggtgtttgttcctgaagctaatgaggaagccctttcccagcctcagccttacctccccagtaggactggtgagatgtgcacacagggtctactccacatctggccctcctgaaaagaagggcttccagtgggggctgtgtcctagtggagaagggtgaagcccagtgggatgggctcacgaaggacctgctgttgacctgctggcttcaggtccaccaggctaggggtagataggccagaaaagaaaccagaggtgtctgtggtaggagcagcaagggccctggcttccaggcctgtggagcagggaggctctggcagttcaggatctggaaaagaactgacaaaatgttctcctaaactctggcccttgccggcttccttacctttcctgtgtgcacacacatgcatgcacatgcacatgtgcacacacaggaaggcctggaactcagtttgcagactcgtggagctgccacaaagcttcactcccagtgtttcccccaccactgatgcttgtcctcctgggtttattctcacccatgaaagtagggtaaaaatgtatccccaaatcaaacacctgtcacctttctagaagcacttccatcctctcttgctctcactgtcatcgctctcctggatctttggggagatattcagtatgattttgttaacattctggccttatcttagagataattaaatgtgaatattcaaattaattagcccccagatgtatcttctgcagaaaaaaactcctctaacaagaagtcagttacagttgtgagaaacatgcaaaacgaaagaaatgttttttttcaaagacctgtgaagaccactgtagagaagctccaacaaattcagttttcaatttgaagaaacattatttaatatagaacattttgacagttgatcagacaggagaaaataggcacaaagctgttattttaacttctggttgggggagttgatgagtcttgagtgtgataaagtaaggaacgctttggactgaatcagagacctgtcctctaatcctagctttttttttttctttttttttcctcatttttaaaacggggaagacaccattgctcagaattgtgaagattaagctagaaggccgggcaggatggctcacttctataattccagcactgtgggaggctgaggtgggaggattgcttgagcccgggagatcaagaccagccctggcgacatagcaagaccctgtctctacaaaaaaaaattaactgggcatggtggcatgtgcctgtggtcccagctactcaggcggctgagatgggaggattgcttgagcatgggaggttaaagctgcagtgagccgtagttgtaccactgcactccagcctgggtgacagagtaagaccttgtctctaaaaataagtaaataaataaactagagacatgactcacccagctcctgatggagagatttggtgctcagaaatatctctcctctctgagatcttggtactccccatgatgcactaagtgaaattggtacttctcagcctcatgattgtctccccatagtatcatcctattctatctctctgaccccattgcccaccgctcctgtctgtgacagtagctgcctgtgtattcatcatgcatcctaccttcagattacgaatgccaccagggcggtcactgtgtccggctctaatctctgtatgcctcacagcactcgtatttgttgaattttattaaatcaatatataagagccaaaataaaatataggtagaggcaggttcggacctgataacatctttggtttggccccaggtgccagcagcacactcctagttgggcatcctcagtccatgttgtcactctgaaaacaaatctgtttgtcagagtaaaggtcacctttttttctcagtggacaaatatttttttctgaaatgaaaaatttgcttttcttcccttgagtgtgtgcactcaagtaagcagagtggagggcctgtgaagatgggcattctctctggaaactgaggaaacatcccgagcctatgtctcctaacagtcttggcacctaactagaatctgaccggagtttcagcacgcagccagcagaggacatcaccagccatttgagtgtgcagttgtctggagcagccacgcagcaggtctctgtagccctgatggagagagttttcttcttgggagggcttcccaggatgatgtaacacctctgcgttttgcctcagtggctgaagagtccctttggacttgggttttgcagaaagagaggggagtctgagggcagagtgtaaagtgacacagccggtgtgtagagctgagcagcctgtgttaggaacagtcagagcctgtggacttgtgaggcttccactcacgtgctatgttagcagttcttttcctcaagctctactgaaagacctgtggacctgacattttatggtcacaagccctggagaagatagccattcattttgctggatgaccttttaaataaacctctagagtaagttccaggcaaatactggaggtggctgtgtttgcccaacagaatccagcaaaaacacttctctgtgcttgaaattccttcttgtacctgatgctttggaatttaggcaggtgataaattaaagatgaatttcttctttttttttaacgttacaatatagttagctattatcttgatatgctttctaatatataatggagttacatatgtacatttaacttatgcaaattcaactctacagattgagagagagacccccacacacacacagacacacacatacacacaccaccttatttgtgctgacccttctgccagcttctccattcaaaggagcacaggccccccctgtgtgtgatctgggagcctcacgtcacctctgctggtaccagggcctgtgtgtctctcctgcgagagagagcaccttactgtatcttcacgtttaaagatgtgtttttgttttccatttcctttgtttcacaacatggccttaacctcaagccaccagtgccatctgtgcttatccacagccccagccatcttcgtggcactgagggagaactgcctggctccctttgcccagagacagtgtgttactaagggatgctcagggcataactttattatagttaatagtttagtttcacttttttttttttgttggacagagtcttactctgtcacccatgctggagtgcagtggcccgatcataactcactgcagccttgacctcctgggctcaagtgatcctcttaactcagcctcccaaatagctgggaccacaggcatgtgccaccacacccagctaattaattaattaattaattaattttttggtatagatgaggtcttcctatgtcacccaggctggtctcaaactcctggcctcaagcagtcctcccacttggcctcccaaattgctgggattacaggcatgagccaccacacccagcctgacagtttcgccttttaacttgagaaccaagctgcgggcgacatgtgaccccactataaaaacagaacggccaggcactgtggctcacacctgttaatcccagcactttggaaggccgaggtgggcagatctcttgaggtaaggacttcaagaccagcctggccaacatggtgaaatcccatctctgctaaaaatacaaaaattagccaggcatggtggcgtgcgcctgtaaccccagctacccaggaggctgaggtgcgagaatcgcttgaacccgggagatggaggctgcagtgagcagagatcacgccactgcactccagcctgggcaactctgtctcaaaaaaaaaagttaaagcaggaagaggggaagagggagttactcctgagtgatccccctttgttgtgactagtgttgtttagtacttgcctgagccccagaacttggtctctttaccctttctcctgtttagtgccagcttctggcttggaagcccacgttgaccagctcctcaataaacagatttctatcaggaatatctaccagggttctccgtgttgctgaaaagcccctagttcaagataacctttaaaatggccagcatcagaatatatacatgctaatttgatatatttttaaaggtagaggttggctgttgacgactccagatatgtttggtctcatcacattggttctagataactaatatttttaaaggatgactaatagactcataggagtctctagaatgaaagcatctgtctgtccttatcatgtttgttttatcatccaaataagccctggacgcagtggccaaggccccagttgaagtctcaaccctgctcttgactagcagtgtgaatgtggccaagccatgaactccctagcctcaggatccctgtggtaaagtggggttaacagtatctgcccatttcacaaaattgtcattgaaggcaaatgagatcattttaaaaaggactttgaaaaactatgaagtgctgtatagataaataaaatagcagttttatttattatgccgtgttcaaagaaaaaaggtaaataaattcttgatgctagaaccactgagattagtacctcaaacatccttgacttcctttgttaaagagcttggggggacatccttaatgtttctgaagttgcaaagggagaggccccaggtttcactccgggtgacataatttctttgctgtagtaagattccagtggcatttgccttagcatgtatctcgttcttgcagctaaattagagcacggtaactatttcctctcattcctttttaatctgtgaaatcatgagccttactcttgccttgttaaggaggagaagccagactactcagaggacccccacggagctcctcagcaagtggcctgcccagccttcccctccacagcccctgagccatcaccacatttgggatcttcttctccacccagttccttacttttcagctcatatcgtcacatttattggtctcaagtctcttgtcttgggttgggctgggaaggaggaacatgcaggaacggaataccagtcggattctagcctcctgcgttcccattgaatgcaggaggggttgaacccagtgacattttgaatataaatattttcatcagagttaggctaacattaaagaatttttctttgggaaaatattttctaaaacaaagtctgctgagccaattcgattccatgatgagtttttttttaatacaatacagttaaattttatcttcatcagggttgttttccatttaaatttactacaaagactggagtcattaatcgtttttttgtccgtgtcatatattatgaccatagcttctgctatagcaagttctcttgcggctgttagttccaccaagtccaattctctaagttcaattttacaggtctaaatgtttttatgaaaactagattcttctgtcaatttttagacaatcccagtattcaatttaccacatgcagttttaactattgccagttttattatcagttgattctttgaacgaaccactgggagataaacaggagactgatagtatatatttatcaactaattcattttttaaaaaaagtgtggccaagtgcggtggctcacgcctgtaatcccagcactttgggaggccgaggcgggtggatcacctgaggtcgggagttcaagaccagcctgaccaacatggagaaaccccgtctgtactaaaaatacaaaattagctgggcatagtggtgcatgcctgtaatcccagctacatgggaggcttaggcaggagaatcgcttgaacccaggaggcggaggttgcagtgagccgaaattgcaccgagctgagattgcgccattgcactccagcctgggcaataagagcaaaactccatctcaaaacaaaaaaaaaaaaatgtgattaattttagacatagagatgaaaatagagatagagtagaaggaaatggcctcaagtcaaaaggggatgttcaagatcattagtcataaaggaaatgcacatcaaaaccaccaagagatgccacttcacacccactaggatagctatagtaatttcttttcaatggacaacagcaactgttggtgaggatatggagaaattgggactcttgtatgttcctgattgggaatataaaatggtacagctgctgtgggaaaaagtttggagtatccccaaaaagttaaacatagaattgccatatgacccagaaattccacttctgggacacaacccagagaattgaaaacagatgttcaaacaaaagcctgtacataaatgctcacagcagtgctattcacaatagccaaaaattggaaaccatccaatgtcttttttctttttttttgagatacggtctcactctgtcgcccaggctttagtgtagtggcacaatctcagctcactgcaacctccgcctcctgggttcaagcaattctcctgcctcagcctcccgagtagctggaattacaggtgtgtgccaccatgcctggctaattttgtatttttagtagggatggggtttcaccatgttgaccaggctggtctcaaactcctgacctcaagtgatctgcctgccttggcctcccaaagtgctggggttacaggcgtgagccaccacaccgggcctaccattcagtgtctataactgatgaaaaaataaacaaaatgtggtatattcatacaatgaaatactattcagccgtaaaaaggaatgaattactgataacatgttgcagcatggatgactctcaaaacattatgctaagtgaaaaatcccaagacaaaaggtcacatgttgataattctgttgataagaaatatacagaatatgtcaacctacagagacagagagcagattagtggttgccagggaatgggagacggagaaaatgggaagtgactgcttcatgcatacaggctttccttttgcagtgatgaaatattctggaactagatagaggtgatgagtgcccaatattttgaatgtattaaatgctactgaattgtagactttaaaatgttatatgtattttacctcaaaaaagtcgtggggacaaagtgatgaattcaaaatgtgttactgtgctttaagaccagtaaagatcattgaccaggagtcttagaaactctactttcctagatgtcttcttgaaaaaacaactccagtaggccgggcacagtggctcacacctgtaatcccagcactttgggaggccaaggcaggcagatcacttgaggtcatgagtttgagaccagcctggccaacatggtgaaactccatctctactaaaaatatgaaattagccaggcgtggtggcaggtgcctgtaatcccagctactccagaggctgaagcagcagaatcacttgaacccaggaggtgaaggttgcagtgagccgagatggtgccattgcactccagcctgggctacagagtgagactccattgcaaaaacgaaacaaaacaaaacaaaaaaacacttcagcccttttgtgtgctcagatttgcttttagaaaatggatgcatggagagaagaaaacaacatttaaggagattacctgtttctcctgtttcttatgtacattgtgttgcaggtaaagcagatgctcaaataaatacatttgagaagtatgtgaaatgccaagagttggggacagggacagaaagatgagccttcagaagaactagatgggaacatgatggtttaatgtgggccgtggggtatcagggcagtaaagaagcctcttgaatcaaagacaagcccagctcaaaacctttcaggggacgtctgtccccttctggctgcctagcattcattcttcctttctaagggcatacaaatttccccttggggaagttcttctctcccactgcatgcaggtaataaatcaaagtgtgtcgcccacccactctgaaattgaaggcatcccttttagttgccgtactcctgggacattgacctttgagtagggtggggggacactggtactaatggtgtaaaaagcacatccctggaacagccccctggtttctttcttggatcctgccctcatttcacgcctggttctccagcctcttttccatttagtaggcaccccagtgtccttctgtgtactcctttcttaagttagtcagagttgggttttgttgctttaagcaatgcatcctatctgacagaaacttcaaatgctgaggagtagctgctgatgggcattttgttcactggaaaggacttgctgcaacttgctgagatgtgaggactcaatctcaggcaacatatcctaaacatctagtgtgtgccaagtcctgtgctaatttggtagagaagtacaagggagaatcaaaggaaataacagtgaagtctgagtttaatcactagctataaaatagtttgatttacagccaaggaacttaggtaccataaggaagaactggtcacccactggtttaaggcaaagatgagcatcagtcaactttattttttcaactctctttttaaaacaccagctgtccgtgcctatgtgagcttcatctgctcaaagacgtacgtgtgtgtgtgtgtgtgtgtgtgtgtgtgtgtgtgtgtgtgtgtacgtatgtatatggggggtgggagggagatccagacccttgtggtctttcccactgaccaattctcttagtaagccagatgtcgattataaataggctcagaagataaggacaggctggcctctatattttgttgtggcccagcttgtttgttagtaacaaacatttattaaccgctggccacggcacaacattggccacaataccataaggattagtaaagaagtagaagagactgtttctactttcagggagttaagggtaaaacatgcccagatgcttcaactcaagaatagctttaaaaaatacagacagaaagacatgcaaattagcgtagtaaaaatggaatattctgtaaaacatgaagaaagcaatgaaattttactataggatttaatggagagatgtaccatgtttttggatgggacacatcagtattgtaaaggtgtcaattatctcctaggtaatatatatttgtcgtgtttccaatcaaaaatctaaaatttttatagaactaaacaagctaatcctataattaatctggaaaataaaatgctgaaatctgccaagaaaattttgaaaaataacaaaggcagcctgcgctatcaactatcaaagtatctcataaagctatattaattaaagcagtgtcatactggcatatgcatagacaaatagatcaataaactagaatacaaagtatagaaccaaatctaaatatttaattgagaacttggtgtatattaaagatgtccactgaaagtagggaaacgataggccattcattgtgcaaggacaatgagctagtctgtcagaaaaaaatgaattatatcttcccttcacatcattttataaaagtaagtggatttaaggttaatacattttttaaaactatagaagtaatagaaggaaacattgggaattatgtttataattgggtattgcatagctctttttttttttttttttttttgagacagagtctcgctctttcgcccaggctggagtgcagtggcgcgatctctgctcactgcaagctccgcctcccaggtttacgccattctcctgcctcagcctcccaagtagctgggattacaggtgcccgccaccacgcccggctaattttttgtattttcagtagagacggggtttcaccgtgttagccaggatggtctcgatctcctgacctcgtgatccgcctgcctcggcctcccaaagtgctgggattacaggcgtgagccactgcgcccggctgcatagctctttttaaaacaaaatgcaaaacacaaaggttttaacaaaacacaacaaaatctattgtatattttaactttatcttgttatataaccataaaagatacttttaactataaaagatatttttataactataaaagatatttttaaccataaaagattaaaaactagggccgggcacagtggctcacgcctgtaatgccagcactttgggaggccgagaggctgaagtgggctgatcacctgaggccaggagttcaagaccagcctggccaacatggtaaaaccccatctctactaagaatacaaaaatcagccgggcgtgatgacatgcgtgcctgtaatctgagcttctagggaggctgaggcaagagaatctgttggacccgggaggcagaggtagcagtgagccgagatcgctccactgcactccagcctaggtgacagagtgagactccgtctcaaaaaaaaaaaaaaaaaaaaaaactacataaaataaagttaaaatatacaatagattggagaaaacatttgtaacatatgatagataatggcttaatgtagggataataaaacaatacttataaatcaatagaaaaatagacaaaggatatcaacagacagttcacagaagagaaatacaaatgactagtaaacatgaatcagcgaaatgcaaattcaaacaagcaactttttttcaaccatagattgggtcaaccttaaacacaagttgaaacaagatacccatttttttgcccatcaaagtggccagaatgtaaaagattaataatgccaattattaatgagggtgaggaagacaggtactttccttcgttattggtgggaatgtaaatgaacccatcttttttagaaggcaacttggcagtatctacaaaatgtaaaacgcacatacctctcagttccatcacagtgccttctgtatgccctctcatcaggcttacaaggaggagagtgcaaaagcagccatatctcctaagggccaggcctaaattggcatggcagtccttctgccaccttctgtaagcccagagaagccacaggccagtccagatcacaaggagggaatctagctcccggcagaagaatggaataagtggaattattggccgctacattttcgaactaccacatagatagaaaaagcatattccttcgtgtaccattttagcagcatttcttcagtatttatatgtttatataaatttcaaaatattctattgttttagtccatatttccttcctgacctaaaccatgtgactgggcacctattcagttttttgtttttaaatttttttcttgtggtctgtggataagttatataaacaaacaactacacattgaaccccaccatagtaaatgcagtctaaaaattcaattttgtaaaccctggtgttgtattattatgaagttaattaaaaacagtgttttatcagtaggtattgtcataaaattaaaccttttgagacttccactgtgtataattgatcttacattgaactgagaaagtcccaagtgattgtgaggcaattgatccctaacacacacacacacacacacacacacactcacactgagaattactgcaccccactctgagaatggggtgttaggtaggctggaaagaggacagtcgcctaacgccaatcatgtaatagctgaattcacattattatggcacatattatttttaaatatatttttgtatattttaaaaacatatatttgtccttttagatttactaagtgtctctatattctgttcattgaagcaaatctcccccaggtgtgtaatgtatgtccagtgctctggggatagagctagaggtgaatgagcagcaggaggggttggcttgaaaacagcatctaaagtaatcaagtcacctggatgttaggacggagctgtgcatggagaaggggcaacccccccagcaacctgactggaagtgagtcttgaaagacaagtagtaggtggcccaaagaaacgctgggtgtgaaagagcattccagtcaaaggagacagcttgagcaaagactcctcagataaaagtagttcaacaccacgtgtacctgttctggctggagttgggcctggtagtttaggtttatttgagcttaggcaagaagttaagcgagtaccagggtgtagccggcctcctaggccaagtgaggacccatgcagtggagggtgggggccaggcttgtgtgttgagatcacccctccattggcgggtggatgatggagtaggtggtgagagcaagactagaggcttggaggccgcttggggggctgctgccaagattttgaggaggggacctgactctaaactgggaatgtggcatcaggacagtcacatgtgtcatcattaaatgtgaaatctgtgactagacaaaaagaaattttacttcattcttttgttctattttctgagattatattgtattctaaacatgatcagaaggtaggcatatgaaatttactcattcttctgatatttttaagctcagcatatttccacttttaatttataaacaaaattttctttaaactttcctccaggagtgatcaaaagcttaatttcttggatagtcctcttcctctatgcaaaacttattatctaacttggtagtctgaaatcctttataagttctgtatctagatcttgtatagtgtttggttgtccaattgacatttttataagcttgctttttgttactgtcataatccactcagctcttataaatgccttcgcctgccttccaaatgccatggcttttgcagtgatatttgcacctgtggtgttacgctggcaagtggcttcatgtccttaaggtcttaaaatactctttcccctcctcccctcccccgaaaaggaagcttgtctgggaactggtttgcttaaggtgatagcttcacttctcttaactttgtgtagatttgattaattacacacacatacaaggagtaaatcaaagatgggttttggggatcatctggttctgagagaaatgataggcaagtaggttaaggtaaattattaataaaacactcaccactgccatataatacagaggggaatgattgacgtcactatcattttatattatacgactccagtttatataggagacaaatcctggacaaccatcaagcttgggctaaaagccatggaagtgaaaccaacagcggtttcagtaaatgcagtcaccttgtactgtggttgtaaaccataatcatttcttagttgtaacttggatcatcttcttttcctggtaattaactatttgtgatttttgcatttcctaccaacgcctagagtcactctgtgtttttacaatgcaccgttgttagcgaggcttcatgccttgcgtaggctaacaagcctttatccttaatcaatccaacaaatatttacactgcactgcccttacagcatattctctggagcatagagtagtgccctcaccccacaaggcacttacaggctcttagaagaatttgcagcccttcccagcactaactgagagtagcaggtttggctaatggagtaaccactacagctgtggcctgtctcgttagggaaagaagaagtgagcttttagtgagtgtaggcgctatgctatttcatatacatcagctcctttaataatgagctaacctgtcaagttagaatgtgttcaaaatatatcacttgctttctttttattctatattatggaaataagccatgttgaattacttaacagttaccctaaattgaaatcctctttatatatatgtcctggttgatttctaaagctaatctgatgcagagtgtattagtaaatggggaaaggcggtaaatcatggcacggatgtaacgtaataaaagcctcatgtttatgctttgtgtgcagaatttccctggaacaaaaataggttgaaagagttttgctaaaagatttttcagaacgttgctcaaggaatgtagagaaaattgacctcccttgtcctttctttagatacattccaccgttgatctgggggaaaagtggacacatccagacagccttgtatgggaagatgggaagggtgaggtcgccacatccttatgggcaccggaagttcatcactatgtctgatggagccacttctacattcgacctcttcgagcccttggctgagcactgtgttggaggtgagctgctttagattgtgtgattgagccatcactcagagaaggagcactagtcagtggagagcacagcagtgtgaatacttgtgccactgactctgcccatggcatcaggggctgttgggaagcctgctgggattcgtcacttaggagcagcctgcaaaggttagcttcagcgtatgtttgccagtcaccatgtaaagctcttcagaactcattgtagaatagttttttttttttttttgagacggagtctcgctgtgtcgcccaggctggagtgcggtggcacgatctcggctcactgcaagctccgcctcccaggttcactccattcgcctgcctcagcctcccgagtagctgggactacaggcgccagccaccacgctcggctaattttttttttgtatttttagtagagacgggttttaactgtgttagccaggatggtctcgatctcctgacctcgtgatctgcctgcctcggcctcccaaagtgctgggattacaggcgtgagccaccgcccccagccgtagaataggttttaatcctgttgtgaaatacagaagcttgatgtacggggatgagggagtgcttggagcccaggcaccccaggaccaggcctctgggttgatgacagcaacagaggccagaccattctcagtgcttcgtgtatactgttatctcatttaatcctcaaatagcgctgtgaggctggtatttactatccctactttactgatgaggaaactgaagctcggagatgcagtataggctggcgtttgttggatagcagtagattaaaaggctcccaggttccctttgcttaggtttccctggacaaatagacacattgaggtcatatctatcatgcagtggtctaggacacctatttctgagagataactgaaattttcattgctgctggaatttggcattgttctgtctagcctatacaaatagcattcattctaaaatgcttcataatgaagacttttgaggaagtggagttactacaagcatccttttgaatgctattgctaccaaaagagaacatgtcttttgcattctatagtattcaaaagcaacttattttttgttttttttaaataggaactcagtagttatttatgggtaaattccagtaaacatattaggtatttaaagtggctagaactgctgagtagctggtgacaaagatttaattgatattccctctgcctggaatgctggtccccagaccttcacatggctgcctcctccttgtcattcaggtctcagctcagatgtcatctcctcagagggactgtctctgactcccctaactagtgtttccttctcagtaaatccatcacgacttcctgctttagttcttcgtggtagcttctactctcgaaacctatttgtgtgcttgtgtattatttatctgctagaatgtaggaatccccagagccccgaatagctggcttctaataaacagccatggaagagatgaatacatgaataggtgaggagttcacactgtgtttataaatctgtagctggtttttccaatagttatttattcaccatacccagttaaatgttttctttcccttatttctaatgctttttcttcttctaccactaaagcacaaagtttagtttgaccatctgctcttcctaccaggaccaacatggaaagttgaaaagggcagaagagtgattcttccttgtacttgctcatgtttttccatcactcctgcccccagaaatgactgacaaaggtgcttctagggaaggcagtatttgtacctaagatgtactttaagaaaaacagctctttttcaccttttctgattttttttctgactataaaagaagtactgattttagaaaatatgaataatacatttaaaaaataagaatcacccataattttgtcacccaacatatattattaacgttttgttccattttcttacagttctatgcattgtttttccaaaatctgaattatcatatgtgatattataaagactttcccatgtattaaaactctaaaagtcttcaaaaacacaattttaataattgcttaatattctacaatgtggtcatattataattaaaccattcttctatggttgggcatttaacttatttacaactttgtgattatcaataattatatcatccttcatcagaaaattttaggcaggatttcaagaattggaatttactaggtcgaagcttataaattttataaagagatggagtcttgctgtgttgccctgtttagaggtacagtgactgtttacagatacggtcattgtgatctacagccttgaactactgggctcaaacgatcctcctgcctcagcctcgcaaatggttggaatacagacgtgtgccactacatccaacagtttacaaaatttttaaggttctttatgcatattggaaaattgcttactaattcacatttccctaccagcattaagaatttctaaattttaaaaatcttaatttgaagaaaaattatgatcaaatttaatgacctaagcacctcttttcttttaaagaaaagtatgtattcatatttttaagtaggcaagtcacattcatgatagaaagttcacaaggtactaacagtatacagtgaaagtatctctctctctgtcctctactctccatccctacccctgctcagtggtacccactctcaaggttcttgtgtgtgattccaagatagtggatgcatttgtaaatatagatatcttttttttctccacacaaaaggcagcattattataacccccttctgcatttagcattttttcacttaatttatggaagagcttgccacatgagtgtatataaagatgtctcattatttttaagggcttcataatatttcatcacttagatatgcaataatttatccaaccagacccctatttctgggcatttagattgtgttcagccatatgcaaaagaatatgtattgcatgattgaacacaacctaatgcatatatattgttttacatatgtacaattacatctgtcggataaataactgaaagtaaaattgctgggtcaaagaggtctgtgcaaacaccactttttatcttctcattcattcattcatatagaatttcttacagaaattaagagtaatgttcaggaacttctatagcaatgtgacagagtaattttatatttgttgaatcttatagtagaaaattgaggtttgtatatttttcatttcatttttccagtaattaacttctattgtcttttcaaaagtatctgttcatgacttactggacattttcaaaacaaacccttcactataaatagcttgagaagcactgatatagacagctccagctagaagggaaaaattcttccccagagaactgagtgaaagatgtatgttgaattccctccccttgttttctagaccagtgaagtgtaattatgtccatttatcatgtcacatttcttggatacatcaggatctctttctctacgctatagatgatatcaccatggtcatctgccctggaattgccaatcacagcgagaagcaatacatccgcactttcgttgactacgcccagaaaaatggctatcggtgcgccgtgctgaaccacctgggtgccctgcccaacattgaattgacctcgccacgcatgttcacctatggtaagcatggctaagtggagtcctccctttttctgcaagtgtgctactacttctgcttctgccttgttttttctttttttaagttttaaacctatgcccatctgcaagagatggtaggtcacacggttatatcaacagccaacttgtactgggcattgatgatgccatgcctcacaccagcctttgagatgggcactataaccaccctcacagaggcagaaactgaagcttacaggggaaagtcttgcccaaggtcccctagctagtaagagtcacagcagggctgggagccaggtagatcgggtagcagagctcatgaccttcaggactgtgctgttctgatgctcgttcctcaggactcttgtgactgacaggcaagggtgtgatgaggcatgtgaatgtcagtgggaagggagcctggcacagtagcaactcactggattttaggttcctggggaacaggaactagatctcgtctttcgacgaatgcttcttgatttgaattaaaattttgtgttagctgggccagttgtggtggctcatgcctgtaatcccttctctagtaattaatttttattgtctttttttttttttttttttttttgagacagagtcttgctctgtcacccaggctggagtgcagtggcacgatcctggctcactgcaggctccgcctcctgagttcactctgttttcctgcctcagcctcccaagtagctgggactacaggtgcccgccaccacgcctggctaatttttttgtatttttagtagagacagggtttcaccatgttagccaggatggtctcgatctcctgacctcgtgatctgcccacctcggcctcccgaagtgctgggattacaggcatgagccaccgcgccccgcctttttattgtctttttcaaaagcatctgttcatgacttactggacattttcaaaaccaacccctcaccataaatagtgcactttaggaggctgaggcaggtggatcacttgaggtcagaagttcaagacaagcctggcaatcatggcaaaaccctgtctctactaaaaatacaaaaattagctggcacacgcctgtaatcccagctattcaggaggctgaggcacgaggatcacttgaacccgggaggcagaggtcatgccactacactccagcctgggcaacagagcaagactctgtctgaaaaaaaaaaaaaatcctgttttagctaaggttctggcttctggactgcttgttcttgattcttattagctctctctttagattatatatgtatacataaacaataaacacataaaatatgcatctgtatatgcacaaatatttgggatgttataagcaaataaattgtaatatgttttaatgggaaataactaaaaattatatctatcatctcaccataactataattttctatttcttccaactacccttctgtctttatcaatgtctacatagtttttatttattgcagtcatagcatgtatatctatggtgatttatttaaataactctatattcaccaacataaagatgtttaatctgtttaagagccacattgctgttactactctgttatagtttatttaaccatttatctttgtaggacatatgaattatttaaagtttttcagcattttaaataacaatgctgtaaatactgtgtcttgtacatagaattattttctcttgaatgaccttggagtaaatgcccagtaaaattgcagagtcaacatttttttatgcatatttgtacatcttgtcagattgacctccagcaaggtcattccaattacgttgccactggtaacatgcaagggcactgtctcctataagggcaggtaagggaaggtcacaggtatggaagcatgaacaggtatacctgctttgtgccaagcagggtgttgggtgccctgagttcatttcctcttctgtattcacacccacagctgaagatacccattttacagactccgttctgttcagcagtttggtcagtagcttgaaaatataggtgaatttggccgagcgcagtagctcaagcctgtaatcccagcactttgggaggccaaggcaggcagatcacgaggtcaggagatggagaccatcctggctaacatggtgaaaccccatctctactaaaaatacgaaaaagtagccgggcgtggtggcgggcacctgtagtcccagctactcgggaggctgaggcaggagaatggcgtgaacctgggaggtggagcttgcagtgagctgagatcgcgccactgcactccagccttggtgacagagtgagactccatctcaaaaaattaaaaaaaataaataaataggtgaatgtccagatttacagatagcacaggcacagggtgaatagtgagtatgtgggagacagaattggacccaaaagtcagaaataggccaaatcaaacacaaagaaaacaatggggaataatggtaatgtcctgtgcttggatatatagattgtctatacaagtagaagatggggaggcatggcttggctgcagggccaggatggagatttgggagcactaacagtacagtgtgaacacttactgtgtgccagtgggaacacttaatgtgcaccagacacagtactgatgtcacatgtaggcacaatctcttttatctccacagcaacccatgggaccgtaaaattctgatgaaaaaactgaggcatagagaggttaagtgatttgggcaagggcacagagccagtaagtagaagagctaagagaggagcctggatctggctgccggaatcatctcagagatagcagagtaactgggtctgtatagtctaggcctcccagctccagagtgctgtactgttggggctgtaggccaaagagaccagattggaaggcgttaccacaccaggtcaggggagaccagcagctgaagagcagagaagaataggttaagtgcaggccttgctcccagagagtacctgggtcaggagacaggctctggatccgatgccccagcactgccactgatgctgtgtggctcgagcagtttcttaaactcagttccagattcttcagctgcagtaaggtggagctacaattaaatgtgggttactgaggacttggtaggcagttgattacatatagtaaacatttattgtatgttaggttcattctttttgttttgttttgttttgtttttttgaggcagagtctcactctgtcacccaggagggagtgaagtagtgcaatcatggctcattgaagcctcaacctcccagactcaagccagcttcccacctcattttttaattttttgtagagacaaggtctcactatgttgtccaggctggtctcgaactcctgagctcaagtgatccacccacttcgccctcccaaagtgctgggattacagatgtgagccaccgtgccagccaggtttattcttattcaaatacttgaaggtatattcatgttggtgagagattaaccgtgctgtttgtgacccagataaataagatgtgttctgccagggagatgtgagtgtcgttaaagaattacaatacaacgccgggcacggtggctcatgcctgtaatcccagcactttgggaggctgaggtggacagattacctgaggtcaggagtttgagagcagcctggccaacatggtgaaaccctgtgtctactacaaacacaaaaattagccaggcatggtggcaggcacctgtaatcccagctacttgggagcctgaggcaggagaatcacttgaacccaggaggcggaggttgcagtgagccgagatcacaccactgcacttcagcctgggcaacagagcgagactccatctcaaaaaaaaaggaattacaatacagtgtgatgagtggactaacacagcgggcctggtgaatgtgctgcagcagcatggagaaaccagcctcgatctatgggcgaggagtcaagttgtgggaggaagaattctcccaggaaaggcatttgagctgggttctcaaagatgagctcctaaacagaggcactcatgaacagttggagtttgtagacaggggagtgcgctatggaagggcaacccatgcagaagagcagcattcacagctgccttaagagcactgtatgtttggactgaggagctgcctgtgagcatgaaaaacccttggagatgaggtgaatccatcaggggagagcttcaggcccccaattttgaaaattaactatctccttcaatttgtggatggtgttgttacattttatttcatcagaattttagaagtaaatttctgtagtttattatactttagaaatgttctagaaagacaggtgacctagaaaaaaaatgggtgtcttcttctagccatactatttgtttttttgtgtgtatcagtacatgttttacttgttaataatttcttttaaccattggaggataagctcaaacaaataggaccttaaaaaggtcagaaatccagaatttggatgctttgttgaaatgtaaaaattaaaacatctttcgtagcttcaaagagcctagagagagaaagcgctagtgtttcgttaggtgctattgatgtaattttagtttaaaataaagtttttaataaatgttttcctgggctggtggaaaaggagcaatccttcaccaaaggtggcctaacacgttagagcaaagcccgtgtttgttacttttgactggttaattgaggcaggtccacagttaacatgctagaactggaaaccttttatcatagttaatcatatcctcatgtaagtgtgttagttgttgatgtgtgggctttctatactttagtacaaagatctttgtcaacttttgtttctacacccagtactgttctcaatttttaattattgttgccttgcaatatggcctgatatctgatggtaccaaccctgactcatggctatttcagagtatgctcttgtctgcctacctgttttttttttttcttttttcatttgaaccaaagaattattgtgtccagttccatgttgagtttttgtcttattagtcaagatggactagattatgctgtggaaacaacttggatctcagtggtttaaagcaatgatttctgtccatactatccatccattatggcttagctgaggggcctctgtgtctccatcattatggtcctcactcaaggaaccaggcccatggagcagctacctgctggaacattgcagagggtaggaagagtgtggctcttgaagcttctcctcagaaatgacagaggtcactcctggtcacactttattggtcaaagtacagtacacgaccaagcctaacttcagtggggtgggggagaagcatccttcctagagatggaaagtagttattggtggtgaactctcgcacagtttatcacaatttctgaaggggaactttaatttataaattaatgtggaaaaatttataatacttacttttctcatccaggagcatgaccttttccttcaagtcttcctttatttctacctaaaagaactcctagttctctttgtgtaggtcagtttgttgtcaacactagaatttcccatgggagcttttaaaagatacctgtgccagtggcttagctctccgggagtctaaggtatagccaaggtttttcagagccacagatacaggttttactccttgttccctcattagttttatttttgcttttttactttttattacagacatttcaaaatatgcagaagtagggagaatagtagaataaaccccagtgtaccctttacccaacctcaacaattgttcaactcatggcccatcttgtttcctttactcccttctggcatcccctctcaaagattattttgttttattttaatttaattaatttatttattttctgagacactgtctcactctgttgccgaggctggagtgcaatggtgcaatctcagctcactgcaacctctgcctcccaggttcaagtgattctcctgcctcagcctccctagtagctgggattataagcacccgccaccacacccagctaatttttgtatatttagtagagacagggtttcaccatgttggccagactggtgtcgaactcctgaccttaggtgatccgcccacctcggcctcccaaagtgctgggattacaggcgtgagccactgcacccagcttcaaagattattttgaagcaagccccagacagcctgtccagtttcatctgtgactatttccagtgtgcatcactaagatacacaggctctttgtaaactgtcttcatttgttaggactgcaatatccaaataccacagtgggcgtggcttatacaagagcaatttattttctcaccgttctggggcctagaagtcccagatcagggtgtcagcagggttggtttcttctgagacctctcttcctggcttgtaaatgactgttttcttgctgtggattcacactacagtcacctgtgtctctggtatctctctgtgtcctaatctcttcttaaaaggacaccagtcatcctgaattagggcccaccctaacaaccacattttggcttaattacatctttaaaagccttatctccaaatatagtcacattctgaggtaccgggggttacgagttcagcatatgaatcttgggagagacactattcagcccataacataacagaagcacaatggcatcatcacaacggaaacacttaaaacagtactcctcaagagcaattcaatttccccattgtcttcctgctttttttcccattttaattcttttgttcaatttaagatccaagtcaggtccatatattgcaattggctgataggtctcttatgccacttttcgatctccttccacgcatttttaataggtccccaaccaagtaagcctcttccaggtggggtcactggatgtgacattggaggagctctctggatccccaggacatactgcagtccaccatcaggccccctattcccaccctgagtgtatggaaattccaggcactgaactccagtgcctgctaatcccaggactgcccaggttctgtttggaaggcccttctgtggtcttcacttggcttctctttgtcactcaggtctcaaccaagatgtcaccctctcagagagcccttccttgactcctctccctcatctaaagctcccccccaaccccagtcattatctaatgcccctccttactttcttcaagccacttaagatttgaaattaaggatttgttttcataacctgtgaaattatttgtttatatggctatcatctgtctctccatcccagaagttcactccatgagagcaggcagttttcgcactccctgctgtagttccccagtgtctagaatcctgcttggaccctagaaagcattcactgcatcagtgtttactgaatgcctactgagatgggaactgacagtttgtgactgtaaaatgatactttacaaactagtacatcccaaaccattgtgccctatatgtgagtcttcccttaggcacattgcctctcttttgagcagatgccaggcattcaagtcactgtgaataccctttgggctttttgcaactgtgatcttgaccagaagaaaactaaagagggcattaacatgaaactctatattcttcttttgctgttatgcacctgcctcagatttctctgagaaaattataaaggatcttttcccatttatcaacccaactctgttccaaaccacataagctttgctaatgtgattagaaattgttgaaaacagatctgccttgcacagaatttcctaaatggataattaagcattcttgtgacttagaacccttcgtgctgcctttgaaagataaattcattaaggaaaattcttcatgacagcagttaccatttatctcactctaatgagtgccaggcatgtgctttcacgttacttcacttgatccttactgcctcagaggtaggttttaattagtatccccacttcacaggcttagggaggttaagtaccttgacctgagtcatgtgactagtgagtggcagaaccagccttcaatcaatgtgattcttaaccctaacttaataccacctctgtggtagtgttcatttcctatttaggatactgttcattagaatacagaggagcaggtgtgatgtttgagtatttaaaaagacattttccccactttggtggtagtggtcattactgttctgatagctgtcacttacatagcatttgctgtgtgccaggcactgttgtgaatactttgtaggatatattaaatcagtcacaccccttttacaggtgaggaaactgaggcccgacaaggatgactgacttgctctaaatcacagagttaatgagtgggcagcccaggcttcaaacacaggcagtctcgcagtctagtcctagaatccgtgctcctgaacaacaggctccattgcctctccatgtaagagactaaggagtgaggaaatagttcccagtcagatacattttaggcttaaggcaaaagagcatccaagagcatctcagagccacagaattggacctgtgggtttggtctttgatcttttgttcagccagcatcctccagacaatgatggggccagcctctgcgatgggaatacaggtgtggattcgagtccctgccttcaggaagatcccagtctatgaggaactctcaccatctagttggggaaggagggtgcacagtcacagtcggtctaagcttattggctaggtttgtccaaaaggaatatttaccaacagcaaccttttcacagacagggaccagatctgcatttctaatttttatattattgtgtgttaatctcctccatctagtgtatcacttagagagagatggtcaggaaaggcctgcagcgggagagaacctgtgctttatagtccaacagctgaaggtttgactgcctggtcgagaaagctgagaaagactgttaagaaatttggcaataagtcccagcatggtggctcacacctgtaatcccagcactttgggacgcccaggctggcagatcacttgagcccaggagtttgagaccagcctgatagaacatggtgaaacctcatctctactaaaaatgaaaaaagccaggtgtgatgatacacacctgtaatctcagctacctgggaggcaaaggcaggagaatcgcttgagcccaggagtgcagtgagccaagattacgccactgcactccagcctagacgacagagactgaccctgtctttaaaaaaaaaaaaatggcaataatataaaagtgcatggcatagagtccagcaaataccagtaaacaataacgattatcatcttcattggcccttcactctaactttgtgttttctgtgagccaccttagaggagaaaaggtaaacatttacttgaactgttaaatgaccttacctctgcatccagttcatacagttgacctcatgtgaactttggaatttctgcaaggacgagtttaagaacctgctcgtgttgagcataaaattcttccttctttgagctcagtctgagttacagctctgtgtacagggatgtcggctgtggtgattattctgcagtatgcaatgcttgctttccagctggacaaccttcagtattggcctcttggccaaatctgtttgggccacacgcctccagctcaaagccactggcttctatatacagagccagcccttaaaatcagtactggaaagagtttttactgtagtacatgctacattttaaccttctaaaaaatgttttttttttttaaaaaaattcctcacacttaacttttgtatagttcataaattctttaaactggaaaatactaaatatgtctcttttgataaagacattagctaacctgagtaaaaataaatgtgaagaacacctacaagagtaaagtttaccaaactgtcttaaatttcttattgtgccaagcgaggtggcatgcacttgtaatctcagctactcaggagactaaggcaggaggatagcttgagggtaggagttcaagaccagctgggcaacatagcaagtccttgtctctaaaaaaaaaaaatttttttaactaatagggtactctactgggtcaggccaggtaaacaaccctgtcatgtgggtgaggtcaataacacttggaaatcaaggaagatgaagaagtcatgaagattttcttgaagtgtatttattataaagagcctaatctttaatcgaggcactgcagcagtagacatgttggcttactctttattgacttaattgaccttctaaactaaacaatgtttggaatgtgagtgtttttgtcagtgattctgtaggggcccagtgaattcaggcagcattctgcttcttctgtctctctttggccgagtgccttatcccaacagtccagtattcatgttcagagcaaagaagaggtagatcaaatccactagccaaagaataaactgaaaaccagaattttccagcttgtgcttattctggcctccatatcataccttcatatcttgaaagttttatcaccagaaaatcaagagccaagtaacaaaggatcttattagtttgatcttgatttaaagagagaaaaaaataggattaaaaacaatatcttctatgtcaagtgaaaggaataaaaataacctggctctggctccccaaaggtaacgagtcccttaggatcatgagccttctaagaacttagtacccatctcccaccaaaacaccaagctggggcatttggcattgaaaatggcctcgaatatttaaattgcttttttcctgtgagtttaaacagggaagaagtgggcccttcccttatttctaaactcttgactctcgggcattagacatcaagctgtgaggaagtacgtgaaatcacagcattgaattctcttgctgggaggaggaaatctttaatgtccaactgggtttaatacaggaacttttttgttttttaaactatcttttggattaaggctgcagtgaaccgtgatcatgccactgcactccagcctgggtgacagagtgagaccctgtctcaaaaacaaaacaaaaattatctcttgggctgggtacagtggctcacacctttaatcacagtgagacctcatttctacaaaaaataaaaataaattagctgggcatggtggctcatgtctgtagtcccggctactctagaagcgctgtgcccaggagttcaaggctacactgagctgtgatcatgccactgcacagcctgagctacagagtgagaccctatctcttaaaacaaacaaacatatatacaaacaatcttttggaacctcaaggtaaggtcagaaaacttggtcttgcttagaggacgggacttcagtcttagaagggagggagaccccatctccctccatctaattacacattccaattgagacacttttgagagtaaaaagggactttattaataacgttataataattcataactttattaataactgcatcagaacaatacattccaggaccctcttggagagactaggatgtagggttacctacctttagcatgctgtagagatcacccatgatccaagacatctcactgtaagagcttcaggcagtgatttttaaggaacttctattttgtttttactgcttaatatcttacaatcttctattagatcataaacataggtgtttcgataagcttctcatatctaccattttcattggtgtagactcaattttgaattgtattcatagttatgaattgtgttgcctctgcattaaacagttgagttttataatggcagaagggcacaatgggaagggaggaggaagagatgggtgaagggagagagagaatgtgaaagtgaaggtagtgagtttgcagaactcagacatcgtagtaaaacacctggcaagatcgtctgctgagagccaggggccaggagcttcaggaagtgtgtcagggagtcatatccaaagcagaacagtggccaagagtggtgagttctgcactttcaggatgatatctgaatacttaaacctttagccataagagggcagttttaggcatcctatacctggggaaacaaggctgaaaacactcattttttaaaatccttatttcagagataagggcaaggccaactaatttgatagcacaaaggggccttaactttatttctacagctattgtattcctggatgactcagctttaagatagtttccccttgactttaagaaatgactcacatacttttactatggaagtgacaggggctgctaggcccctaaccgcccacctgtcagcgagccatgttagcttaactgtatttttctcttaggctaaacttagtgggaaagatattcaagtacctctttcatgtcccctgcttactcatgctggcgagtactgtgtgcctttattccagacgattcaaacttccttcttatccacctgacattttgtggcatatccacagatgccatgcatgggcctggcatggaacatacagagatgactcagagtctccatccacaaggaacaccaagtctcgagtccctgtattttagcctatttagtcatgctagtgtcatttggggaagtggctgttgaaataatagctttcaggcagcctttgccttgtccttctttaggtgtaggggcttgagaaaaaggtgaggggtcttttctgttcccagcaagttgcctttccaaaatggccgtgcaatactcatctgtctaaggcccagctagtgtttcagatttcatcttactttaaaaagcggcagcaagattatatagttacctagtgctaatcccataagaattaaatacatagagcctcatttaaaaacagattaatgtagctgttagtaataacaggccagggagaggccccaggcactaaaggtgtttggtaactgacatcaggggaggtcccaggaggaccttccagaaggctgatcctggagctgggcaccatgtctttgcccttcccttgcatgggagaggtggcatctcttcacagaacatccagcagtctgtctgacatcaggcagggttggccctttatccagatcagatgtgtttggatttaattaaattgaggctcccaaagtgcctacacaattagctgtaattgctcctcagtagtgtagcaaatctgagttttgtaactgtcccaatgacatctgaacatctgctctaggtctcaaataattagtctcaaacctgagtaatgatagatgggtctaaaaggaatcaaagctgggtgcagtggctcacacctgtaatctcagcactttgggaaaggaagccaaggtgggcagacctcttgagctcagaagttcgagaccagcctgggcaacatagtggaacctcccaggcaagttcgcccatctctacaaaaaatcagaaattagctgggtttggtggcatgtgcctatagtcccagctactcaagaggctaaggtggaaggacgtcttgagcttggggaggtcaaggctgcagtgagccatgatcatgccactgtactccagcctagggagacagagcgagaccgtctcaaaaaaataagaataaaaataataaaaggaatcaaatggttggggggagtaagatgtttaataattgaagcataaatctctggagtactattacctaagtagatttgtgatataaggcaaggggcttgggctttggggttgacatggtccaaagtctagcgttggactttgagtagacacggtcatgagtagacatggccctactcattatgtgagggtggacaagtcatttcatgtctttaaatctgcttccttgtctgtgtttaagttcctagaagagaggctgaacactgtacatctgttgtttcatccattcatttaggtaacactgattgagtgcccaccaagtatctggcctcacagatacagtggtgaacaagagcaagaatatctttgcttcatggagtttataatctaatagagtctcattcaatgttggaaccaaacataaagatatagttagctaagagatgacaaaattaggcagaaaccttaggaagcggtggagaagtaaatatttaataacaatttaaaataagtttctcagtactatttcttaggcaggcaaataatgtccccagcacaaaccattgctccagcatgagtgatatgttgggtgtctttagcattgtcgaaactggcctgaggaaatgtaaacatctttttttcccttatttttttgctagattttaaaactggttagattcatatttaaaaagaaataaatacacatgagaaaaacagtcaaactgtgccaaaggctacatacaatgagtgaaactagatctttttcctaccctagacccccagtttttctccccaggaaatcaatatctgctgcaatttcccagtgaatattcagtcagatatgtgtgtatgtaatcccttaaaacccaagcaaacacgggagagggtgccagccccactgtttcaccccttgtttttatcccttaagatggctcagagccattccatgtcagatcagattctttttttttttttttttttttttttttttttttggagacggggtctcactctgtcactcagactggagtgtagtggcacaatcttggctcactgcaacctcccttcccaggctcaagcgattctcccacctcagcctcccaagtagctgggactacaggcacgtgtcaccactgcctggataatttttgtatttttagcagagacagggtttcaccatgttggccaggctggtcttgaactcctgaactcaaatgatccacccgcctcagcctcccaaagtgctgggattacaagcatcagccaccgcgcccggccagattcatcctttttcaccacagtgtagtccttcatttaaccagtcctctactgatggaaatttaggttgtttccaaacctttgctgctacaaacaccaaaatgctgcagtgaacattcttgcatgtacatgtttacatacatatgcagtataaagtccccaaaggcagaattactagaccaaaggtttgtactttaaaaaacatgaacagatgttaccacattgccttccaaggcctataccaatgtgtactccctcaacagtggatggaccagagggcctgttacccacacttcttccagtcctgggtattggcaaacttcatcttttctaacatgggcagtggaaaatgatttctaagtgtcattttaacttgcatctatttaacaatgagtgacatgaagcatcttttcgagctgcacttttaaaagacaaaagaggccgggcgcggtggctcacacctgtaatcccagcactttgggaggccgaggggggcggatcacaaggtcaggagttcaagaccagcctggccaacatggtgaagccccgcctctactaaaaatacaaaaattagcccggcgtggtggtgggcgcctgtaatcccagctactcacgaggctgaggcaggagaatcgtttgaacccgggaggcagaggttgcagtgagtcaagatcgcaccactgcactccagcctgggcaacgagcaaaactccatctccaaaagaaaaaagaaaagatttcatccagcttttctgtcaactaggacaatggttctcaaagtgtggtctctggaccaacaacgtcagcatcacctgagaacttgttagaaaagcaacttctcagcccacccagaccagtggaatcagaatctctggaggtgaggtcctgcaagctcattgagccccttgagtttctgattccgtgggtttggggtgaggtccaagaatgtgcatttgaaccagttcccaggcaatgctgatgctgcttgctcaggggccacactctgagaaccactgagctagagcatcattcttgcagtaatatataacctccgtgcagcttttccaattcactctttacaagaaagattaccagaaagcagttacatggatttaaaggcatttaaattttctgtttgttaggtattagtggatctacaggaagcgcctggttgtgttgaacggcgatgtgctacctgtggaaaccttgctttgaggaaatgtttggaaaactgctaccaggctaagcttccgaaaggctaagcagcgcccccatctgtgaaggttgtttactgcaagtagaaaggaaagggagtctgaaaaggggtggcccagagatgagagagtgcttcaaaaaaatgccttctcgcattggtctgagctggagagagcctcgttccttagagcagtgcgccacagccacagtggttgcacctgaggatcttgtagaagaacacccatggccagatcccacccccagacgttctgacttaatgaagctggggaggccccaggcattagtatgggtgttttagaagctccccaggtgtttggctttgaggctatttctttaactctctcaatgattcagtaagccatttaataccctataataaatatttttcctgctttttttttaaaaaaaatccccaggtgattctaatgtgcaatcaggttgaagaacactactttagagaaaaccctaaattttagatcagctacactcttgtttaaatatatttttaattgtgataaaatgtacataacaaaatttcatcctaaccatttttaagtgtacagttcagtagtgttaagtatattgattgttttgcagccaatctccagaattttttcatcttgcaaaactaaaactatacccattaaacaacaactccctagcccctggcaaccaccattctattttccatctgtaaattttactagtccaggtatgtcacataagtaggatcctacagtatttgtccttttgtgagtggtttacttcatgtagcataatgtcctcaaggttcttccatgctgtagcatgtgacgggatgtccttcccttttaaagctgaataatattgcattgtacacatgtaccacattgctcttatccattcatccatcaaggcacacttgggttggttccactttttggctattgtgaataatgctgctataaacatgggtatacttacatatttttaaaagagaaaataattagagtcagttatagccattaacattgaatgcttattatgctctggaccctgatctaagctgtttatgtatatcactttattcacatctctaaacaactctacgaagtctttactcttgttacttccattttacagatgatgaaacagacctaggagagtttggtaacttacccaaggtaacggtattttgcacagtttcctcactacaaaaattgtctgggctgtttgttgaaagttcccattcccaggcctcatcctattcctgtaggttctaagcctccagaaaggagcctggaagctgaagattttccctgtatacgggggttacttgtcatcaaagagaaattgagaacatttggggccactaagtggtaggcccaagcagtctggccacagggccttttcacttagccatgaggccaggctgctcctttaaggcctggttttcagtgcctgttatggcccaagggaggtgaacaaatgtctcctttgggatttctaaattttttatttgttgcgtggtgtagaagctgatatcagctaattgctcattgtgctctcagctgtttgtttgcacatccccttttttatatcacagctacattttgaaatccagcattccctggaggcataatattccttccattgctaccttcttaaaaagagaaacttggccagggcagtggctcatgcctgtaatcccagcactttgggaggcggaggcaggcagatcacctgaggtcaggagttcaagaccagactggccaacaagacaaaaccctgtctctactaaaaatacaaaaattagctggacatggtggcacatgcctgtaaccccagctactcagggggctgaggcaggaggatcgcttgaacctgagaggcagaggttgtagtgagccaagattgtgccactgcactccagcctgggtgacagagcgagactctgtctcaaaaacaaacgaacaaaaagaaacttgaatgaatctgacttcggtggggacaacagtctggcatttcacattccaaagttaagagttcaaggatccttctggaccaggtttttgttccttccctgtcctcagggcccattcagaggccttgtcatcagaatccactcaattcagcaactctttattgaaggcctgcaaactgccccagcctctgctgagtgtaagagggagaaaaataagcagcttgatcctctactatctcactggagagggagacgggctgccttctcaaagttggtgcctgggtcctgctgtttgggaggaagcagctcttggcccggtttttcccttagttttaggcatctcttgcttaagctccttctaagcccccagcatttccagatcatgattattagtcaaaagtataggggatactgtctgggaagaggcatgaggaggcctccaggggtgtcaaaaatattctgcgtcttcatctgggcaatgcttacctgggtataaatgtgtaaaatttcattgattgtgcattttcctgtatgtatgttataccccattaaaaataaaaaagaatagggcagtttcaagtgtattgatgcataatattgccagacatattgtaaagggaaaaaaagagccaccgaacaatgtgtatgttaccactggtatttttaaaaagaatataggaaacttacctttcactccatcttttacagcatttgaattttctaccatgggcatgaattacctactcaaaaacaaagtcactatagattcctgggcttggtccccatcttacagaatcagcttctctggagttgaggcccaggaatggtcatttctaacaccctctccaggtgattctatgcacactgcagcttaagaactgcatggggctgtgccggcctggcttaggctacatcctaccacaaaagaagacagatataaggggagtttaccccaggctcaaaagatactttcccccatggcttgatgattagggaaggagctgttcaactctattaagaatgccaaaacctctgagctggtgccaaagtcaacaactcccgtttccattgtaaatccgtactcttctcatgccagtctattttgtatgtgctttgcgtcgacatccctatctttccatgttagattttaaattggctccctacagagtttgaggttgggccttagaaggatgtgatgaatcccttcacttgtaatatggccattcacctcctcctcttagcaaagctgctgagacataacatggcttcaataacttcccaaggggacaccagctgagatcatctctcctgggcaaatgaggcccaaacaaccctctctgttaagaggtctcatctgtgtatttttgaatgagcctgcctcccttggcaccctgtccctatgtcaccaagaacgttttaccctaatcctacagagcatcctggcagtccctctggactgaagtttatctttcctctcctttccaactctgtcaagaagattctgtaaataacatccacttgctacttttcttaacaccatgaatcatcatacacatgggtatagcatcccaatttgtagcctaggaagctaatctcaaaggattttgctcttgcatttatttatttatttacttattttatttttttgagacagggtctcactctgtcacccaggctggagtgcagtgatgcgatcttggctcactgtagcctctgcctccccggctcaagggatcctcttgcctcagcctcctaagtagcggggactacaaggacacacctgtagtgtgtagaggtggggtctcaccattttgtccaggctggcctagcttttatttaggtctgtgtgtgagcatatgtgctcatgcacaccctgaaatctgctttgatatccatgattatctagacacggttcttgtgacctaccttttaagaagcattgtacatttgatacatggtacctccacgctttggcactgctgaggccctgtttcctcttatcccaaggggcatctgggaacttctgtctggatagccaaagagcagtgtctgtctctctctccacacacatcccccgacacacacacgtatatatacacatatatatttctctctcttttagtatactggcacccatttagtaacgttccagcttgcattttctccagataggatgcacctgaaatgattgagcaatctcacccttttgcccacaggctgcacgtgggaatttggagccatggtgaactacatcaagaagacatatcccctgacccagctggtcgtcgtgggcttcagcctgggtggtaacattgtgtgcaaatacttgggggagactcaggcaaaccaagagaaggtcctgtgctgcgtcagcgtgtgccaggggtacagtgcactgaggtgagtcatctccgccttccatcagggccttcagttagcccttatttatagagatgccccgacgcacaacacactgttctgtgaagaccggggaacactgtggccgactgagtagaagtttctgagtcttggactcaccttgttttgtctgcatatcatacattggagatgccccatcagaccccttaagcctgggatatgcagctgcgttttggggtcagatctgtaattggagaagtaaaaccccctttgatagttgctgtctcctagggaatctctgtcaggtgacttaatttgttcaggcttcaggagtttttatagaaacgtggattaatgaaagagcacaggagactggcaagctgggatctgaaagctgggccttgggatcccagatccctccttcctgcaagagatgagtcccagatggcatctggaagggatctgtagaaatcatttaatcagtgtcctcacctttaagtatttgtctctgtcaggcatcccaggcatcatcacaaaggagctgatctactgggtcaagctttctcccaccccttagtctcttgccagtagatgccccacaggatgagtcccaggagggcgtggtcatctgccccgattcccctgaagatcactgctgtcccaggtctctcaagagtcaccacactcacacgttcacacacacatgcacacactcacactatacacacacctctccaggctcttcaaatacattcatatttttttctgtactcttcatggtgtctttcgttttaccaatgagtataaccagttattaaaaatctgatgaaaaaatttgaaacacacgggaaagtttaaaaacacctccctattgatccagtctaatgccaaacagtccttatcgttattcaaagaatctttttgcctcacctgtatatctcatgctgcagtttaaacataccttgttactttctgatggatagaggccatctatattatttctaaaaatacatattactggaatttaaagccagcacacccaaaagacacatgtgggcccaggattcagcctctccctatgaggcttaaagctggctgaaaaaggtgatctaaatgtacccacgatagacatgagaaacatctctgatgaaacccttcctgagtcccaggaccaaggtctgggttctatttttccgtgccggcaatatggggatgatgatgataagcagtacctacctcatagcaccgctgagagtcaaatgagttgatgcgtgtgaagtgcttagaacagtgcccagcacgcagaacgtaagccactgttcattttcattatcgtcatcatcgtcattcactgtaaaatgaaggaggtgggttcgatcggcggatcacaaagaccggtccagtgaactagtgactgcctcacttcataaggaatcacttggaggatcatgttagaaagaaattctgtttcttgggccccacccttggagattttgattcatgaagttggaggcatgggacctcagaagtctgcattttggatacatttcataggcgagttttcagtttagttacgtttagcagtccccggggttagtgacctcagtggtctctccagctgctctcgcgttccaggaccaggctagtcccccatcttcctaccaggaatcttttccttcactcctctggacactggggagtcagctgagaggacatgtgcctttatcttggtgggactagtaatatccaactcccagctcatagccacgtgtaaccagaattaaccaaagtcctgtcgggcccagtcactgggataagaaagacatgagcaaggggcctaccccaggatccaagggagcagaactaggacgtttgttttgttttcttttttttcaatgcacaaaatcttaacacgacaatcccttcatctcattttgctgcagtagcgccatctgctgtcagcaagagcacatgattgacgcagcaagctaaggtgtttgaactaaggcaaagaaggctcaagaagctagaaaactaaaatctgtgaggtgctatacattttgcagacatagcctacacagcctcttccttgagacctcagagggcttcatacacataactaactattggcacaccaacctcatgcaacaaagagcaagttgcaactttattgtctggagcacagagaactaacttgcccaggctaagatcatgtggtcctgcatatgggaactggcaccaggtcagagagacactgttgtccttgtgtgtgctggtccaaggctcaggtaccctcaacatttaaaccagatctatggaataaatggagcacagttccttactttaaaccagtataacctttttttttcctgccaaggcttgagggcgatgagcctttcagcactgggatggtggcagctgcataagtgcttcccatcacaccaaggtggagccggggaggcccgtctgcctctgcaggggccacacgagagttcatgcgtctggtaaatctctcctagctgagtctggagacccgcttcctcagtgaacccctccctctggcttctcctcccgtagctcacctcccatctagccagagccggttgaaggctcagagagaagccagccacccgcttgctgtagttagcaaagtctagctgctgctaaactagctcaccttctacctaaatgtgctgaaccactgaaggagggacacagatgccctgaaatcacctggtatccggcagactttaacatgttccctcagcataaacagctgccaacccgcctggggactctgtgtggtgagacatcctcctaggtaacagggacacagccttgaacaaggctgactaattccctgccttcatggagcttaaagaaaatggggagagaagcatttttggtctggtttcaggtaaaataaattctttcccaagaaagccctcaacaaccttatgttacagaattgaccagtaataataaaactaaaacaaaagcattttattgcagtttgggtgtaaaagatagtctgtatctgaggacctcacagcacttaagacagcagagtgatatttacaaagccacaaagcaacaaatacatgttactaagatattacacatttaggcatatgggtgccaaggaggtcctcagtcaagtggggggtccatgaggagggatttctgaaggaggtgagggtgaggaggacagtagcacagggcccaggccaggggcagaagccccttacagcaggggtcccaactgctgttaggaaccaggccgcacagcaggaggtgagcggtgggcaggtcacagtgggcaaagcagtagggaagcagtgggtgaaccttcatctgtatttagtctcattccccattgatcacattactgcctgagttccgcctcctgtcagatcagcagtgacattagattctcataggaggatgaaccttattgtgaactgcgcatgtgagggatagtttgcatcttcttatgagaatctaatatctgatgatctgtcgctgtctcccatcacccccagatgggactgtctagttgcaggaaaataagctcagggatctcactgattctatgttatggtgagttgtagaattatttcattctgtatgataatgtaataataatagggaaaaagtacattataaatgtaatgtgcttgaatcatcctgaagccatccccctgcccctgccttccctaggctgtggacaaattgtcttccacaaagccagtcccaaggactgcttccttacaggacagtaggggaattatcagaggagtgtttcaaatctccttaaaggcacattatactccgggctaagtggatgtgttaacatcactaagacctgacctccttggttcaggtaaacctgaacatcctagcattctttgagcaaggccttcctgccatggggaagaggcaggtaccacttttcctgccaaatggtggggatattgtctctcttgcttttgatgggcaaacttcaggctagagatgagtttatggcaaaagcaaatattattcataaagtttccccagagactgggactttcctaaaatttgtttttatagttgaagagctataaaatacagtaactttgtgccatcagtaattttgaatcacagccaaacaaagagggggaaactgcagcgtttaaatgagactctatggacggaacctcaccctgggaaacagctcagcttttccaccactgggttgtgaagttgacctgaccacatggttgcccttagtgccttggggctttttgtgggtttttttgttgttgttaattttttttttatcagtataatgagagactctaactcattcctgtaaaagtacatcctgcaaaaggaaaagattctgataaggaagaaaggggcttggtaggtggccatccctactctagtctgaagtccatctttctgccccatccttccaccccagtggaactaacaaagcccagcctggcaggtaccaaaaactcttggcccactcccttgtgtggtacaaacatggttttcttctgctcacactcaagctgaactagctggagatgatgacctctctacagattgactctgcccctgaagggcaacctgctaccagcccagaaccttctggctgggtcttttgggtccagaggctctaccatccctcctcccagaggcccggctgtgcaaggcaggagccctgtcttgggcttggccagcctgcctaggatcgtgccctcttcctctctctgcaggctgggctggtcctggttttgcccccactgcaggattactctcttacagtgcccaaattagaaataatccacatgtccagcatgggagatagttaaataaattaataatataccaactcagtgggaaacgaggcagcttttattttaaaaaatcaagaaaaatatataacacgacagaatgtatatattaaaagtagggaagggccgggtgcggtggctcacgcctggaatcccagcactttgggaggccaaggcacgcggatcacaaggtcaggagtttgagaccagcctgaccaacatggtgaaacaccacctctactagaaatacaaaaattagccaggtgtggtggcgcgcacctgtaatcccagctactcaggaggctgaggcaggaaaatctcttgaacccagaaggcggaggttgcagtgagccgagatcatgccattactgcactccagcctgggggacagagcgagactctgtctcaaaaaaaaaaaaaaaaaaaaaacaagatggtaaattttatgttatgtgtttttatcataattttttaaaaatatgactgtatataggcaaaacctggaaagaaatcccctccttctacaagtaaaaatacttcttaggtcggtgtgatagcattatgggaaagtacttaatgtactttattcttaaggtttcattagcatattgctttcaaggtatttttttagtatcgtctacatccacatcccattaattcatctccaatcttaattcatactgcccttgccttttttccctttttggggtgttaaggtcatgcttgcccatcccactcttacagaacctcattctcattctccatattttttcaaagaccacaggaaagctgtttcactattcttatagtctctcagcactctgagacataatttatttgagccaggagatctgaattcacttgggtaccattagatgcattctttccccagttcattctcttctgactttaattcgttttcatcagtacttggtccactcactttgcaaaatatgaactggaaagctgagccttctctaagcagttaccccagcagcataatggttggctcagctcttccttgcccaagtgattgctctgaacctaattgtaaatgcctgtttgttgggaccctcttctgagggattaaaatccattgccttccgcaacacctcttaaaattcttttaacagtccaaagagaaatctctcactagaaaatggctttgaaaccagtatgggtcatattttattataatttaatgttacattgattagaaatgaaggcattttcagggaattctatttatgttggtaataggtagatcaatggatggacaaagttctttaaaaatccttatggattattctcaaaaaagactcccagtgaaactatactgggtttgggggttaattttctcttctcatttgtgattatcacttcttgagagttttgcaactttcagaaagcatctttccttttggagtcatcctggttctttctgaagttttgaaacctaccctccttccagcaagattcactctgaattttgcaaagccattccctccctgtaattctgcccgagctgcccctcccagggttccacacttctctcctgtgtcctcagccagtttatcctggtggaccaatatctggcccagcctggggagcagttcctgccaccccttctctcttctggagaacatagctatctagaggcaagtcaagaacttggatattcaggccaggtgaagtgcctcacgcctgtaattccaacactttggaaggaggccgagacctagagatcacttgaggtcaggagttctagaccaccctggccaacatgacgaaaccccgtattctactaaaaaaatacaaaaaattatctgggcatgatggcacacacctgtagtcccagctactcgggagtctgaagcaggagaatcgcttgaacccaggaggtggaggttgcagtgagctgagatcacaccactgcactccagcctgagcaacagagtgagactccatctcaagaaacaaaaacaaaaaaagaacttggataggcaagtaaggtatttgtgcagtgtctagagagctaaactcccctggtttcgtgcccattttgtgatttgcatctaaaattgaaccccagtgtagccactaccagctccaataacatgaattcatacccccatcttgtttcctctacacctatccattcaacccctccctcagaaactacattcttttaaagcaagttgcagatatcatttcatctgtaagtagttcactaggtagctctaaaagactctaaggactttttcttaaacataaccacaaataccatcatcacccaaaaaattagcaataattccctaatagcatcccatgtctagtcagtgtccagatttccttgattgtctcatggaagtgctgtttgtttgtttgtttgtttattttgccagttggctggtttgaatcaggatccacatactgcctacatatgcatttattgatttgtctatgtttcttttagtctgtaggttaccctttcttttactgcctttcagtttgctgttgttggtattgaagacatcagtccttttcaaaaaaaaaaaaaaaaatatatatatatatatatatatatatatatatgagatgaatgtaatacattgatcttgattcttttattaaagcaatataaatttaagtttcaattccttaattctacagccaaaggtaaaagacatcccctacatatactgagtggtaaaccaaagatactaaaactcaatcttagccaaaataaacagtggaatactggtcccagcatccttgtcctgatccctccctgagccctgggtccctgtgaatccctagaacctttcaacaagcagtgcctgtggtgttttcaataaaaaaaaatcaagggctgcagcatctttttatatcttgtttatggccacaccctcctcccttccctacctctgcagcctgtctgcaatgaaggaggtactaacaaaagcaagaacatcccttcagttaggaggtcagcaaagggagaaatgaaccagggtaagagaaagctgggattgccagagaccactggctctctgggtggcttggatccaaagtcagaggagaggcagctggttgtggctcggtgattgggtgacccccttccctctgaccacaggcaggtgagcacagtcctgctttagccggggtccctcatggtggtctggtcctatactcttcctgtagtgcttggttagagtcgggcgggggttggctgcacatttatgcagtggccttttgacccttcagggtggtggtagtcttcaccttgagcttagcctgtgtttgatgagcacattgcagaccattaaattcacaaaccatttcattcttaactccccactacctcttattttttaaccacgacattgtgggaaatgtttgtcactccaaaactgtggaattttgccattctaaaattgtagcagctttggggaaattacttttataaaattacttttataaactccctggattgaaaaaataataaaaaacaaaacaaaaaaccttacaaaccacctggtcccctcacttaccatctggaagatggaacctagtagaagtagtgacgtccagatccattcacagggtggagtcaggcctggagattttgaaacgtgcaagataaaagtttccctgtaatgagtgtggactcagtgtccgcctgcgtttggattcacgcccaagggaggagagcagtgagtggggagggctgggcaggcatggctggtgggagtgagcccactggtgtttgttcacctgctgtgtggtcatggacatctggctggggaagcacatggccagggctggtggtgctgtctcctccctctgcatgtgctgctggcagaacctgggctctggaaaacagggataatatcacctgcctactgccgccattgaagggtcagagtgtggccctcacagccacacactagtgtgccagtcacacactagccctagaggcagaaagacacttccagaccagccccaccagctgtgcctacaaagggttaagggcctgtctacttccacttcgatttccttgcctcttcaatggtataaggctaatcaaaagatagatgtatttggaggagatcccagttaatgattttcctttacctcttgatcagcaatgacagaagattttttaggttttcccctccacacccactctcccgttccatgtgccagtcattaaaccagaaaacttgcctgccaggtagggagccaaatacagaaagtgttcacatgacaattgaagcagactttggtcctggcaggctcagtgactaagagaaggtccaggtgctagaagagagtgtcgggggtgccaccaacaaagcctctggcgctagagagggcctttgccggggtccccttcccctgcgctgtcttggtgtctccatagatttctccacaggtgtttgagctctgcacattagagcctctgttttaatgcagaggccacagcctgagagccggccctctccacacaagcacctcaccccatggctagagccccctcctggctgcccgcctgcacccccacaccgcagtcaccctcactcgctgtggttcttccagggcccaggaaaccttcatgcaatgggatcagtgccggcggttctacaacttcctcatggctgacaacatgaagaagatcatcctctcgcacaggtaggtcaccttccgttctctctcaggagacagacagttccttcctgagctcatctgggaaccgtgaaaagccaggactcctgttccttcaggggaaaaaaaaaaatgcaggtgtggtacagactctctgctgcctgcatttgtgacttgattagaaacaaacttgtcttggccaggcgcggtggctcacgcctgtaaccccagcactttgggaagctgaggcgggcagatagcttgaggccaggaatttgagaccagcctggccaacatggcgaaaccccatctctaccaaaaatacaaaaattagctgggcatgatggtgccgctgtaatcccagctacttgggaggctgaggcaggagagtcgcttgaacccaggaggcggaggctgcagcgagccaagattgcgccaatgcaccccagcctgggtgacagagcgagaccctgtctgaaaaaaaagaaaagaaacctgtcccaagctactgaatttgccaaattgccttatgcttttataattcccagtaaatctaagacaatgaaccacttccacacccttttctcccaaattagagcagtcacgaggtggctgtcattgttgaggagaccttccctgtaggatgcttctgtgcctgggggatcaggactcattcttggctggcgcttgggcttctgaccaagcagcagcgggacaggaggctcagggcatggtttcggcgcctccctgctcggagtttgagcctctccttattcttcatgcttgtcctgcctctccgcctcgtaatcctgtggtgggttaacctgtcaagtgcttagagcagtgctgttatgcatagcaccagataaatattagcaatgactttttcattatgattattattattgctgacatctctgcctcctcctctacgcctctcattccctctagctggactaggctacttagaggttcctgtgtcccctggcctctgccacactacttactgcccttgctgagaatactctcccgtttctctgctggtgggaactcagcccatcctttaaagtccatctcaattctcctgcttctgtgaagccaactcatccatgcccaagttgcttttcttttgcttcccctctgtaaatcctacgtctagaaccaaactggagagcgttggagggcttaggcatgtgttgattgctcccagcacccgagacacacccgttcgctcaaaaaaatttgggggatttttggtatcaccctagaaaaagcaatctgactaaatgatcaatttcttgttctcttttttccagtggctaaagcagaccacacaccccagattgggcttcctacgggtgggcgttcacatggcacctaagcaaggctgggcttgaaggccccatcaggctgccacgttgccaaacatgtccttgtgtcctcgtgtctggaaggagagcagagggagacttatgtcccctgtgctggctggaaaatcagctgttcccacttggctcatgttgtttgagattcagctgtgtgctgggcactgaggtgcgtgtagctcagctgagtttgaatgggtctggagattgcagatgttttgtagccagaaggggtggatccaggcctctgacaccaagtccaagtcctctgtctgcgtttccacacctctggtgtcaaaagtgactcctcccaggaaacatttgttttgctaaaggacccagtcttgctactaattagtctagaaggttcaaattatgagagtcctttgagtgtactctaagtattcacatttttcaaatttactacagaaagccaaacatttggaaattttaggttaactttgaatttgtacattctatccagtaggtatataatcttcctaatagtcttttgaaaaaaataaatgctacagaaatgtgttcttcttttggagaggttgtgaatgagtcgcagaataccaagttggcataataaatccttcctaccgcagggccatgcctcaacaaattcagtccgcttccaggtgtgtgactgagagcccttgctgggaagagaggtcaaaaatgcacgttgtgacccctacctctaatgtcatcctctccagatggattttttcttaatagaaatgctggttccacttgggggttgggaaaaaaaaaatgattgctctcctgaatagatgttagcttttatctaagacactagagagctgttggtttgcccaaatgctaaatgagttaacccttgtcttcctcgctttttgtttgttttccactccttcctgcacactgagtcttccttgttaagcaacacaaacagctcattaaggggaagggtctctgccaagggggacattgtcaacacagtgtaaggacgacgcccctacggcttggcccatggcccaccactcaccacaaggcccgtcttgagcccccctcccctgtgctgaaggttttttaatattcaactaggttcaaacccaatctttagtttgtctgggtacccctgaaaagggaaataaggttttgacattaacagcgccagctcatcctctgggacattccaaaggctaaaggttctatttctaactgaccacgttggctctccctcctggcttgctgtggcaaggaagcaggctatgccatggttgttcatcctccacatcttaatctctgtttgcttttgtgtttgctctaggcaagctctttttggagaccatgttaagaaaccccagagcctggaagacacggacttgagccggctctacacagcaacatccctgatgcagattgatgacaatgtgatgaggtgtgtccgcgcaggcgggagagggacgctctggggcagggtgccaggcaggaggctgcaggtcagctgtgcccagcactagtgtttgctctgcctacttgagtgttaagggtgtttttttccctttaagtaagtgtctagtgcttaaaaacagaagatttcacaggaacatttaaatttctagtttctcctggaaaataggaaaaggatccgaccactcattctgcattcctacaaagcatagttagcttgattcaaggagctggggcgtgcaggccctagcatgggcagtcttcaccctacctgtcctgcctcaacaccagggcaagtgtcaggtgccacataaatctgcatttcgcagtggagtaaaaggcaaaagaaatacttcttgtacttctctgtgtctctaacaagagtagaaaaactggctgggggcagtgtctcatgcctgtaatcctaggaggatttgggaggtcatgggggaaagatcgcttgagcccaggaggttgaagctgcagtgagccatgttcatgccattgcactccagccagggtgacacagcaagacccttctcaaaattaaaaaaaaaaaaaaagaagtagaaaaacagaagatagaccaagaggactatgtgtttcaagcaaaatggacagagcctcttactttggggcatggtgactccactctgagtgtgagacacaaatactgcccacttcattcatctactctttatctgcctctctcctccaggcacctgaggttgcagccttgacagtggcctctttcctggttccagtagtttctgattgaggttagcctcagctgaaaaaggaaaagttgacctctgatctcatcattctctttaaatacgtgatccttttcatttaacaatcatttgaggccaggaacagtggctcatgcctgtaattccagcacttggggaggctgaggctggaggatcacatgaggcaaggagtttgagaccagcctgggcaacatagcaagtccctgtctctacaaaaaaaaattgaaaaataaaaatagccgggcatagtggcacacacctgtagtcccagctgcttaggaggctgagacaggaggatcacttgagctcataagtttgagattacagtgagctatggtcccaacactgcactggagcccagcctgggcaacagagcaaggccctgtccctaaaatataaaaaataaattatttgatatttttagatgtagcttaaagcaagcaattattcttcatctaatagataggcagatattgacctaagggtataggatctctgctttgcttccttatgagattttagtagccttcttacaccaagtaacgttgaaatatgcctgctaacagtttctcaaaggaaatgaaaactaggaaattgctggtatgttcagaaggtgaaaaatgaatcttacccaccctcacttcagatgaagtgtgtgactgtattgcggtgtgtggtaagaaaaaacaaattaaatttcccattcatctcctaaattttttaagcccagaagagaatgtttctcaacactctctaaagtctttcctctttaatagcgttggaaaatagcagttttatgatcataaccagtcttggtggcttcctcagagatccatcccagtaatactggagggatggaacaatgcatttcctgcctgctgagactgcaaacgaactgatttcacaaggacaggcatcttagagatgatctctacacttggcctccaccctgtcaagagggccctactagtccagcctgagctttccaggccattcccaggcagagatgtctaatgagatccacagctttgggggaggaaggatagcttaaagaccctagtcaaaacaggaagacccaccattcagaagccagaggccctaatctgtgtcagaaagaggttttgagatcttctggcctaggcctcctggtgtcggagctccagattgaaccttgaggggcctctgggagcacggagcagagcagagcagagctgcggcccctcattcatgctgagcactgaaggttttgttacatgccagtttatctctattgctctgtagtcagagatcggagcagtagtcagagataaagggacagaattggtaactttgaatgacggtctcatttctgttacctaatacatattttattccaattcacggtggtcctgttactccactaagaactctgttaaaaggaaagttccagtaaatgtccttgaatttcagtttctccatatctatagtgacatctggttttatactgccacaagagatgtaacatacactaataattactatagataacaattactacagggtaattactctgggtcggtcatgatgctagtaagcacttgaacatcataagtctcacagttccattgaggaaggccctgtcttcagattcattttatacaggagaagctgaggctcagataagttgaaccatttgcccaaggtcacatagccagtaaataaccgaagcaggatttgaaccccaatgccaaagccagtgctcttaaccctgaaccttgctacctgcatacatttcattgatatgatgagttagtgcaggatctggaacagtcataaaatcagctcagcattcaggcctagctcctgcctctgtctactctaccaatgccacaagttagcgtgaggaactggagccatcgtcggctcagcattctgatcttaaagaccaatgttttgtcctttttctttttttctttttctggtgtgttgcaggaagtttcacggctataactccctgaaggaatactatgaggaagaaagttgcatgcggtacctgcacagggtgagtggccatcacgggctcagaatcagcatcactccacccagcctcgcacacaatacgacagatacctctcctgaattttcctggtggaagctcagctggaatctggctccaaccgctcttttagcttggatttgtttattgaaccaggctctgtccctctgtaactgccatacattaatcccagagctgccccttagactggtgtgctcccatgtctgtgtgagggcctttaaaagtgctccaacacccacttttttcttagtcttcctttgacagtataatcctgtctggtttctgccagatcagtgagatctgtctagatttcttaccatccgggaccctcttttggccattctgtattttgttaccatagtgcctaagactgaactcaaaattcctgccatgatctggtaagcacagagtaaaactgatgtgtttctgtatcaaagtaatgatgagcatgtctatttttttcttttttttttttttttttgagatggagtctcgctctgtcgcccaggctggagtgcagtggcgcaatctctgctcactgcaatctccaccttcccaggttcaagcaattctcctgcctcagcctcctgagtagctgggattacaggcatgtgccaccacgcctggctaatttttgtatttttagtagagatggggtttcaccatgttggtcaggctggtctccaactcctcacctcgtgatctgcctgcctcagcctcccaaaatgctgggattacaggcgtgagacaccatgcccagctgagatgtctgttgataaggtagacttgtttgtattaatgcaacttttagcagctacaataaactttgtgtgattaagtttgtggccaaccaaaatctccatatgtttgttttacctgaatgaccaacaagccagtccctctcattctgtctttgcacaatttattgccctatttatccaaacacaggacttcccatttatccttgtcaatgtccacctgtaggtttggcccatcattcccctggctaaagcagatcactggaaactgtagttgtgctgtcttatcagccatctctcctagtttagcatcatcaggctttttgatgtcgtcatttaagccattgtaggaatgttgagctgtctagagccaacatcagagacctacaggataccacaatcattcactgcctcattatggctgttcagtgacatctgagtctccctatcagtaccatctccactaaaatgaaaaagaaggctattggctgttttagtaaagtggatgttgaatgcaaccctgccaacggttttccaatatccaccagcctattcctgttttcaaccttcagattctttttcttttctttttttttttttttaaagagacagggtcttgctctgtttcccaggctagagtgcggtggcatgatcatagttcaccacagctctgaaatcctggcctcaagtgatcctcctgcctcagcttcctgagtagctagaactataggcataagccataagcctgacctagattcttttgatttgttctatttttgtttttgtgtttgttttaacaaatagagactgggctgtgggtctcactatgtttcccaggctggtctcaaacttgtgggctcaagcagtcctcccaccttggcctcccaaagtgctgggattacaggcacgaaccactgtgcccagccttggcctagattcctgtagaatctcttttgtctggtatggagtgcacttcattttccgctcccatgatataaactgaatgaatatgtacataattcattgcaaagtcatttcctaaaaggagtggctaatctgaaacactctgatgattatcaggaagctttcttctacacactcctgctttcagggcagtaatcacaatggcagatgtaactcatcacactgccagagaatacaaggcgtccttcctgtacctgttcagcaagctgagctgtgaccctcttccctttgcttcaaaaacatgtccagcagtgagtttgagccttgaatcgatggggtctgaaaatgggaatcagtagtttaattctgctttatgttcttgttgcagatttatgttcctctcatgctggttaatgcagctgacgatccgttggtgcatgaaagtcttctaaccattccaaaatctctttcaggtaagtgtttcttcctgctgccctctcaacagctcagcaagttgccacagtaaattctgtcaccttcaccatgctgtcatctcctggagaccaccctctttagggaaagacatctcatagcagtcagtgttcttattctgtgtagcctgatagtcctcgggctgtgatggggcttgggcatcaggcctccctcgtgttcctcccagggcatgagacaggaccaccatgtatatccatagccagtagggctttggggagtcacttgaggttctatgagattatctcagggttagggttcccctaagtttgaaagtttgacataaagagatatttagatttaaaattcgagactaggtgtgttggctcacacctgtaatcctagcactttgtgaggctgcaatgggaggatcgcttgaggccaggagttcaacaggagcctgggcaatatagtaagaccctatctctacaaaaaacttaaaaattagctgggcatggggaggctgaggcaggagaatggcgtgaacccgggaggcggagcttgcagtgagccgagatcacgccactgcactccagcctgggtgacagagtgagactccgtctcaaaaaaaaaaaaaaaaaagaattagctgggcatggtggcacatacctgtagtcctagctactcaggaggctgaggcaggaagatcacttgagtccagaagttcgaggctgcagcaagctatgattgtgccactgcactccagcctgggcaacagagcaagattctgtctctaaaaataaataaatagtaaaaaataaaataaaatttgacttgaaaagcaaaacaaaaaatccggttctgctatctcttgtgacagcctctccatctgcttgaaacatacaaatagaagcaactgggccaagtgtggtggctcatgcctataaatcccagcactttgggaggccgaggtaggcagatcacttgaggtcaggagtttgagatcagcctggccaacatggtgaaaccccatctctactaaaaatacaaaaattagccaggcgtggtggtacatgctactggagaggctgaggcatgagaatcgcttgaacccgagagtggaggttgcagtgagctgagactctgtcccaaaaaaataaaaaataaagtcaagctctaggttattatttctcaggatggccacttagcatgtggcgttgagagcttgggcatcttttaacacaacgtgcagctttaaggatcttgaagataaatgtctgtagtgaaaactcattgactccattgaattctcctcgttctctagtaaaaatactgtaaatgccatgaatcgctactcagagcctggcccccaccactaccatgggcatcacctgggaactttttaaaaatgcagaatctcagctcccacttcaggcttattaaatcaaaatccgcattttaataagatatcctaagtgattttgatgcacaaagttaggaaacacattgaatcacctggggagcttgagcaataccaacacttgggaattcccttccctcactcctctcccacctcccacccccagagattctgatttaattcatctgggccagcctggggttaaggagctttaagaactccacaactgattctaatatgcagccgagtttgagaaccctttagagttctaaggctttcttcagctggtgcccattcagctccaaagccaagctgtactctaaaacctgctagatgccactgtcttgcctgccccctctttggtgaacaaggcagagtgagtagaggttggatgcccacttaggtgaccctgcggggacagccaggctaccctagccagctcacctctgcacctcctgtcctggagcaaactagagaacagtaactcactcagctgcgtttcccctgcagagaaacgagagaacgtcatgtttgtgctgcctctgcatgggggccacttgggcttctttgagggctctgtgctgttccccgagcccctgacatggatggataagctggtggtggagtacgccaacgccatttgccaatgggagcgtaacaagttgcagtgctctgacacggagcaggtggaggccgacctggagtgaggcctccggactctggcacgctccagcagccctcctctggaagctgcgtcccctcaccccctgtttcaggtctcccatctccctcagtgacctggatctgacctcacaccatcagcagggggcacccaccatgcacacctgtctcggagtaggcagctcttcctgggagctccaggctatttttgtgcttagttactggttttctccattgcattgttaggcatggtgacaagtgacagagttcttgccctctgtccagtttcagcatctggttgcttttaagccaagtacatctagtttccctattaaaaatgtgtctgaatagcgattttgctttgccaccaaaaggcttttccctgagaacagtgaaggatgtatgtcattttgtggtggttgtatgtgtccttacatagaccttaaaaagagctcacccttccaggccaatgctgaagacacagctccgcttgggagcctgagaacccaggcttcccaggccagagtgtggcttcttaaacggcaaaggaaattcctttgagtcacaagccaagttttcgccctgtctcctgagaccatttccctacgctttgctgctgctgagagttacgtgaggcacttgttaaaaattcagcctcccaggtccctcccctcggagaggctgattcactgggtctgggaaggagcctggggattttaatttttcacaagtgccccagatgattctcatcaccaagcaaattttggaaatgctgttcaacagcgcccttaaattggaaacatctttgcagctcgttttattgaaattcataatcaggggtgtcctctagctcccacggtctccagagcagcaaggccggctatggagctgccgtcgtgtgaccacagtgtgatgtctcagaagggctctgggtgggctgagcatctgggctgtgccctggctctgcttttcaccctggacaaagtcgctgtggacttcaatttcttcacctctaaaatgggggacttggaccaggtagattgctgagctcactaccaggttcaaagttcaatgacaaactcagtttactgaggtttgagagaacatccctccaggggagcctgggagctgctctcccagtctaagcatgtagatatcatcgtttgccttttgtgtgtgtgtgtcccttatttgataaaaagatgttttgagttgttttttttttaagcactcacttgtaattttagtttttaaacccaagtccctctaactttgcctttgataccaaacaattcaaaagttggatctgagtttggagaaagatatttccaacctaagtgggtattattttgaaaccagatttttaatttaatagcctatatttgtagtctgttggataggtgtttccaaagtgtgtcttctcaagtgaaaacgcaactctaggtttcaagtactccttttctccgatcctgtggtacttgaatatccaaaaaccctgcactttgaacaatcagctgttgctatctggaactaaacagaactatgagtaaaattgcctggatacttt

SEQ ID NO: 36775 - DNA, 98842 bp, Homo sapiens
tgggagccaatgggcacgctcgggggagccgggctggcggcggcggtggcggccggctgggcgcgcactctcgggatggagggcgagcgccgggcatcgcaggcgccctcctcgggcctcccggccgggggcgccaacggggagagcccggggggcggcgccccctttccgggcagcagtggctcttccgccctgctgcaggcggaggtgctggatctggacgaggacgaggacgacctggaggtgttcagcaaggtgagggcggcggcggcgagtcccgggaaacttccaaggcaactccgggcgttgccagcattgcgccgacggctgcctctggcgcgcttgccctcccggggcggtggctctgagctggggacgagtgaggtcccccgggctgctggaccccgcctgccagctctggccgcacccggggccgcgtcgcctcggggcctcaaaccgcagccgctccctcctccgcactttgaccttccgttcggcggggctgtggcttagtggagtctgcaaagttgtgatttgttttccctttctgcttctctgacacagacatcttcctcgcggcagctcccgaacctgggaggctggtggctcaaaaccgctcccgccagctgcttttcgggcgaggccagccctgaactctgggagagcagccaagtttagagaaattattcttaatttagtgttgttgcttgtggatttgagacttgggtgagtctcgggtcttgtgggaataggttctaggaaatctccctgaacaggagaaaacggttgtttctaacaggaagctcctccgctgaggagctaaggatttttcagatggtcagctactgccacccaacccacagccagtgctttcgtttttccttgcccccgggaaatttaggaccaaaggctcttatttgcttattttactgttggagggaaattgacttgtgggggctagtggtagacttttggtacgtgtagactggtgtttgtaatttcttaaagggttttagaaaagaaaaatacctttcttgcagggaggttgaatgtcactccagtttctcaagttgctgctgagagaagacctgagttcagatcacaacgctgtattcattactaagaagcctgttcattttaacgttacctggagatattaggtaaagcaaacgacctacttaaccaccgcatttactctgggagagcaaaccaaagttaggaagtgaccatgcatactctgactccaaagaggagtatataaaacttatttctacttcggtttaaatggaatgataggcccaggtttgtattccgaatatttaaacagactatcacagttttgtgctcttgacttttctgttaagtagtaaaacaatggaattattttatgtttagttgtaaactctgcctttttatattccacacatacttcatgttcagatcaacgacagttggccagttggttatttactttctttccttctttacattgctgtttggataaggaatattagtctatggttatgcattgtgaaactttgggatgggatgttggaaatagcaatggtgtatcagaatcatcagggtttctttctggtttttttttttttttttttttttttttttttttttttttgtcggggctggacccatctggcctcaagggattctaccacctccagcacccaaagggtttgggattacaggcttgagccacagtgactcggattgttttaaacttgtcaagtggtttctctttccccagattctaggtgttctagctgactcttaagaatcaatgtttaaatgaggtcctcttgtcagaggcagatccaaggtgaagctaatgaaattgaagcttcagcgctattcgtttgcttagacctctgggcgtgttgggggttgctggagtcgcagatgttctaggtgggaaggaaatgacaggtcccgaccagaagcatttctaaataagcatttctggtgaattgcctaaagctctctcagactaaggaatctagatctccatggctccaatcatttattgagatttcttttctcattctgaataatgtgtttttccacctaattttgtattcttttaaaaggggaccttccaaactctaaaagcccgtacacctgggtccaccctgcttgttagtgttaactgcgcgtgttggatgcttagaaaaagttaagaacaacttctgtagaaactgcccacatagattaaggcaaagatataatattagtgaaaatccaacaagagtagttggaaaagtttaaaattagccactttcatccatttcagtaagttgaatttctcaaccgttatctgtagttaagcaaatttaagaaagcctgctccacgtggccttccctttccactaccttccttgcctgctcctctataaaacaaacaccactgctgttcagcctatcctaggatggaatctcacaattacttatgaagcaaactgtccttcccttttagtaatttgagattggcaaactacatatttaatttacattcacctttatagtccccttattctcttagattatttgtgaatatgtgtctggtatactcttccagaagctttttaaagagtatgaatttccccagcactttgggaggctgaggctagcggatcacttgaagtcaggagttcacaaccagcctggccaacatagtgaaaccccatctttactaaaaatataaaaattagccgggtgtggtggtgggagcctttaatcctagctaaccgggaagctgaggcaggagaatctcttgaacccgggatgcagaggttgcagtgggctgagagatcacgccactgcattcccacctgagtgacggagtgagactctgtctcaaaagaaaaacaaaacaacttcttattattttttttccacaacgtattacaagtacatggcaaatatacattttgtgttaagtatgctttaaaaaaaagaaatacaagatttagttcttgctatcacaatcttatactccaggtgggaagatgtgacaaactctaaatggcaatataaatcaagagggatggaaagtaaaacaaagttgttctgaattttcttataatccagtgagaagaaaatgatgccagacctcaagagaatgcagaggacattgatttaaaagaacggggatagatgttagaaggaagagaacagaaccaatcatacaaaaacagtaaaaataaaaaaataaaaaagatacacaaatggtaacaagagcctaagaattattttagaactaggtcacaatgagatgaggcttccaaaaaatttaactggagaaaaagggccagtttcttcacgtttaaaggaaaaaatcctcctctttggggaaaaacaataaattaaaataaattgcctttatttttattgaatactgtataaaagaaacagctgtggatacagtgtatgtgattaggccacaatgaagcactgagatgcttatctggtactcagtaaatgatagctctaattggcctctttaaagatattcgggatcataaaagtgagatatatatcatctaggataatcagggaacttacaggtgtaatcatcctcatcaccactagtcatctttgagaaatcatgaaatgcaataatggttccctgaaactagagataggtaaatattgtttttaaaaataatgggcaaaatgggagttctggaaggtagcgaacagtaggtttcatttcaatctccaaaaaagccatgaaatgaattatttagtatgttgtttatacacactttgaaaaaaacatgatcaatagaagctacaagttttataagaataatgaaagacttaagattgtgtttatggtaaatcagagttataatgacatgattgagcaaggcttttgaaaaaaatcactcatttcttcagaaaaggttatttatttatttgtttattttttgagatggagttttgctcttattatctaggttggagtgcagtggcacaatcttggctcactgcaacctctgcctcccgggttcaagcaattctcctgcctcagcctcctgagtagctgggattacaggcatgcgccaccatgcctggctaattttttgtatttttagtagagacagggtttcatcatgttggccaggctggtctcaaactcctgacctcaagtgatccacccgtctcggcctcccaaagtgcagggattacaggcgtgagccaccgtgcccagctgaaaagtttatttctgaaagaataaagttgagacatctaacatacacatgtatacatatctttatatgtatatatatatttttttctttgtcaatttggaaattcagtatagtgatggagcggcataattatactattcatctattctatcaaataattagaaaaagattaggaagtcctgcttactaatttctcacatatattctctgcacagtctatttggtttctgttgtgtgcctatatcagtcatcactctgataaaaatcagaattctctccaatgatttaaatgagagttgaatgcggggactatttatggaattattggcagagttagtgaacaaacaaggaatactgaggcatttagagagttgtagtgggaaaaagctattagcatccctagctttaaagggacaagaaatggaaatagcattgctggaaaccagtcagacctggagctgtggagatggggacacttcttcaggaactgcatttacagagagaggtagctactgccggaaacgtgccaaagcaggaggaaataaggggtatgttccctgaattcctctcctcctgcctttggatctcctgcttgcactcctctttgagtggtcttgctaaggtgatgtcatctataggtgccagcctcctagggcacagaaaatagatgggtggggtcgtaggacatagtacaacaatgtggagagttactttcaataaaggtgactgtgtcagtatctctcattgtatatgctcttctatgatgtgacctgccactctcctacggagagatggtataagtgctgctttccttgaacttgggtgggattatgactgccttgatctataggatatggtggaagtgatgctgtgcaacttcccaggctagatcatgaaagggaatgtaggtttcgtgttgtccagtgggacactgtgctttttggagcaccatgtaagaaatgcaacctaaaacctccatgttaggaaacccatgttacattgaaaccatatgtaaatgcttggtcagcagccctagccgaagtccctggcactatccagcattaagtggcaggctttcatgtgaagatgtctgtatgatttcagcctccagcattcatgtgccctcagccatcaagtcttttcagttgagccctcatgtataatggaggagagacaagacatttctgctgtgtgcttcctgaattcctgcataaaccagtgagcataataaaatctaaaacaataaaatcgttttatacgactatgttttcagattgtttgttacacagcagtagtaactataacaatagctaatagtctgtatatcataatcagccttccaaatcttttgataagttagaacattgtattcagaagtagactatggaatttaattgggataaatatgaagttctgaagaaagctccattagtcattgtaagtaaaaataccattaagatataagcttagtggttaggagtagaaactctcttttctttttatttgagacaaggtctcactctgtcacccaggctagagtgcagtggcgtgattttggctcactgcaacctccacctcccaaggctcaagctatcctcctacctcagcctccccagtagctgggactacaggtgcacactgccacacccagcattttttttttttgtatttttagtagagatggggttttgccatgttgtccaggctggtctcgaattcctgacctcaggtgatctgcccacctcggcctcccaaagtgctgagattgcaggtgtgagccaccacacctggtccaggagtagggactctaactacattgcctgcatttgaaatcctggctgcactgcttactagtattattgcctaaggcaagtaacttaatgtcaatgcgtcagatttttcatctgtaaaatgaggataaatactaatgacgattacatgccctaatatgtatgttcccctttccctaaggcctacatcctgatcttgtcttagtgggccttaccattttgatgattaggaaaaaaaaaacaaaaaaaacaaaacaaacaaacaaaaaaaacaataaaacaaaatagggctgatccaggactacttatatttctcttgcaaaaaatttcactctgtgccattatagctctcttataggttaagtattcttttatatttctccttggggaggaagtctaggtaggtgaaatagaaagaaggtgaaaagctctaagtttctctttttgaggtagcatatatgatcaacaataaaaccaaaacaaggaaacttcagaataagtttggggagaccttgtataggaccattttatgtgcaaacattcctagtggttttcagtgactgaaaaaccagtatacacaaatgacatgatattgaatttaaacaccatattttcaaggtcatatagggtattaattttaatgtaaatttgaactctccatgccacttcagaagatccattccactctcagcattttaaaaggagaattaacagttgatgtcaaaaaatggcagaggaataaggcctcatcttcagatgccagtgccttgttatggattctttggaatactgtgttaagatggagctgaaatctggtctgagcttagaaagagggcttagatccattaacactgtcttcctttggcacaggaagtagcaacagttttgacacacgtatttgctatccatgaaagagagtccactaagggatttcactgatgatatgttctgttaaccatggcctgtgaagaaagtctggtgaagaacaaaaagtgatttagcttggaagagatgggttaattcttttaataactccttatgaacacttactatgatctaggtggattaaatgtttacagttttgaagggcaaaactaggaccactgggtcaaaaaatagaagtttcaggttaattcagaaaatagatttctaattaaagtttccaaaatgaaagggattgcccaacaggatcgtgaattctgtcactaaaaatgttctggtacaagctggatgactaactgtcccagaggagaggagggtgtgacagttgaactgtccttttttactaaggctgttccagtggaattttaacttactaaatttaactgtaagagcagtggaaagtcttaattagatgggcctattcatcccttcagtttatttccaactggactatgttctgccattctccaattcttaatttctcttccccaacccgttgtcttttccatttaattttctcctagtgatgtaataattccttaggtgtccaggataaaatcctcagtgtttaccttctaatcatccctctcatgcactctccatgtctgttcatatatctgaatgtccccatcatttttacctttttgatatctctggaattagtgcctcctttcagtttcctctcctatgtttggggtggttgtgtagttacctctgagaactattgaaatagcctcataaggtcttcattctcctaatattctgcccccattctatgtgttcccagcaaatcagtgtttccagagcacacagctctgatcatattgtcaccatttgccattcacagctgttgatgtttaggctgtcagccttctccttcacccccactctctttcctggagagcctcactattcagttccatgactgttacatcacctgggagctggttacaaatgcagtctcagaccccagtgaattggaatctgatttaaacaggatttgtggtaatttgtttccaccgtacaatttgagaagcactgatctaggttggtccacttgccactatgtgaacttactgtgtatttttctacttttgtgtagttattgttagggcagtgaaacaaaaccttttctgttactcatcatccctaagaaccttcttcaatcctcagctggaattaattttttccagtctgtgctctccatactagtgttttgaatcatctaatgcttaatacattctgccttataaatagatattatttctcttttccaaaatcttgattgcttgtctgttttcaatagattaagctctcaaaggtaggagagtaggaactctatttacagaataaatacataaatgaatgacgtagcctctgacttttttcatatttatagagacagttattacagcaatttgctggtgatctgtttttagtgaattcagtttgtatcatactggtctttcctgtcaggatactaaactacatagaattaaattagtcttaattaatggtgagtaatgttattgtttgatgatacagagagctatgttgagcctcaatcctgaacaaaatctcccatttagattatattagaagaaataaacacaaagcataaaaaatccaagataacaatttagaaacattcttttacttgaaaaaaaaccatattaagctattaatactataatagcacctgcctcagggagcttgattacaagtagtggaagccaactctggcaggaaagaagtgcaatcttgaatattagattgctcacagagtagatgtaaaggctggaaatgcagctgcagaaagggacaggcgctagcagaaactatagccaatcgtatatagtcatgtgctgtgtaaggaacgttttggtcaatgatggactgcctaagattgcaatactgtgttttactgtaccttttctaatcatgtgttacagctgcctacagttttcataacagtaacatgtacaggtttgtagcctgggatcaataggctataccatctagcctatgtatgaagtagggtatatgatctaggtttgtgtaagtgaactctatgatgttcacacaatgacaaaatttcctaaggatgcatttctcagaacctgtccccatcattaaatgacacatgcctgtatttggaaaggggattggatgttgtataaacaaagaaaaaaaaattatgaggacctataggaaagagagctacagctcttttatgtagagacagtgagttttatttatttatttatttatttatttatttattggtcaggagcaatgaggaaagttattacaaatattttgagaaaatgatgttaaaaggctccagatttaaacttagtgtactctaaaaagaatactttatttccgtgagttttaaagataaagttttatgtttgtatccttgagggtcctcatagcctgctgtagttttacaagtagctagtgtgatcaaaaagaaacacagattcaatagctatgtggttacagtgttaaaaatttattttattcatgtttatttatttgtgtcccacactttccaaagaagatatgagactaaaagttaaacattttcattggagtcaccttaagtatatacagttttctcaataaacaggtaaagagttatatgcttaaaagattttgctcattttaaacagaatatttgattaactttggattgcatgtatcaatcaagctggataatagtgtgttacctctagtattaataaaaaaagacaattaaaattattagcaaatactgacataaaaatctgcttgtgttaaaacatagggttaaaccaacagttttaacattgaaatggaaaaattttattatttttgactttgagaaatgcttttatatgacatgctctttttttctttttaaattcaattttattgagtataatttacataccataaaattcacccattttgggtgaatgatttttttaagataattaaccagattgtacaactatcactataaaccagttttagaacattttcatctccccaatatgatccattatgcctgcttacagttaatctctgttttctctctgtcatagacaaaaaccactcatctaaattttctgtttatataaatttgtctttttaggtaatttcaaataaatagaatcatatcatatatgctttatcacaattttgagattctttcatttgtcatatttttaggttcatttctattagaaaaatgattttatatcatagttttatttttagataagtttttaagataaacaagctgaatcatttaaagtgaaatattaagaaaaaaagtctgtttagaatgaaaattaaagccttatgtgtaaccagaaacaaatggcaaattcttgttatatgaatcttgaaaattagaaaaaatgaatccctaatttgttctgagaaaaatgtgcatgtgtattttgtaatctaattgaacactgaatactctcttcatcagctttcattaggttatgctgcagtacaacctcgagatttcagtggcttgcttacaattaagttttctttcttgctcgtttatctgtcagctgtggctaaactgtgattctgctctcggctttgactctgttccacatatcttcttcattttgggatcaagactgaagcagtaacccctaactgggacatgccactcctgtgacagagggaaaataatatgagcactggtggaaatagacaatggctcccagatcttctacccagatactgccattgtccaaagcaagtaactggtcaaaccaattgggaggcactgaaaatcacctggcagctggccaggagatgtaatccgctcacaggaagaaagaagagggatcattaggaacaatcagaccacctctaacaatggttttgtggcaaagttataggcaaatggcatcttggacctttctgaatgaataaaaccaaatttttagaatagagtattaaatacaagaggtaaaattttctactaagtaagaaattattcaagtggccgggcgcggtggctcacgcctgtaatcccagcactttgggaggccgaggcgggtggatcttgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaagaaattattcaagtgtaatcaagataaatggagctgcatttgatatgattaatcacctccaattggctaatgctcatgaagagtctgaataagaccatacacatgcttaacaatctctagctgtgcaacaagtgttttactttgggattttcaggtgtaacattcatttatcacagagtgctcctccctttttaaaagactattagataaaatgtatgaatacttgaattctgatacagcaaatgtgaaaatgagctttgctggtcattccttcatcacagtctatgttccagccatatgtcttctttctgttcctcaaatattcttcctgccttgggcctcattggttggtccgactggaatcctgctctccaagtgttttgtatagctgactccttctcacgttacctcctcaaagaagctttccctgacagctctatggaaagcattcttcctgctccctgcagcccctttattcagcaacctgctccattttttcctaacacttattcttcttatctgaaattatcttacttatctatatatttatttgctcattatatgtaccctccccttccctctcaactaaagtataagcttcatgagagcaggaactctaccagtcttgaccactattgtatccccagcccagtgcctgacacctgggtgacatgcagtgaacatttgttaaatgaaatcaaaatactatactgagtgcttttcatgtgcacatggatggtgagggtggttgagtcttgctatcaattaagagataagtgatttggggagaatgcttatcatccctataccacaaatttattcacctgtaaaatatggacaatgataattatacttccatcagattgtggagaggattaaatgaaataatgcatgtatgtgttgctaaggcacatagtctctggcacttagaaaactctcagtatttgctattatggtatataagattaatattttgtttttgacttgtgtaagcagccactttgaatttgtagtgagatcttcagaggatcacagaaatatactggtttctatctttgaggaagctatgtgttttatttatttcagtggtagaatgttggaatcatctaattgcattaaaggagggtggaaaaaaacattcccagaaattcctggagttgactactaacctgttaaaaagaatggagcaaagttgaaatattttaatcatgatttcttccttttagctttgcctccatcctcaaatttttattgtgtaccattttaagtgcagaaatgctgtgtgagtttgccagggctgctgtaacaaagtaccacagactgagtgtcttacataacagaaatgtattgactcacggttctggaggccagaagtctgacatcaagaagtcagcagagttggttccttctgagggccgtgagagagggatctgttccagacttcccaacatggcttatagatccatgttctcccagtgtctccacacatcctattccctccatccatgtttctgtgtccacatttaccctttttatagaaagatagcagtcgtaattggattagggcctatcctaatgacctcattttaactttatcagatctgtagggaccccatgtccaaataaggtcacactccacggtactggggatttgggcttcagcatataaatttgggtgagggaacaattcaacccataacaaatgcttataataaaccccgagtaacaacagaaaaacttacacttaatttgtgatttttgcaataaattctattatcatgctaacaccaatctaatccatttatttcagttaagttatttaagtggtttttctgacagtggatgtattgttttggagtaaggataaaagaccatgaattcttgcaacacaggctttcttctctatgaaactcactcaaatctcagcctgaacccatcccaggactttcttgtgtgtgtgcattttcactgttctagctacaggagtaaacgtgatttaagaagtagagatttgtcacacagataatttttattatgctataatctgttgaaggaaaaaataaaaagatatattttcaccatttaaatgaccctaagataatggtcttatatccaaatagagacagagagacacacatccattattgtggaggtgagacctttgtttggaaagaacaaattttattgatccatttctcctgaaacgcatcaaccgcaaaaggttaaatggagttctttttggttaattgctactttggatcttcccaaacacttattttcttcagttattcatgtccaaatgttaagtcttttaagtattgttagtatattttctttccttttattgaagtgaatataaaacactttagatagtcagttttattgaggttttaagaatgcttttgagtgattcatagtaatttaaatccttctactgaaatcttggatgttgctaaatttcagcctgtaattttctgcctttgctagatatcgaagcatatttttatgacaccacactgtactcattggaattgtgagccttttgtaaattcatgcagatttttcccactccacaaaaggatgcatttcaagcggaagaaatagaatgctaaattatgtagtaggtaaaagaagtaggctgtggtgagttgggaggatgagcaaaaagaatgccaaagcacgtttgtacgtaatgtcagtaaaatacaaagtacgtttgcccaccaaattaaaatttgtcagcttacaaagttgctatttatatacagtggtttttgagagagatttttgtacatgctgattacacatttatttggaagctctaaattctggttttaatggctgcttagtatttcattgtgttagcatcccataacttattatttatctatgcaaccttgttaagaaaaaaatcaaatataatccgaagtattctgccaaaacaactgttttatcactacggttcttactgtctcttagcacatcatgtacaatgttgactctaacaattttaacggtttttctggttataaaatataacatatgttttagaatatttggaaaataaagaaaatcacatagaaaaatattaaacccaacagcaatcccaacatctggaataattcctgttaacttttttttttaatagctgctaaattccctctctccctccctgcccatccccccagtcatacacatacacacacattggaatctggttttacacaaattttatattttgccatttttttctgaataacatactgtgaaactttttccaagttattgtatgttcttctaaatcatctttaagtcactatgttgtattctatcatatggatagaattcattataccctcccatagagatataaaatgatttatttcactgaattttttttgcaagacatttattgcttctaaattttctgtgtctgattaatccaactgaaatttgtcttctactccttgtgtaatgcttaaatgatcacaaatctttttgtgataataggctgaaccttcgtaatctttatgactattgttattcttctttcttcagttagcatatcctgtgataatctctcttctattattacattgaaggatgacctaaatgttgcattgtagttcacagagctaaactttttgtgggaagagcctttaaagcagtgctctgagtattatcgatgcttcaaaagcatttttattgatttggtttgaagagaaaacaagtccatattatgatttcatctttttttcctattcatagtttcacaaaaaagtatctcttcctaaaacatcagaatttattacattgtactatattaatgcatttggatctgagatattttggaaatcatcaggtccaactttgtaatttaacatagaaaggctgaattagtggttcagtgcctgcttagtcaatggcagagataggaccagaagccatttttggcctcctttatgattttttttttactcagtactggccaactttgttgctaagctaaaatgggctttgttgcagatttaatattcaaatacatcagttaactttataatcttacacataacaacagacaaaacttttgattccaacatctgtatcactactttaggggaacaaatgtatctaaaagaaaaagtatagagttggagaacaagttcttactaccactgcagagataactcaaatattctattgagagtgttagttttatctttgcatgtgaaagaaccattatttgaatttaaagtttactgtaattatccttatgtttcagttaattttatttataaagaataacatgtagcccttcctttcccatctttttctttcttttatttagacaaaactattgaaggtgactgagcagatgaccagtgttgccaattgaaattgaagctgaggaggcatcctgcatggttggggttgagaataaggctgccttggcctacgtggtcagagcagaggaggaagccggtgtggttgggagattggttacatacaggggaattgagccaataagtaaacatttgggataataggagccaggtttctcactgctgactaaaagagttataaatatggaaaagggaaaggctagacaagccatgacatgtcaaattagaaatagaggtatataggccaggggcagtgactcatgcctgtaatcccagcactttggtaggccgaggtgggtggatcacgaggtcaggagttcaagaccagcctggccaagatggtgaaaccccgtctctactaaaaatacaaaaattaaccaggcgtggtggcaggcacctgtaatcccagctactcgggagtctgacgcaggagaattgcttgaacccgggaggtggaggttgcagtgagcccagatcgcaccactgcactccagcctgggtgacagagcgagacgctgtctcaaaaaaaaaaaaaaaaagaaatagaggtatatcattctaatttgtgaactcttggtattttatatctgtatctagccatagatctagagctgtatgagtctgtgtgtgtgtgcgtgtgtgtgtgtgtgtgtgtgtgtgtgtgtgtgttagtctgttcttgcattgctataaagaaatacctgaggctgggtcatttataaagaaaagaggttcattttggctcatggttctgcatgctgtacaggaagcatggtgctggcatctacctgtagtgagggctttaggcagcttacgattgtagcgaaaggtgaaggacggccagcatgtcatgtggccagagagggagcaagagaaagaggacgatccagggtcttttaataaatcagatattgcctgaactcatagactgagaacttactcattaacatgaggatggctccaagccattcatgagggattcaccctaatgatccagacacctcccactaggcctcactgccaacattgggggtcacatttcaacatgagatttggagagggcaaacatccaaactatatcagtgtacatatgtatgtgtatgtctcatatatttatttcctagcattaatatcttggttttgtaaataccaatcttctctaaaaggaaccagagctcctcggagaaatgtctcattccagagcttgggcagggaaataacaaaatattataaacttgaaacatcttgttctaaaaagtaaagtgctcaaagaataatgaagacatagcaaaaacatactggtgcagctttaaggggctcccacttgtcaaacttgggactgtttagacatcaaaataaattatgatgttaatgaattatatccactgaataaaataggaatctgtgaatctgtagtcatataattaatttgagtctatagtcatataattaatttaaacaaaatattatactctttagtctccttagtggaaaacctattgatggtatcaacattgaaaaataaaaaatagcagtatacatatatacactaatatagtttggagtgagagggaatgaataaatgaataatgaacactcaggaaaacaaaaactgggctggcacagtggctcacacctgcaattccagcactctggcaggatgtattaatctgttttcacactattaatgtgttttcacactgctgataaagacataaccaagactgggcaatttatataggaaaaagggtttaatggacttacaattctgcatggctgggggagcctcaatcatggtgaaaggcaaggaggagcaagtctcatcttacatggatggcagcagggcaaaagagcttgtgcagggaaactcccatttttaaaaccatcaaatctcgtgaaacgtattcattgtcatgagaacagcatgtgaagacctgcctctatgattcaattaccttccaccaggttcatcccacaacacatgagaattgtgggagttacaattcaagatgagatttgagtggggacacagccaaaccatatcactccacccctggcgcctcccaaatctcatgtcctcacatatcaaaaacaatcatgccctcccaacagtccccaaagtttcatctcatttcagcattaactcaaaagtctgcagtccaaagtctcacgtgagacaaggcaagtcccttccacctatgagcttctaatatcaaaaggttagtcacttcctagatacaatgggggtacagacattgggtaaatatacccattccaaatgggagaaattggccaaaacaaaggggctacaggctcatgcaagtctgaaatccagtggggtagtcaaatcttaaaactccaaaatgatctcctttgactccatgtctcacatacaggtcacactgatgcaagaggtgggttcccatggtcttgggcagctctgcccctgtggctttgcagggtatagcctcccatctgtctgctttcatgggctggcattgcgtgtctgtctgtggcttttccagaggcacagtgcgagctgtcagtggatctaccattctggggcctggaggatgatggccctcttctcacagctccactaggtggtgccccagtagggactctgtgtgggggctccaaccccacatttcccttttgtactgccctagcagaggttctccatgagagctccatccctatagcaaacttctgactggacatacaggcatttccatacatcctctgaaatctaggtggaggttcctaaaccctaattcttgactttggtgcattgtctgtcccaacactgtgtggaagctgccaaggcttgaggcttgcaccctctgaaaccatgacctgagctctatgttggcccctttcagccatagctgaagcagctggagtggctgggacacaggacaccaagtccctaggcggcacacagtatggggaccctgagcccagcccacaaaaccaccttttcctcctaggcctgtgggcctatgctgagaggggctgccatgaagacctctggcatgccctggagagattttccccactgtcttggggattaacattcagttccttgttacttatgcaaatttctgcagctggcttgaatttctcctcagaaaatgggattttcttttctatcacattatcaggctgcaaaagttctggacttttatgctccgcttcccttgtaaaactaaacgccttaaacagcacccaagtcacctcttgaatgctttgctgctcagaaatttcatccactagataccctaaatcatctctctcaagtttaaagttccacaaatctctagggcaggggcaaaatgccaccagtctctttgctaaaacatagcaagagtcacctttgctccagttcccaacaagttcctcatctccatctgtgatcacctcagcctgggtttcattgtccatgtcattatcagcattttagtcaaagtcattgaacaagtctctaggaagttccaaactttcccacattttcctgtcttcatctgagctctccaaactgttccagcctctacctgttgtccaattccaaagttgcttccacattttcaggtatcttttcagcagtgccccactcttagtaccaatttactgtgttagtccattttcatgctgctgataaagacatacctgagactggggcatttgtataggaaaagggtttaatgacttacaattccacgtggctggggaagcatcacaatcatggtgaaaagcaaggaggagtaagtcacatcttacatggatggcagcaggccgaaagaacttgtgaagggaaactcccatttttgaaaccatcagatctcatgagacttattcactatcaggagaacagcacgggaaagacccgcccccatgattcaattatctcccaccagtttcctcccatgacacatgggaatcgtgggagttacaattcaagataagatttgggtggggacacaaccaaaccttgtcacaggtcaaggcaggaggattgtttgaagccaggagtttgagaccagccagggcaacatagcaagaccttatcactataagatattttttaaagcagtagaagaatgaaaatgtaatcataattcactatatggcttggctgtgaataaaaataatttttttcttaaacctctatctaccttaaaatggtgataagatgatgggagagagaaaaacgtatgtatatatttgagagaaaggaaacattgcctataaagtagcttcgaataggtctataccataatagaaagtgaaaggtgagaaatggttccggattgaaggggaccagagatataacagttaaatgtaacagatgaacctggatttagttctgtactagaggggaagaacattttaggatatttttgggacagagaaattcaaaagggtctgtggattagactgttgtattgcgtcagtgctaatttcccgattcaaatacctggatcggtactatggttaggtaggagagtattcttgttttctgaaaatacacacagacctatttaggaataatggggcaacatgtttctagcttactctcaataagtaaaagttttctcatccctccttttctctcttttgctttctctctccttaactttcttacaccaattataatttatctacagatctaacataggcatgcttcctatcacatttatgtcattatcagttttcttttcttcctttttttgtccttcttttacttcctttttttaattccctttcttccttgtttttctctctcaccttctctgtttcctttcctcctctgcttattcccctttcgtattctgttctccaccatccccttttccttcatccctcgcttcctttattctttctccttgtcatctccttgataccctggatatttattttcctggtccagtgtatatgggctgttctctaggtttgctgcaaaactgtcaatgtagaacattattttccagggaattccctttactttgatcttctgttgtatctcttgtttttagattctatttttttctttcttggcatattctcttattttggagaagtaaagaagcttccaaagaataggtacatgggaagtaagtttttgaaatcttctatttctgaaatggcttaattctacctgtatatttgaatgacaattgcctggatatgtataattctaggttgaaaatacttttctctcaaaattttgaagacattagtttattatcatgtagtttccagcatcaccatttaagaactctgatgccattctgattcccaagattcctcctttattttacttatattgtttcttaaatctttagggaatttaaaaatctctagtgttatgaaatgtcatggtgatggatgcttgtaggagtactacctacccaaccagtgtcctgttcattttggggagacctcacaggccctatcaactttatgtcaaggatatttttctttctcattttctggaattccttttattcaggcactgcctgcctgtatccttcaatttaaaaaatcttctcattttccatctcttgttcttttggttcacatagtaggacagttcttgagctctgattttcagactttctgttgcatttttatattgctatcatattttaattttcatgagtctcttttttggttggtggtgttgctgttctctgaattttctttttaaaaagagcatgctttcattcatggatttaatattttctcttatctttctggtgatttcatggttttttaaaaagtgtttatgctctgttctatctgcttcctctaatcttctgttttggtttgtttgtgactttatttcacgtcagagcctttcctcgtgtttggatgtttggtagatcctacaccaaataataaaaagcagagtagacattctgcatgcatggtaggggctttgatgtagggtggttatgcagagacctggctaattcattaggggactacaactgtcagtttttctccaagatcagctaagagaggaaacttccaactatggtgggtgctgtggtatgaatatttgtgtccacccagaattcatacatagaaatgctactgccaagctgatgatagtaggaggtggagcctttgggtggtgattagatcatgagcgtggagctctcatgattaggattggtgcccttataaaggaccccagagagaccctccccccttttaccatgtgagattatagtgaaaggaagctgttctgtaaagtgggccctcaccagacgctgaatctgctgacatcttgatcttggacttcctagtttagaactgtgagaaataaatttctgttgtttgtaagctacctagtttattgtagttttctttaataacagcctgaatggactatgatggggtgggggttgcaccttcctgccaacgttcttgggaccagatgaacaggtttgcatgtcttttagtctggtatgcaggactttcacttgatatctgtattttcataggacttcttccctatcctactggatgccctcgagctcagacctttcagaaagtagacttccagtgttctaccaaattggggtgggaaagttacctgattgcctagggtaggtgagggaatctgaggttctaactcttgttttattagatcttcttaataaccaatcatctggtttctgctctgccacaacctttatgtccacaggttcttggtgcctccaattcttgaacctttctggcattctacatcataaatatccttgcctcttcctagtttactgttctcttctagattacttttcagttttctctgcactgctattttagttaccacttgacgatcagatctccagtttccaaaaagcagttggcacatttcgtttaccatagtttttttcttcttattcttgcctgagtccattagtgctactgtgacaaaatatctgagactgggtaatttataaataatagaaattgatttctcacagttctggaggctgggaagttcaagatcaatatgctggcagttttggcctctggcaagggatgctctcagcttcaagatggtgtgtgtctttttgttgtgtccccacatggcagacagtgaaagggcaggagaggcactagctcgttccctacagccctcttataaggtggctagtaccattcatgagggctctacccttatgacttactcacctttaaaggctccacctcttaatactattgcattggggattaagtttcaacatgacatttggagggaacagaaacattcaaaccatagcaatccttgagggtttatacttttcatttgtttgtttctttctttactgtcatcttttgggtgggattttcaagaggaaacagataaaaatacatgttcagtataccacatttaactaaaagtccaataatcccttttgttcttgatatatttcattaatattgatagcatctagaaatagaagagtttaatttttctattgatactaatttttgaatgttttatttcttaggatgcctcattgatggacatgaactccttcagccctatgatgccaacatcccctttatcaatgataaaccaaatcaagtttgaggatgaaccagatttaaaggatctcttcatcacagttgatgaacctgaaagtcatgttactacaatagaaactttcattacgtataggattattactaaggtaaacatttggtgaatattttcttgaatatagctgcttttttttaagctttggaagtaagtacctcttgttcattataattctgaacattccaagatcttagctgaattgacttttactttttcaaaccttttggctaacacattgcttcttatctgcccttcacttgttctgtattaagtcagtgaaattcaacttgacttgagaaatagtcactcattttatagcagctatacttcttagaataagaatatctaggtttttagtttaaaaaagtattaagaaatacctttggaaaagatgggcctcaagttgttaataaaaaaagaaaatgcttaaacagttcgcaatattatgtattcagatttctttggaagattataaaatatggtaccatttgtttttcaaagtgggacaggtggccactttgtctcatgtatgagatactgttatgtgtgcaataattcaagagcaaagtagatctagaacacagatctctttaatcgtagggcgaagtgctacaaagacaatttacctcagacacaattaagcaaccacctagtataatctgtattttaagtcctttatttaatagcatttgaaaataattctctttataatattttgtttatgaagcgtcaccctagacttttatatttcataaatgtaaaaagtacatctctttttttagctgaaaaagttctgaactatgtttctataatcacttcttccaatgaaactgccacactgctattagttatgtttcctgaagatatatatatcttatttcttcacttgaattcttaaaatcctttcttggccccttatttcaggcagagcaaagtgccgactttcttgtatgacatataaagaggcttctcagtctggtgcccacttaccatataagacttatttgttacacctcacattcagtaccttgctttccactcaggtagagctgcttctgttttctgaatatttaggggatctcttgctctcaaaactgcatatagttttccttctgtttgctgtgtccatccccttcttagacagaagaagtcatgcttagttttcaatatacaactcaaaatgttagatgcctgtgaaagcttctctagttgttactgtcccctggctgaaatagttattcttcctctgttttctcatactgttctattgaactcttaaggaatgtaaaacataagagtcaatatagcaaaatatcaaaagcatatatttaatccaactaagctgtttttttaaatcaatgaaactgagataatagaactcacttctgtagggttgcagtagaataagtaatcaatgcacaccccacttagtaaagtgcctaacacacgataagtgttcagtaattgccatctacctgtatgtgaatagatgtttatttgtatttattctcagtgagtttgtgagtttctcaaggaaggtaactatattttaagttatccataattccaaacacaaatcttaggacataataagtaaactatttattttgttgatgaatgagtgaaggaattatcttagctatatcaagatgtggtagagcaagacaacatggagttgaatcttgatttctctccttccttgctatgtgacttggacaatttaattaacctctctatattagttttcttgtttgtaaataggataacagtactaacctcataaggtctttatgaagattgaatatgttaatacaggcatactgctagagtagagccaaatttcttctattactactgttataattatctattgtcattatccattctagcaaataatttgtgaaactgaattatttttccatcatttgcgtctctcagaaagacactctttctaaagccaccttgtgagtttcattctgatcatagacatactgctcttctgagtttttctatttacacatactttaaatggactggtcttatagaagtagtaatagtagtagtaataataatatgaaaatatataaactagcaaacatttactgtgtgactgctttgtgccaggtaatattctaaccagtttctacatgttaactcatttaggctcacagtaatcctcaaacgtagatattatgatttacccccatttcatgcacgaggacaccgaaacttagtagcttgttaaaggttacacaacattgtaattagctgagctgggatttaaatccaaacagtttactttcatagtatacattttttctattatatttttgtgcatttaggtatggatgtggtaaactttcagtttaactattataaatgacttccattgttctacttctaattacttttactatttcatagtatatagactatatctatatatacagaaatatatattacagatacaaatatataaatagtacatgtagatcatgttatcaaatagtcttttcttattatcatttacttacttattccacaagttttattgagtaccccgtttgtcccaagtattgtgcttatatattaagaatatatcagtgatcaggataggtctgacaaaaggaactttctgctttcctggtgttttcactctgaagaaggggtgtttgcatatgatgatattaaataattaattttgtactgtgttagtttgttctcatgttggtaataaagacatacccagtactgggtaatttataaaggcgggacatttaattgactcacagttccacatggctggagtagggggctcacaatcatggcagaaagcaagggggaagcaagacacatcttacatggaagcaggcaagagagagcttgtgcaggaaaacccccatttataaaaccatcagatatcatgagccttattcactaccatgaaaacagtatgggggaactgcccctatgattcaattatcttcacctggccccgcccttgacacatggggattattacaattcaagatgagatttggatggggacacagccaaaccatatcatatactaagtaatttctttatagttataaatattttgaaggaaaaatattggatattatgagcatgggatacaccatctaatttggaggttgaaagatggctttcctgggaaaatcttagttttgtaaatatttatattcatgggtactaaggattgtaagggtaaatgaatatacacatacatacatggacaatcacctatttaggaatacttaagaatgatccaactgtgaatgattgtatcgggaagaccacatttgtggcatctgttctttttatgggaaattaccctttgttgtctaggttagcatattttaagtgactgttatagagaagtattttctcttttggagatctaaagatgtacgttctcttagtacatataagagtaagaatgaagagatttaacaaggtactttccttccacttcctctttgtgaaaacaaacctataaatgcctgtcattgtatagttaggagttaagctgtattcttgattggctgaactgactattaagtttcattttccctcaaaaaaagttttctaaataatgagtttagaataactgttcacacttgactgaaggttggtatttttggaataaatgcttttgggggtagagatcacacaagttcattagtactaaacttcaaatacccaagcttttatggtcaaacatgaaaaattggccagcattttcaatgttgcttccatagaaaactgtattctatgttagaagcattatttatactccaaatgcactttatgaaatacatgatatttctaagttggatatatgttatcaaacccagttatttctacagtttggaagcttttgtttggaagcttttgtgcatcttttttctttttttcttttttcgagacagagtctcgctctgtcacccagggtagagtacagtggcgtgatcttagctcactgcaacctctgcctcctgggttcaagtgattctcctgcctcagcctcctgagtagctgagattacaggtgcgtgccactacgtctggctaatttttgtatttttagtaaagatggggtttcaccatgttggtcaggcttgtctcgaactcctgacctcgtgatctgcctgcctcggcctcccaaaatgctgggattacaggcgtgagccactgcgacatcttacagtgatcaaatttgtccactttagaagggacaatgattctattacttgctgtagggaaattagtcttgttccaaaccctgctgataatgactgttttccttatcatattcctacatatgtgtctcttacaacccttcaagagaagaatgaaatcttacagtaggaagaaataacatattcttctcgttgcttgcacttatcctctgttttcttcttctgttgcactacattagagaattcttttgagtcagtgacagagtgatgaggatagactgaaccaattatttgacttgattttatatcttcttactggaatttatactagattgttttatgcttacttaaaatgttggatattcttagggacgtatacagctcaatcttattttaactgctggtttttttcttttgagtgcttcattgttcgttatggcaatttatattcttagaaattggtagtggacctgtacgtatgtacccggtacaaggagatgctcagtaatattttttaatgagttactctaaaccatgttttgggtgcatatgtatgtgtgcatgcatctatttgcatatggacatacactgaccagtctatattattaaactgtgctggtatttgatatagttttcctgtttttaccatttccatatcatgtaccatgttgcataatagttaagattttgtagtgttttgtgaacatttagtttcttagatttctgcatttcattcgctcccactttttcccattataaagggaatgttgtacaaagatacattgtatgatattctgaacattcattttaagagaataaactttggaaagtatagctttcatggaccttattttatgacattgaagattgcatcttatgacttggactgtttaatttacaattgtgtacatctgtgtgggtgatggatatttctggtgagtgtgaaatatatatgcaatgtgttattccatgtttacttctgcaggaaaatttcaacctaaatattactgcatgtaatttttaatatgcaaaaattcagttaaataaggtattggtgtgagtgactgttttcctatgagaggtgagtgtacattagataactcatatttttatctttggcttgggactcaggcaatagaaatgaggttgatattgtacccatgttcttcttgtcatatgtgttggcatggatttttggtttgttgagaacagatattttaatgtatttgcttaatttttaggagtttaggcatataacccaaaataaaattctttgagaaatgacaggaagattttcttttcacatcaaatgtctattaattactttttaaacagtggtaaaatcactctaaaatgttagaattttcatatactaaaagcaaatcctagcacagcaattcatttgagcaaattccaagaaaacatttttctcagttacattcaggttattttccaaattgcaaaaataggactttcctcaaattctgaattctaatcatcttgagaaaagaaatatatttgaaacctaaattcagaacacacttgcttgttagcaagaaagtcatgccaaagataatagtagttaaaatcttgtggaaggcagatggttgttgtaagacagatttttcagtttggattttaaatttaagtatgatatttgctttctttctggaaataccagaaagtttgctttatttcatctgctacatgaatagatgacaaaaaagaaaaaaattacaggctgacaaacactgaataattaggatgtgttaatttttcttagagacccatttatttcacaatgtctaaaataacgttaggcaaataccttctatcttatattgcatgtgctgttattttctcttactttcttcagacatctcgtggggaatttgactccagtgaatttgaagttaggagacgatatcaagatttcctttggttgaagggaaaactggaagaagcacaccccactctgattattccagtaagtttgcaaaattttttttttcatagaatagctaccagttttctagtgagtctttttgaatgcctaaaacctaatttcagaccttaagttcactgtaattcatttatcttaggaataatatttatttctaagtgtttcaatcaatgtacattttttttttaaaaaaaactcttcataatgtgttatgatttctcatttttggttctaacattgtgaatttttaaaaattatttttataagaaatgatcagatgttcaactagtcttccaaacagggaaagcgtagaattgcttataaacctatggctaataatacttgaatacctttttaattttttttgccttagccattgccagaaaagtttatagtaaaaggaatggtggaacgctttaacgatgacttcattgagacacgcaggaaggctttacataaatttttgaaccgaattgctgatcatccaactttaacatttaatgaagacttcaaaatttttctcactgcacaagcttgggtaaatgatttttatttatactcatataatctttgggtgtctgtatctatagtagattgtattgttcctcttgtttaccgttacaaatcatgcagtggtgtacttgaattgagatggaatttttcagaaacactggagagttatccttcagatataaccctgtgtcaaatctacatataaatattacagaaatcttgtatcttctccatatatatacacacacacacacacacacacactctctctctctctctctctctctctctctaatgtttttatgtcagggtgcttcttgcataaatagcaaatactgaacaggtataaatatatttctttcattgacactgtagttgacccttgaacaacatggcggttagggaagccaaccccttatgaaattgaaaatccatgtgtaacttttaatttctcagaaacttaactactagtagcctcctgttgattggaagccttaactgtaacataaacagttggttaacacatatgtataccttttgtgtattatatactgtattttttgcaataaagtaacctagagaaaagaaaatgttatttaagaaaatcctaaggaagacaaaatataccaacagtattctactgtatttattgataccaagtttatgttgtctgtttacaagatgaattgtcagtctgaaatggagggcaatgacagtggcagacctcagtctatggtacttagcaagcaattcaactttttttgtaatgacatgacttttctctgcttcttgggaacatttccagcatcactagtggcacttcatatgggtcccatggtattatttcaggtttatagtattgcactaaacacaataaaaaaaatacatgggaaccacaagagatcactttttactgctacacccaatttaatggagagatgaactactcacatggagatgatcagcgtcacatggcattttaagcagatattcacaacactggagctcaccacaaatagcaacaggagggctacaaaaatagtacaatagtacagtgtgtagtgtagttaattttaagcagttttgatttaatactgcatctttatgtttgtttacatttctctcaactgcatatggtggcatgtaagtcaaaatatgtgcatacgttttgataaattttaactttttataatagatttatacacattttagggtagtaaatgatagactagtatccacatacattttgtggattcatgacatacctttctctcagttttttctacatttctggactatgtggtttgtgaggtttttttagttgtcacaaatctccaaaaaattttccagtatatttattgaaaaaagtccacatgtgtggacctgcttagctcacacctgtgttgttcaagggtctactttattttgagtaataatggatcagggctttttaagttaggataaaagtccttattaaatgggtagatggatgaatggagatggatggatggatggatggatggatggacggacagatagataatataatctccttacttttcctttaattatctaagtgggggagtgtctaatttctaatacagaaaccttatccattctacttgttttttcttttattctataaagctataactctgcaagaaagataccagacaggacaaagggtcaatattaaacagttactggcaaatgttgagttttatatctctcagttgttgccagtggtagaagctaaaaagtggttcatttcaatcttgacagatagtcctctatggaagccctttgtgacttatgtgaaatgaatatgcggcctgacttcagaaccttagaagctgttagaaatattttctacagtcaacagtttcagtaacagcttgccagttgtgacgtgagctgtctctgataatgtttactctatcaaatgaggctgtagcactcttggatggatgtattgcctggtcaaggatggcatctgttattattggcacaaaagaaatcacacagaattggaaataaacaagtttactttgtatgtattctgcaagatattcaggaatgaaaacctgaaggaagatagacaatgtgttatttaatatttgggtaaataatatataatatttttatctgtaaattaggtagtcagcagtattttatttgatcatatattttattcgatcccaagcttgtgtctcaacaagggccacaatgattattaaaatcccttgtccttttttgtttgtatttgttcttttaacttatgccatacttctcaagggatatgtttctgtgcagtatattcttttataggatgttttctattttgcaagtctatagtcgtccctcctaggttaagtatgaaataactagtttcgtatcttattacaagttttctcagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcggtggtgggcacctgtaatcccagctactcaggaggctgaggcaggagaatggcatgaacccgggaggcggagcttgcagtgagccaggattgtgccactgcagtccagcctgggcgaaagagcgagactccgtctcaaaaaaaaaaaaaaaaaaaaagttttctctgtagacagccagttggtgaaggtggtgtcactgtttacccacttcatttggctgaagtgctatgttcaggtagtatctatttacaaaccatcctaatgactttaagcgggcagagcaagttggtgcttaataatgaagcctctggaatcagacttccaggattccagttcttgctctaccacttaattgctctgggatttttttttttttttttttttttttttttgagatggagtctcgctctgtggctcaggctggagtgcagtggcatgatctcggctcactgcaacctctgcctcctgggttcacgccattctcctgcctcagcctcccaagtagctgggactacaggcacctgccaccacgccaggctaatttttttgtatttttagtagagagggagtttcaccgtgttagccagggtagtctcgatctcctgacctcatgtatgccctcctcggcctcccaaagtactgggattacggacgtgagccactgcacccggcctgctctgggatcttgagcaagttagttaactttcctgtgcctctattttcttctgtaaaatgaggaaaataataaaacctacctcataggtttatggtgaattacgtgtattaaaatgtcagtatagtgcccagaatgtattaagctctaaataaatgttagctactattacatctaaagaattaatgaagttttccaattttattttttggagtataacttaggccctgagaaatcttctctcaatcattttccattaaattcctattataaaatatagatggtatgtcatattatccttatctcctctagtatctcattgagcactattctgtcggttaaaccctgttcttttaaagatttacggtctgaggaaagactatatacctgttttacatgagtagtgtgaaagggaatattattgaggctgccacttagaggaaacactgtaccttaataaagctcatctgcttcaagctaacattaaaaaagattgatgcctatgaaaccattttatcttgattttattctcctaattaggtttatttttgtattgagtctcggaatattgagacttgtttcactagaaatacttggttttttgtttctaggaactctcttctcacaagaagcaaggtcctggcttgctaagcaggatggggcaaaccgtcagagctgttgcgtcctcaatgagaggagttaaaaaccgcccagaggagttcatggaaatgaataactttattgaactatttagccagaaaataaatttgatagataaaatatctcagagaatttataaggaagaaaggggtaagtagaattactgaaatgtgatttcaaagttgttcagtttctgatgaatcttcacatttgttggtgtaatatagcaacattcagttagaatgtcagcttcaaagtgtggcttattcctagccatcttatggacatttctgattcctaaatgatttcgaaggtagttatggccagtctccattttcacttttatcaatcactagctgctctacttcccattcatagataatagtggtaaagtaagcccgagttaaagattgtggatgtggttgtttgtattcaacatggaacagagctcagaatcaaagaagtgatgtttcaggaaatagggttttcatattttctggtaattatttttttctggagggaacagatactctgtattaaacctgtcgaagtatggcagagagatttacgtattggaaaatctgcctcttttcctattttcttttttttttttagtttataaatcagaattgttggtgaatttttttctaattctaatcacgtgatgattttttcccctaattttctaattgcatttacttacattaaaaaatagataactgagtcagcaaataatttcctaatataatttgttattagagatgaggaactacataaagacaaacaaaagttcctaagttgatggcttatttgttaattgacctctacttaactgtactgccagtcaggataagctgggaaatatcttatttctagtatccgggcagtgtttaaacataataagtacttaattaaaatttgttcagtgattgaaaaaaaaccacgaatgaacataagatttggaatggtgtaggaaaaggtgctttattaagaattgattggttttaaaaagagatatagaaaaaaattataactgcatgtactttgccccttttctaactttttttcatgcattgacccctgatgagattactgtagtgactgaatgtagtataataatttattttaaacctctttggtttgcccttacatttattatttgtcttttttttttaacctgaataagtgaattattttaactaggttctgtgattccagttctattaagtagattctggatgcatagttaggtggtatggcaattcaaagagatgtctggaaactattggtagttaagagctttataaactatcaatgagtatcaaagagtaattaagatggtacctgttaagctcacagtctagttgggaaatatgtatattaacagataaattacagtgcagctaactaaatgtttgcatacagattgatttgagtggtatgtaagcacagtttagaattttagggcagctttgcatataaacataaatattgttcaggtttaatgactgacattgacatatattgagaaaatgagaaatttgagatttctcaattgactcaattgagaaaagaaagtggaaaattttcttttccagaaattagttcagtatggtcattatttaacataaagacaggcctaggatcaggaaggtggagtttggaaggactacagaggtgattaaatgttcattacataacaactagtatctccattgtttttaaatttcatatttttaaactttttatttaatacagacttttaaagttttagtagtttagagaaatatgacagatatcagcaaaccctaatgagttgtaagatggttaaatatagataatttgattgtatttatatggatagtgaacaaaaaacggtcactgcttataaattttccaccacaaaaagctatacatcattgaaaattaagtgtgaaagtaagaatgtaaaattgtaaagacagtcacattttaaaatgaaatccaaaaatttttgaatacatagcgtatcaaacactgaatggtctttggttactcatgtatgcattctttcattgatatgaaaatatttattgaactcattacatataagggtttgagatagaaaaataataagactcagtccctgttttaaggagtatgtggccaagagcatttgagttataagacatctataatacagtgggataatgctttaatagaagtataaaattatgataagctcattgagggccaaagcatctatgaatcctttggaacagaatcagaggagatttatttgaactggaatttaaaggattagaagtagtttgtcaggtgatagaaatggaggacaaggcagagggacatgtgcaaatgtttttgtaaagagaaatcatgggttattcatgaatgaacaagcaatttggcttgagttaaaatctttggcagagaatttcacattggacctggagaagcagacggtgaggactaatttaactaatttaatttaactaattctaatttagctacaaagagtcaatgtttctatactctgataaaaatagagggagaatagttaggagacccttgaagcagtacagattagagatgctgatggtggtggaagtgaagataagtacataggtagatggatagtttaagatctcgaagttttggaattggtgatttactggctctgtgtaagtatgattctaggataacctcccaattttttgcttagatttatggatagtaattaccactaagtagaatatatagtcagaagaaggggagaaagaagatgctaagtttttttcagggcatgttgcctgtcaggtactcagatatagttgtgtggtaggcagaagcctaaatagatatgatggtcatataatttatttttcaagccaagacatttttgacactgaaaaggtatgttattattgattacacttggacagtagtcattcaaagactgacctggggcaaactgtgatggctggttgatttaatgaaggatgatatccgttttcttatgttcttgtgtaagaacatgtgcactgtgagagaaataaggccctttcttactctctaggatacaggtattttgaaaacttttgtttattgaagagcttattaagtctttttttttttttagaatattttgatgaaatgaaagaatatggcccaattcatattctgtggtcagcgtcagaagaggatctggttgatactctaaaggatgttgccagctgcattgacagatgctgtaaggccactgaaaagcggatgtctggactctcagaggccctgcttcctgttgtacatgagtacgtgctttatagtgaaatgttaatggtaagaacacctaattctaattttacctcagtcccttacctgattataagctccataaaggcaactgtatttcttttctttaaaaccactatctttttgtcctagcaggttgttttgcatgtagatgttcaataaatatttattcactgtgtgtctaaatagatgaaggaaagaatccgttgttaaaaagcaggaatactcaatagcaacaccaacaatttatcagattatacgtagacttgaagcatcctcaatcaaaatttacatagggaatatgattagtttttccaaaccttgtgaaattttactttaaaattttttagtgctttggggattttgaaagaactgctctcctgcttctaggtacatttgatttagcaatatatttagtaccattatgtagaaagtacttgagttggatcttgatgttctgccttctggttgcttttaaaagaaatctttcaagttaaaatgtttttctttcactacttgaaaaggcttttattcctcttatatcaaagttttgcattttacttcctcagttcaagttaaggtttccagatatttggaatttagcaatgctatctgcaaagctaatatttttcatccagtatttttctgtgcctacaatactttacacaggcaaattggcaccctcagtgttttagggtggtgatggggacaggagtcagcttgcattcagatacagctccttttttccgttctttataattggaaccatggtttctttggacatgtacccttgatttctagagatttctttcaatttttttcttttttaaaaacttttccttgttttggtctgaaaagctcactttgtgtttcagcatgagatctgcctctctcttgttgatcatgtttaggtttagtttgacagagtcattaaatattgcacagacatttcaggctttggctgtacttaactttattggagtcctcctgtaaacaaagcttcttgcttcccaaaagccttcgatgtttcactgttgatgattctctttcctctctctatccatttccttggctacatcctttggtttcacttcattattggggtcacccccttgtgtcaatcttcaagaagatcagatttgtatgttctgttccattaattagtgttttctcctatattatatcaagatggaaattatgtaattgaagtattacattattaagggtatggaaaaataagaattattttataggtcctcgtttgattgaattaatttttagatgcctagggtataataagtagtacttatattgcatttcttgttctgtttgatattggaacattctcttcaatttcagctaaagtaatgaaaaataatccttccataaaaatgattaatttcatgtaattttcaccagttgtcctctgaagcaaccttttactcaaaatgtatttgtgcatatgaaaaccagtgcttcatcttttttgaaacaaaccttaaataaataggactgaattagagagtgagtcattttggtcaaagaaaggaagggctttcttgacattaatggtatttaaacattgaggtaaatataaaggaatttgagatatcagttgaattttctatggacttctttgcaactaggaaaaatgttagcttcctttgattttttttttttttaagagacatggtctcactctgttgcacaggctggagtgtagaggcataatcatagctcactacagcctcgaactcctgggctcaagtggtcctcccacctctttcttccaaagtgctgagatgtgatataggtgtgaactactgtgcctggcctgctttgaatgtcttaagagtcattccaccaggtgcaaaactgtactaagtgattcttaatccttaatgctttttggttatcatttaaatagtgtagagccatcttgtttgacctccatgtaactgatttgtgtctagtttctttccttcttctttaaaacaccagaaggcccttctcttttatgtcctgtacttctctagctggttgaattgtttgcttgtccaaacttagttttattttttccttaacctgttcaggccatttgtgcttcttattagaatttcattatttaatattgtgaaaaccagtaaaagatgagtacaaataaaaagagtccttgtatccttaaagtctaagttacatgtctcggaagaaatgtgaatcacttaaagacattgtaaaagttcggcaaaaatgaaagatgtagttgaattctgcactcaaatttcttcacatgggtgctttaagtttaaaaactctgaaacatgaaatcaagaaaacaagaaactcctatcaaagaggaggctatgatctctcatccaaagcttggctaactgatgaatattttatattttgagctaaaataaaatgcttaggatatgaatgcatacttcaattttctgatttcctaccataatttcctgtttgattatctgatcctttggagtcaggtaagaaggttgccacagagtgtagatatggtccatgtgacatcccacccataactagtttatgccatagtgtatttctccagtgcttctactattttttgtttgttttgctctttactatttttgaagaattgtacatgcgtattccaccaaatgtagtacatatgtacaatgcttaaatgggtaaaatgtgcattaggaaaactaataaaacatttataggaaaaaaaaccctcttaaatacttgctttcaatttagtttttagagagtaacaaaaaaaaaaaaacaactttttaaatgtattatatccccaaatgactgatggcttggggaagagatgctatttatattctgaaatatatatttttgctataggaaagattattaaaactaagtacagcctattttatctgtgtgttttaatgtaaagggtgttatgaaaagaagagaccaaatacaagcagaactggattccaaagttgaagttttgacctataaaaaggcagatactgatctggtaagtttttaagtttcttgatacaatcatatagaattcattgtctaaaatttttattagcaatgtccttacatgattgtccttacatgattgtttcttatatgattgtttctaagcattaagcaaattatagtaaaatttcttcctaaaatctgttatacattggataccatgtgagtctacaagcttaacaatgacggttttctgcctttctgacttatgtctcatactattaagaaagtataattttgtaaaaaggaaataatgtgttagaagaaagtatgaaaggcaatgctagcattattccaggctagtaagtactcagtaagtaaatctacttttttatagttttttgagatatttatatacattaatgttcctgtatacttcttttctaagtgttgttaaaatctttatgaaagggaatatctttgcgtttgcaagtttaatctttcccttaagatattttattatggaaattttcaaacaaaatgagatctaataatacaatgagctctcatatactcataactgggcttcattaattctcaccatttggctcaactttttttattgtctctcctcatttttaaatttttactgaagtattctaaagcaaattctagatatagattattttacccatggtatttttatatttatattttagtatctttgcattttcagagtaatactatcaggttggaataattattctcactttaaaggtgagaagactcttgaaaggtagagtaatttgcctaagtttatatataggtcttgaaatgcagaataggattggaggtgatgacgtctcttgcctgcctcagacagtgctgcctatcagaaagcaggtatagaagtgggaaaaatggacttttaacctaacgaacttctactgagtgcattatgaaatatttttaaaatttttctttaaatttaaggatttaggttgttattgaatacaatattgagtgcacttacatcaggtgagcgggggagtccttgaaacttccctgtaaatctgtaatattgcagcctcctcagccctgacctggccaaggactctgcatcccccctccctgctttaattttctccctaactttaatcacttcctaacatatgacttcctaattagttttctttgtatatttttctctctctttccctctccataattgaaactccttaagggcagattttttttatttgttcactggagtgctcccaggcccttgtgcactgcctggcacatggtagtcactcaataaatatgtagtgaaggaatgagtggaagccacagggactactctgatttgtgcaagcatattgaaggcttgaagcatgaagtctctacaaaatcagaatgtgcaattatttcattatttaattaatattgtgaaaaccagaaaagatgagtacaaatacaaagagtccttgtgtctacgaagtctaacttgcatagttctatgcaacttagaattattatactatgaattactctcacgtttcttgactatgtatattaactgaaattctgttctctccagtggaatgtgagtggggagtggtgggctgctgtagacagagtaggagaaaggaatctgtgagagggaataacagaaaatgtagaactagatgaactagtgctcaagggaaaactcatctttattatttagagagaaccccagattaaccttttctatttgataagaaacaattgactcctaacactctttctatatatagttaagaaacatatatatacatatgtgtataaacatatatatacatatatacatatagttcttaactatatatagagagagagttaagagtcaattagaattgactgtgaaaggctgcacatgtgtatagaaattgtaattgcatcttttgaattttagaatttgtttttaggtgttaagtaaggatatcgaagttagtggttagacaaaattttgctcttgatgaaatactagaaacagtagaatattttaaagtttcaggagaataatagcatggctgaaaaaccaagcatatgttaagaatggcctatattcatgttttaaaatgaaaagaagattaatcgggattgttccaaacacaaaagcacaaggaaaaaaatagcctgggtccaaatatggctgggatttcccaactcagttaaaaaaaaaaaacacattatttttccactgggcttgcaaatattttgtcttctgctgtataaaaatttttttgatattttgttataacttaatcagtgtatatttatgatttcacttgggtgtgtgtgtcatgtctactctaaagtgtttaatacccatgtagctgctacattgtaagactggaaaaatttgaaactttaattatctgcattatattctgtaagatacttttggttgattaagtttcaaaacagacacatttaacagagagattgcaggtatttttttgtttatcatcaaaacaaatttttcctaaagtttatggggactgagttaatgatttgtgaatggaactgtttatattttcaaataattaatttgtttataggccttctcacttttaaaatccctgtgccttatgatggtatcttcaggagaaatctaccagagttactctaaaaatgaaccggccttgattggtcacagaaagactgaaaggaagttgcttagaaatatgcaggatagggtcaccatggcaacgtgcccttgtgaggtccttctaaggagccatcctttgcagtcaccatggcgaccctggcagagaactgaatatagctgtctgcctggttgtttaccatggcaactcagacagggccattttggagacaacccaggggccatttctatggagacattggggcagccttcagagactccatcaaagtcacctttgggtgggatgctacgtgcaaacccagcaaagcaactgataatgaaaaggtcagtgaaatgaagctctagtaagaaaagcaaagattagaggagttatagttattgggtagaaagacagcagttatgtaacattccagaggacatttgactatgtcagatgacctttgtgtggattttgtggcatgcaaatacaagggctctggtctttttaccttgcctataatcctgcatttgaacaataatggcattacagttactttttcttaccacacagatatacccacaaaaggtatgtgtttttctgcaaactaaaataatatctgacagtgagtccttgatgcattacatggttagttgcaaagtggctccttcttagagtttgtggtttgtagttcttatctcacagcaataaaattaatggtttcaaaattacctaagtcagtaaagacattcggaatattcatttgaaggtcagttcagctgttcatgtagagttttgtcatctaagctttggaacttgataaatcaaagatcaaatcctagcttacctgtttatgaattttgtgacccaggacaagttttctaacttctttcagcctcattttatcatgtataggttgaggaaattattagtacctttctaataggcttgtttaaggattaaattgtgtaatgcaaataaattgcttggatcatagtaagcactcagtagcttttagctgttgtcattttgatgacagtatagaggtaatgtttgagattggtcctataaaatgactatggaattattcattgcaaagcacaaggaatatttcaggtagaatgggtattatgaaaagctttagaagctcaaaaagcatgctaaattgattaaaccagattggtttgtggaggggagggtacagtaaggaagaggggatgtgacttaaagatggactgtagtcaggtgggaaggaggccttatctgtcaggttgagaaatatgtactttatcctttgctcagtatggatgcagtgggaacctgaactgaagaggtggcagtggagttgcagagaagagttaatatgagaaagacgtaggcagagggtagaatccacatcacttaaagaatgaagggcagccaatgtttcaagttgttaataactaacatttctaacttgcagcagggcagatcgtggctctctacactgagctacagaataaaaagtgaagaagaaatctggaggtgtgcagctttacataatgataagatgatatttaagatgaggtattcaacaaaaacttttcagcaaagttaattgactatttaccatatgaacgtcactgttcccagcactggggaaagaaaccaggtcctcatgaggcttatgttttagtgggttaaaaaaagagtaaataattaaaatttataatatattatcatatagtgataagcgtggaggagacagagtgttgaggagcagtgcaatttaggattaggggtcagtaaaatattcaccaaggaggtaatgttttagtaatatgtgtacctgggggaagagcctttcaggcagaggggacagtacatgcacaatgaaagtatgcttgtacattccagaagaagcaagaagaccagtgttgcagaaatgaagtgagcaagtaaaagagttgtgggaaatgaagtcaggtctaaccaggggttagaccatatagagctttataaggttttggtctcagtgagataggaaaatagttgaacagaggagtaacataatcatatttaagttacaagatgattattgtgcttggagaaagcacaagatgatgtgcatgtggtatgtgcatgggatggaggaaagccagagccggagagtagctcttaaagtatttccagtgagacataatagcttggaccagagcagaagtgatgttaaggggtcagaagctgagtatatttcgcaggaagagctgtttgctatttggtgggctgtggatcgtgagccaataaggagaggcaaggatgattctgaggttttagacagagcaactggaaggtaatagttggcattaattgagatgaggagactttggaaacaacaggtttaatggggaagataattttctcagatttggaaaggtaaagtttgatttgcctattagtcacccaatggagctattgagtagggagttacatgtaaaaattcataggttcagctgaagatatgtatttggaaattattagcaaatagatggtatttaaagctataacatttgtcaaggtcattaaagtatgagcctttactttatcctgtcagagccttggcatatttcaacattaagagattaatgataatggaagaatcagaagttttggctgaggaggagaagggaaagaatttgatgtagctttgtctggtgatagatcattgcaccagtaagattaactaaacggatctgattagggtcatccaactttttaaaccatttctccatttatgaggcatttcaaaaaataatttgatatatgataattaaaatatttcaagagtaattgagttgcattatgtgcaccagtaaagaagatattcaatgtgatagataccatcctatgaaagccataatttttgactgggatgataaaggtataataataactgagattatgaggaaactcagatatttggagaaacttgtgggttttgccattttgttataagttttcagagtcagagcttctgtttgaaaatgcttattcacttcactgcttaactgtaaaataaataaggttcatctgtggtgctaaataatactgcatatctattttatttttatttctgaatggatgatttatagttttccactgaaagcagcattcaaatataaatgaatatgaatacatttgacatttagcaatatgtgcatagaattggaaagttggatctagatataatgccatagctgtttagcagtatatttatgtgagcaaagaaatgcattttcataagatcatcatagtctggaattttgcacagccacattcagtagatagaaacagataccagattattcaagctggtccttattcagtatgacatgctatttttggctggtgttttactctcatccttaaatagaggttattaattttcagatgatcttggtagtgtataaatggtgcacagagcaagattgccttctctctctaattctaggaagctttaaagaaataattttgacatagcaagccttgcttgtgatcagaggtgaaggttgcttcttccttttcttaaatattttctggctcacttctctcctgaactttttacaaattattcctttctatatgcctcatttcctaatataatctgttttctactctgcttctttttgtctgtttacagctatgtgtctgtctctcatgcacagatacatatccatccacacatgtatacatatacacacacacacagcagtaaagaacatgacagtgtccagtgggatgagaaaaggctttttttcttgcatatttccttttatcagtttatcctaaaaggcacctggctgacatttcctcaaaacttgttggtcagaattgtgaaaagtcaggatcaaaccagtcacatggagtgggaatgtggccatcagaatttacttatcagctacaatacacacccagttacagatacctgaaaaaactggggcctttgcagaacgtaacgtggagagtagaggatggattctgggtaaaacactaataaatgctggtcacagacagtgcagcagggtagtgggtttgcacacacacagctggcggggaatttggaatggtgcatgagtgatgctgtaatcaagaaggccctcagcagccagctcctcccagaagaaagtaccagggagtacctagaattcctctccctttctgtcttctccggcagccctgtctcattcaaggcttcattggcttgagtggtaggtacaaaagcaaaactgtgttctcctatttatataaacttgtaaaggataataatgaatatttgattaaattgcaaaaatcaccgtatctaccttatgaataggagtctgttgagcctgagatctctggttggaattttaccatattggatttttctctctgtcatttatttttgtgcccctggccacttcccaacagagcagtctctgtaaagtatttaatataaggtcttaatcccagttgcagagttgtgtgtaatttaaagcacagcattttgtggcatctgggccatttactgcctttgtagttctgggccaagttccttaacattctccatactttagtttactcaactgtgagagatgtgggtaatgccttccgtagagtgttgttaaatgagcatattgaaaccttagcccagtgcctaaccaggattagattgtaaatatttctataaacgatgttaaaggaactttctttgaagtatatattagtttcattcttctagatcaaagtttggaaagtgttaactgcagtcctgcttctgagacctccacagtgttaaaataagaaaaaagaaaaagcgaggcagcaattagctttagctgtgtagtgaccactcccatttgccctacctggtcgctctaggcagttgcatagatactttaaattgtatctgaatttatgcagactattgagaggttgtgctttggactcctacggaattattttaactcaactcactcgatgttgtaccattgatgcatcagaaggacattttaaggagaaccataaatctatttatgataaacatcaacagcactattttatatttttcttttatgagacctcatgagaaagctttcatttacatctcagcaccagcaatatggtttcatttctcctgagtagctagtgtattttcagcttgtacacatcttgggttttatatctgatcttatcccatttatctcactttttacagtagttactagactattgagagccccaattctgatccacttctgtctagaaagtgtgtcttttttgtgtcaaactcacccttggctttaccttgtttttttccttactctcatgttctcattgcactaatgtctttactttctgtctttaaacttgtagagtacaattgtggaagctctcttatatggaatatggaatctaataaggaataaattagaaacaaattaataagaactagaggtaaagtattccaaatcattttaaagaccacacatttcttacaacatactgtgacccaccctgcccaagtgtgtttttagtcatttcttttgaaattcataaacagcagcatgtctgttatgaacacaaacctgaacacggaatgactcatgtaaccgttacccagaaaacttgtcaagagatattagagggtgaggtgaaaaataccgtactattttcaaaattttaccaatgaaatttgcttagggaagtaactgcatattaaggtttgctaatttgaaagtagaacataaaaatgtacagtcttgatgaataaggcctgtgtaggtttgtggtgggtgagggtgaaaggggagaagaaggaagaagacaaagactgtggaaaaagagaggcagcgtaacaatgttgcagataatttctaacgaaagactaagctctgtgtctttctctaggaagattttttttttctgttgccttaactgcaaccgaaaaagtaacagatggacaagtaaaaggggtagtttaaaattccagtcatttcttctcagggttttaagaaattctacttacggtgtcctttggatttgtggtgtgttttatggggtttgcctgccgtagatagaaagtttaaatagctttcatatatagaaactcaaaccagattcaatttctttttaatttagactttttgttaataagaaatatgtcctaaggttctgtcttacgtatctctttcactcctggccctgcctgggcacttaataaatatttcataatgcttagagcagtaacacactaggaattagaagccaggagaaggctttgattcacttttatttaacttgtgaccttaatcagacattaattattctttatccattaacatgcagaaattacgcttaaagaattttttttgaagatgaattaacgtttatatatctaggacttgtgttagtaaaaattttggtaagttatagtatgaatatgtaaaatgttagataattcatcatagtgttataaaacattatttaaagtataaatagttattattttgagacagaatctagctctgtcacccaggctggagggcaatggcacgatcttggctcactgcaacctctgtctcccgggttcaagtgattctcctgcctcagcctcccaagtagtggggattacaggtacacgccaccacgcccagctaatttttgtatttttaatagagacagggtttcgccatgttggccgggctggatctcgaactcctgacctcaagtgatccgcctgccttgacctcccaaagtgctgggattacaggactggcctaaagtataaatagtttagtactaaaaatcaaaaattgtattcccaccaaatagagaaccagtagttttcctctagcacatttggatatattaaattaaatgcattttgatttattacaggcataccttggagatactgtgttcagtttcagactgccacaataaagcaagtcacaagaaatttttggcttcccagtggatataaaagttatgtttgcactatactgtagtctattaaatatgccatagcattatgtgtaaaaaatgtacataatttagttaaaaaagatgtcattgttaaaaatgctaatgatcatatgagccttcagagagctgtaatctttttgctggtagagtgtctttcctttatgttgatggctgctgactgattacgtgttggttgatgaagattggggtagctatggcaatttcttaaaatatgagaataaggaagtttgctgcagagattgattttcctttcaccagtgaattccccgtagcatgcaatgttgtttgatagcattttacccacagaactgcttttgaaattggagccaatccattcaaaacttgccactgctgtatcaactaagttttcataatattctgagttctttgttgtcattttaagaatactcacagcatcttcaccagtagatcccgcctcaagaaatcactttctttgctcatccataagaagcaacgtctcatctgttcaaattctatcatgagattgtagcaattcggtcatctcttcaggctctacttctaattatagttctctactatttctgccacacctgcagttacttcctccactgaagtcttgaaccctttgctcaaagtcatctataagagttagaatcaacttcttccaaattcctataaatgttaatattttggtctgttcccatgaatcccatatatttttcatggaatctagaatggtgtattctttccagaagattttcaatttactcagttccatcaagggaatcacaatctatggcagctacagcctgacaaaatgtatttcttaaataataagactcaaaagtctaaatgactcattgactcatggactatggaagttacattagctgacatgaaggcagtattaatccccttgtacatttccgtcagagtttttcagtgaccaagtacattgtcaataaacagtaatattttgaaaggaatcttttttcctgagcagtagatctcaagagtgggcttaaaatattcagtaaaccatactataaacagataactctgtcatccaggctttgttatttcaggtatagagcacaggcagagtagatttagagtaattctttagggcactaggattatcagaatggtaaatggacattggcttcaacttaaaatcaccaactacattagctcctaacaagagagtcaggctgtcctttgaagctaggcattgacttttcctctctagctatgaaagtcttagatagcatcttcctccaatataaaacttttgtcagctgggcacagtggctcacacctgtaatcccagcactttgggaggctgaggcgggcacatcacctgaggttgggagttcgaaatgagcctgaccaacatggagaaaccctgtctctactaaaaatagaaaattagccagacatagtggcacatgcctgtaatgccagctacccgggaggctaaggcaggagaattgcttaaacctaggaggcagaggttgcagtgagccgagatcgtgccattgcagtccagcctgggcaacaagagcgaaactctgtctcaggaaaaaaaaaaaaaaaaaacttgtctacattgaaaatctgttgtttgtagtgtagccatccttatcaatgatcatagttagatcttctggataacttgttataacttgtacatcagcatttgttgcttcatctggcatttttatcttacggagacagcttctttccttaaacctagtgaaccaacctctgctagcttcaaacatttcctctccagcttcctcacttctcctagccttcataaaattgaagagttaggacattgctctggattaggctttggcttaagggaatgttatggctggtttgatcttctactcagaccactaaaactttctccatatcagcaataaggctttttttttgctttcttataattcatgtgcttattggaatagcatttttatttcttccaagaactttttctttgcattcagaacttgtctaactgttctgtgcaagaggcctagcttgcagccagtctcagcttttgaaatgccttcctcactaagtttaatcatttgtagcttttgatttaaagtaagagatgctcaattctttctttcacttgaacacataaaagccattgtagggttattaattggtcatatttcaatattattgtctctcagggaatacgaaggagaggaacagagacaggagaatggtcagtgatacagtcagaacatacacatttatggattagattcactactttatatggacacaattctgccccctcttccaaattacagtggtaacatcaaagactgcttatcacagatcgccatcacagataggataataatgaaaaagtttgaagtgttgtaagaattaccaaaatgtgacacagacacgtgaagtaagcacatgttggaaaaatgatgctggtaggcttactcagtgcagggttgtcacaaagcttcaatttgttagaaaaaaaatggaatatctgcaaagcacagaaaagcacagtacaataaaatgaggtatagttgtataattagtagactttggagagtaagccttttctctctggtgaatcttagtcagtagtcaatttagaggggtgtcaatgccccagtcacatggctattcaactttcagagaatttctagacccaaactagtgttttcattttataagcatatttaacatctatttagtacatgttgtatgccaggcactatgctaagcattcacatatatcagccaatgtctaatcctgtgagataggtagtaatttgttcccatttttgtggacgggaaaattgagtcctagagagtcaatcagcaaatagttcttggctccttaagaagactgaaaaagcccgtctccctaggagcttattctctagtggaaggatgctgaaaataagtaaaaaaattaaatgaatatgataattttagactgtgattagtgctataaagagaataaaacagggtaacatgataaagaataccaggaggggaagtatctagagtgatcagagaaggcctttctgaggagatgaccttgagaagagagctgaatcatcataaggggccattgatccaaattctggagcaccagtgttggaagaaggaggaaaagccatgatcctctgaaatgagaatgaattcacatgttccaggaggtttgttaggttgcaagtagctagaatatgaaggacagaggcgcagcactatggcatgaggactgaaagcgagcggacgaacaatgtgtaggccttgagttttcttctgtttgcaatggagagcccctgaagggtttcaagtggggaagagttgtgatttgatgtgttacatgtttttaaatttatttccaagtgacaaacttacagaaaatttgcaagtacacttcaaagacctgcatttcttttgaaccattggagaataagttgtaaatctaataacctttgaatagtgtgtttcttacaaacaagaatattttcctatataactatagtacaaccatcaatatcaataagttattgatatatttatattatcaaatgctcagacccattcaagtttcaccagttctctaatgtttttttgacagtatttagttagatgtctccttcagtctggaacagtctttcatcttcccttaactttcatggccattctacatttgaagattattttgtagcatgcctcctattttaacttgtttcatatttccttaagcttagatttatattatcagtctttgacgggaatgtcacttaagtgttactgtgatcctttcattgattctttttaggtagtatatgatgtttatttgtcccattaatgattctgcaccgtttgatgactgattaaggcaatgtccgtccagcttctccactataaaagtcactctttttccaatgtaattagtaagtgttttgtggggagcgtctttgagactgatgatcccatgccttatcatactttaactttcaatttattcatgtatgaatttgtttttattttaagacatgggttttattatcattacttgttttgatgcacgagttacccaaatttgatgagtgggaccatcttcaagctggcttctatgcccttttgatatgttcacatcattttgatcacctctttgcttctgatacaacaaaacgttctgactctcgtatgctttacctggctcagccctggaatcagttatttctctaatgagccctggttccttttggtagaaaaagttatgtttagaatacaatatcttggcattagatgtgttcattgctattgaggtatcactatccaagaccttctgtatgagcagagctagggagtatgtctgtttaatcatattcacacacacacacacacgtttttatatctatgatgtatttctgtatttacatatatataaaaacaatgaatttacaccagtgcctccaattttaatctagttatagggattcattcttgatatcttttattttccgtatttgtagttccctttctgacagcgagagacaggctctcatcttttttatatctacttatttgattaatccccctgtatataaccaatcctgtatagcccaagtcatctttcctaagttggtggcacttcccactccacttgggctttcacaccctgcaagggccatacctcctctttaacacacttctgtttccccatggtaggtttgcctcctatccccatatggtgccctcttcatcctacttgggcagttactccctactctaggccactgtttgcaggaactacctcctcatctcgctgctttgacaatctgtactaggccaccatgactttgcctccttttctccaccagtgtggacattagtcttgttctacctgcagtgattaacctttagagctgagttgttcatgaagggaaaagagaaaggaagagtttatagttgctctcaaatgctcattatgtttcctgcatgggaaaacagaaagctgtgttgaatccactaccatgagtagggggtgatgatggcataaaaaaagaaggtagtagtggagattttgataagaaagttaagtgatttgctcacagttatacagctagttaaatagaagagccagagttgtaacctaactctgtactccctgatgtatcataaatacaattttttttttcccaatgggtgggtctgaagtccatggagatgagaaaattttaaggcaagtaacaattatctgctactaaaatcaaagcaaaaaggaataaaagtttggtgttttcttcttttatcttctttaaaaaatatacttagatttcataataaattataaattgcaacttggaaatgctttgaaatacatagggagatgagaaaattttaaggcaagtaacaattatctactactaaaatcaaagcaaaaaggaataaaagtttggtgttttcttcttttatcttctttaaaaaaaaaaacttggatttcataataaattgtaaattgccactgggaaatgctttgaaatacatagagttataattatctcagagagttgaaagtctttttttctttcaaggaattattatatggaattatgtgttaactagatcaacaagtcatactaaaactaattgatgataataataataatagctaacatttcttgagcacacacgatgtgccaggcagagtcctaaatgttctgtgtgtattgtttcacttcagtctcacacaatacaatggggtgtaggtactattattttcctcattttataagttttatatgttttataaatgtcacagttgaggaacagagaaatagaattacttgaacaacattgcacatgcaggaatttttgaagcagaacttcagaaattgtgctattaactatatttcaggacttcaaaactgtattccaagacgatacttgtacatagcctactactgctttacccgttgcagaaaccgctatatctaatcccagaacaatcctcagaaaatacttaccaacatgcttcaaataattaataccaatcagaatttgcacgtgataaattctctttgccagaacatcattggtgacttgaaatattttattacagtgaactggcagtcttaatagtgtttattttaggttaaattgacctgccttgtttatctctcagtcacaaagagggtatgaaatgagataaggaggtacagtttctttccttaatgtatgtcagtggttctcataagcagtgtgggtagggagagggtaagaggcattttcaaaatacacaaaattacaaagatagtgtccttcccagggggcagattctgttgcttctgagaccttcttatttagaagcttttaatgtaaacttagtgagaaaaaagacatatatccgtgaaatgcattcaaaataaaccttaatgcatttaaagagctgttgcagacccttgtaccaggaaaatgcaagacatataatgggcactccataaatgaggaaatgaaaggggcatgcacataggtcagatggtaagagaagtgccagatgtgcgaattacttattgcacatagaagtgcaaatgtaaggcttccctaacacacttcctgaagaaggtccctcaccaaaaaacatagtttttgtccaatgtcaaatttttagttacaatatttaaattaactttaggtcaagatcacacatgaatgtgtggtttttagtatatattaaataatacattaatatagaaataacaccttttccactttcacatgcattttcaatacttcttttatcatctaacacttttattggaagaggaaatatatacacacatcaggaaaaaggaactcagagtctccatttttatgccttattttctgaatccagatgtaatgtgtccctacaaatattacttcccaacaaccactactcatttatataacattaggtacttcaacatttcattcatcccgtaagatatatagtcttcagctctaacataactaattagtgcattgcttataaaaataaccccaaattatgatttatttgaaaagataatatattcacatggctcaaaattcataaatttagaaaacacacccagtgaaaagtgtgcccatcccaatatcctattctcccaagtcccactacccatgttattagtataagcacatcctattgttagttacttctgtagccttccactttctttatgcatatgcaataaataccaatatacattctgactttttaattcgtgtggtaatacactctaaagatttctgcactgtgcttttttaatgtagtaagatatcttggagatcattccatttattgatgttttacagctacatgatatcccattgtatggctgtgcagaatttatttaacctgacccctgctggtaaatatttatttctgatattttgtgactataaataatgctttaatgaagaattttgtacacgttatttgtaagtataccagtagatctttagaatacttagaagtgaaattgctaaatcggagggtatttaattttgatagccctttgctagatgagtgatcttgagcaaattagctaacttctccatgcctcagtttattacttcgtggattagagataataatagtacctagctcatagtgctaaatgtgttaacccatgtagggtgcttagaatattgcctggcccataggaagggataaaagagttagctcttctgctgctgctgttcttgttaccacccagctgctgtccacagaaaagctatttacattctcaccagctggcttattcctgtaccctccacccgcagtcttgttaaggggagatatcaaaccgttgaattgttgcctcctcaaaagtgaaaaatggtatccccttgtaggtttaatttggcatttctcatctgatgagtggggttaagcattgctttatatatttaagtaaaatttgtattgcttttatctgtcagtgtctggtctttgttcattatattttctctattaattcttgatctctgtctttctgatttataggaacttcttattcgggaaattagtctttattttttatttatattgtaattttttgtactgatttttactagcagaagtttctagtttttatgaagtcaggtttatctatctttttcttaaagattttacctttaaggatgagttagagagtgttctacttcaggtgacagaaaaaaatgtctcgtggtttcttccattaatttttgagtttccttttttacaatagaatctttgagccatttgaaattgattcttataaatatgaggtttttgagtcaactatatatataaaatatatatttttaatggtatatatcaactataatatatatttcaactatgtatattatatatattattcaactgtatatattttaataactgtcccagtcgtacccgttatctattgaataatcatgttttccctagtgatttgatgctgccttcgaaatatacttaattcgttttcatatgcaacgatgataagactttctatatgttctcttggtctgttaatgctccaagaccatactgtgtcaataatggaggttttgtaatatgtttgataaatggcaggacttgtctacccccactctttgttcctcttgcttgtctatttacagagcttttaaaagtaaactataaaatatttataataataatcaaatacctgaatcatgagagatttcctagaaataactgttgttaatctttgtctcctttctttaaaaaataactccgttagtagactactatgtatatctaaaactaccattaattgaatttgcctcaggctaatatttcttataaaatattacctcatttttcaaaatgaagtgattgagaaaatattcagtaatattagagtatttctaggaaaacacatgaaagcaattttatccttattaaaggatacttttttgagtgaacccctaatttttatacttgagctatacatatgacactattccagttacatgatcacaactttctagagccatgctatacattatggtacccactggccacatgtgctgtttactcttacatttgaattaattaaaattaaacacaactaaaaattcagtttctcagtcacactagctgaatttcagtagtcacatgtggctattggtaccattttggacggtccagaatggaatatttctatcatcacagaatgttctatttggctggatttgttttacagtatgttgcagcattaggagctgttttttatatatggtagtttggttgatcgaatcaaagaagggagatcatttctcatggaagttttagctttggtagggattcagacagaaaagagatgaatgtctgaaagaaacatcaggggaattcacctgattaaaactacagtgtacacagtactagagcaaaaatactatggtagtcatcagactcttgatcacatactccatcaaataaatattttttaagcacatctcccaatagatgttcatttttaatttacagattatttacttgcacctcaagtttgtgttcccaatgcatttctccaaaacccaaaatgctccaaaatctggtactttttgagtactgacatgacgctcacaggaatgctctttggagcattttggattttggattttcagattaggaatgctgaaccggtaggtgtagtgcagatattccaaaatctgaaacacttctgatcctaagcattttggataagggatacttaacctgtactatactcatgttttacttgtgttataaactgtgcacgtaagtagacattaaagacaatgcatagcagttaaatataaatggaagttcctttgtgtagtattgtgagctgtcttgtatatgccttaaacctcatctacccaattttggagttttgtagtatgttaaggtttgcatcacaagctatagagaacctaggttctagatcaaagtttcaaaataagtcacttttatacttcaataagccttattttttcttgtaagtaaactgggaaaaataatatttaccttacagggtatattgagaactaaatgagataatatatgagatattgtttagttaagtagtgagtaaaataaaaatatttaataacagaaaattggcctgtgaagttctgtgaaataaataaattttgatttttggctttgaaataatttttaactttggaaagcctaatggtaattgaacatactgcttttctaggcttaggttatattttgcagaaaagtacagggaattacatctaaagaggtaaaggactgtgaatttttttgttttatttttaaggagccacatcatttctttttaatagaaatatattaatgactgatagaagcacctagaaagaagtgaatcctttatattctgatgtatatttagtggcttttgttgtatagaagattctgaggagatctctacctgttctaaaatgtggccctttaaataattggttttctgtttcctgcaatgtcacaaaaaattataatcatgatttgagggatgttaatggtgttgaaggtgctggcttgaaacgtgatgcgttaactacatttgtgggtgttttatgactcaatttgtcatttttagaaaatgcattgtgttttactgaacaagttacgtttggataacaaaatctgcagtgggtttcagagagagaggtttccactttttaagaaaagtatgtattgtaaagtatgtaaaaaaggtactacttagtaatcacatgtatgcttaagcagcattgtataatcaagcatctaatttctttagacacatctcacctctctcacgaatcagaaaataatacagttttattgttaagagccctcttatctttcccctgcaatttaattaatacttgttaagaagaggtagctgtcagattagaaatgaatttcagaattttctattgtcttctgatggagtggcaatcttaatccttttatttagatatattattttcaagaacttttcaaaatgataatttcccagcttttctgattatgaagagaaatttttagcatttgaataaatggattgaatggttgatttttttttccataaaaggaaataatagataagccatttaaaaaggaaaacaatgatgatatttttaagtaagaataactatcatcctcaaattttattattttgctcaaaaatgttggtgatatagcttccatttaaaaaggaaaacaatgatgatatttttaagtaagaataactatcatcctcaaattttattattttgctcaaaaatgttggtgatatatctttacgtagatacacatctatgtaaagaaataatactcataaagccagtaggagaaataagcctggattaattactaacctttcactttcctaaaatcacccattcaatctacacatatttaccagattcccacctagtgtaaacactggggataacaatgaaaagatgaatagaccccaggcccctcatggtagaccttacatcccaacagaaaagtacaagacaaataaataaaataattgcaagatctaatgaatgctaaggaaatgaatggactgagataggaaatagcaaaaaacaaagacaaaaaacaaaaagaacaacaaccctgctttgtacataaatgttttgggaagcattatctgggaactattatttaagctgagatgaaagaaaaccagaaaaagacttaaaatagatgatttgttttagatacttcactctttgaaactccttcagtatctctcaataaagttttaaacggttttttttccccaaaaaggctgtgtatactttttgttaaatttattactaagtaccttatttttttggcttgtatttatcataaattttgtattttaaaacattttatggccttttttttggccagaattagagaaaagtaattcacttttgcatacctattctatatttaatgatttaagttatttttaattttaataatttatagatgggttttctacatagaaaattctaggtcgggtgcagtggctcacacccgttttgggaggcctaggtgggcggatcacctgaggtcaggagttcaatagcagcctggccaacatggcaaaaccccatccctactaaaaatacaaaaaaaagcagctgggtgtagtggtgcatgcccgtagtcccagctgcttgggaggctggggcaggagaattgcttgattgatcccgggaggcagaggttgcgctgaactgagatcgcatgactgcactccagcctgggtgatggagcaagactttgactcaaaaaaaaaagaaagaaaattctattacgggtgaatattggcagttttgtcttatttattcaataattagacttcatattttctttttcattgttagctggcaaaaaaaaattataatgttcttagtgatagaacattcttgtatttttcctgattgtaaagtaaatgcttctaagatttttgtcataagtaataatgtttgctatagttttttatcctatatatttttaatcaggctggggcagttcttactcctatttgatgagagttgattcataagttaatatcgagctttcagaatgattttctgtgtctactcagataattgtacatttcttattattttcttgtggcaacttacactagagattttctcatgttaaccattcttggggccccgggtaaacccactctggccattgctgggtttggcttgctcactttcttttttaggacttttgtatccacatttctgaataagaatgatttgtaattatagttgcttctgccagaaatgccgctttttgtatcaaagttatgctagcctcgtaaatttttacatactagattaatttgtatgagaatgttattatttgttaatgaagaaataactcttttcataatgtattaggagcagacctcataagatgtttagacattaggggcttagtaataatattggaaagactctaaattttaattgtgctaacatatgaccttactattgtatgtatagagacaatcacggaataaggataaaggatgcttatttgctctagttctagattacaaaatcagggataagtgatggaagattattaattaaatagtcaacatgggtggctctttcttagagagagaactgaaatttctccctagattgctttttagcaataataaattgcagtgatttaaaaaggttttgactggatattttctgccattctggcagctattcctagagaaacagactgtagggaagctgatttctcaatccataatttttataattgatactttgataaaactgttagtgattatgaaaattaactcctctagaatcatcatgctaaagtatattaattatttattaaatgtatagtttagcagtcaagcagagtttcttttaacacatattttaatatggtgtacggttcaaacatttttaccaaaggagtttactttctatggtataggaaagttggaatatatgctccagtaagtctgagaggtaccccctcatgggcaatgcaaactcaaaatttctttaagctctcctgttttaaatcttgtgtgaatatcactactccatgatatatttatatttgttaatttaaaaatggtttaatctctgtaaaatatctatgaaaattattccatgtttattcatgactttggcgatccttaggccatcactgtgtgttgatgtagatataggaatcccaatttgagaaaaacatgttaaagcattccttagtggtctcatcgtgagactatatccggattggaaggactttgtgatattaggcaaatatttgcctctatgaaagaagtgttccaaaaacgaatgagaaaggaagaaaaacatttcacaagggggcactgtgcctggtatggtacttggcatgaagtaagtgctgaagaaacagttgttggttgagttaatatactttaaaaaaactgatctctaataaaaaactaaaggcctaaaaagatgtttggaagtcgaaagggatggtcttggcttttattcttcttagattgctagacagctttttttagttaccaggaagtatattctaaagtgctttcagattcagggggaaaacatccatttgcatatttttgtcttagggtatttacattccataatttgcaagacactaaaatgtcttggatttgagaggaataatttattgaggtagcgtggcaacctaagtttctaaaatagaggtaatttctgggctttttggcttcaactatctgatttggagaagggtcttactataatagaagactttttggcctgaaacatttcattgttcagttcacccaccaacactctcaggctttgtcagggctattgaggagcttactgagttattaataacatagctctttgtttctcctgtggttttcttttcttacaggtcctcagttccttaacacaggataagtgagagggcagattcatttaggacaattctgataccttaagaaaaatcttctcataatcacaccagggtgccgcattttacagagggggaaactgcaccctctgaaggaaatgaccttgtctgcattcacacagttaggactcgaacccacaggacttcagagcccagactttagatcactgactgataaatgtgtgtctttgtaaatttttaaagttcagtaagaaaggagcaagagaagcaggtaacaccaaattgttaataccctaaggcaactgagaaagatggaatgttatttcttcaaagtggagctgcctgagtggccagtataatctgagtcttgacctaaagccagaagcatttgttattaggagacaggaaacttatcgttgaggcaggtgttgcatcctcttcataacaggtacatgtctttctcaccacatgtagcagagcactggacatgtaaaaatgtcctggaaataaagatgtcattcaactgagcttgattatgtctgattgtttacttatctatattagtatgtaccttaatttcatcaagtgaatatttagtccagtaaggaatatccattgaatatggagatatatttcctttttaaggggattttttttggatctagattgtctggatttcttaagatttagtttggagggtacttattttattttaaaaagaaaactcattgagaaactctaaggcaactgttaaggtagaatgccagggaatgcccagtgcaatgtgaatcttaagtccctgctagactgtaagctcccagaggcaggaccttccctctcatattcatcctgtgccctttgtcctgtgtctaggccaatgcctggcacataataggcacttaaaaataaagtttttttggccgggtgcagtggctcatgcctgtaatcccagcactttgggaggctgaggcgggtggatcatgagatcagaagatcgagaccatcctggctaacacagtgaaaccccgtctctgctaagaatacaaaaaattagctgggcatggtggcgggcacctgtagtctcagctacttggcaagccaaggcaggagaatggcgtgaacccgggacgtggagtgtgcagcaagctgagattgcgccactgtactccagcctaggtgacacagcgagactctgtctcaaataaagtttttaaaaaatgattgtttacttttctaccaaatttattttgcaaaccacagcagccctgtagaagagaggcctgactgttaaaagaaaaacaaacagcagcaacaacagcatcaataaaagtgtccccacaaaaacccatccaaagctcagcaacctcaaagattaaaggtagataaactcaggaagatgagaaagaatcaaccaaaaaatacacgctgaaaactaaaaaagccagtgtacctcttctcctccaaatgatcacagcacctctccagcaaggccacagaactgggctgaggctgagacggatgaactgacagaagtagacgtttcagaaggtgggtaataacgaactcaactgagctaaaggagcatattctaactcattacaaagaaggtaagaaccatgatgaaacattacaggcattacaggagctgttaaacagagtaaccagtttagagaggaacataaatgacctgatgtagctgaaaaatgccacatgagaatttcacaatgcaaccatagtatcaataaccgaatagaccaagcggaggaaaggattccagagattgaagactatcttgctgaaataagacaggcagacaatattagagcaaaaagaatgaaaaagaatgaacaaaacctccgagaactatgagattatataaaaagactaaacctatgactgtttgtggtacctggaaaagatggggagaatggaatcatgttggaaaagaaacttcagaatatcatccaggagaacttctctaacctagcaggactggccaacattcaaattcaggaaatccagagaatcccagtaagatattccatgagaagatcaatcccaagacacataatcttcagattctccaaggtcaaaatgaaggaaaaaatgttaagagcagccagagagaaaggccaggtcacctacaaaggaagcccatcagaataacagtggacctcttagcagaaaccctgcaagccagaagtgtttggtggccaatattcaacattcttaaagaaaataatttccaacccagaatctcatatctggccaaactaagcttcataagtgaaggagaaataaaatccttttcagacaagcaaatgctgagggaattcatcaccaccaggcctgccttgcaagagctactgaaggaagcactaaagtctataaaataaccagctagcatcatgattacagcatcaaattcacacatagcaacattggccttaaatgtaaatgggctaaatgctccaattaaaagacacggaatgtcaagctggacaaagagtcaagatccattagtgtgttgtattcaagagacccatctcacaggcagagacacacataggcttaaaataaaggtatggaggaaaatctaccaagcaaatggaaagcaggaacaagcaggggttgcaatcctagtttctgacagacagactttaaaccaacaaagatcaaaaaagacaagggtattacataatggtaaagggttcatttcagcaagaagagctaactaatctagatacatatgcaccaaatacgggagcatccagactcataaaacaagatcttagagacctacaaaaaggcttagattcccacataataatagtaggatactttaacttaccactttcagtattacacagatcatcaagactgaaaattaacaaagatattcagtacttaaactcagctagggatcaagtggacctgatagatgtatgcagaattccccaccccaaaatgacagaatatgcattcttcccagtgccacatggcacttactctaaaatcgatcacataattggaagtaaaacattcctcaacaaatacaaaagaactgaaatcataacagtctctcagaccacagcacaatcaaattagaactcaagactaagaagctcactcaaaaccacacaactatatggaaactgaacaacctgcttctgattgactcctggataaataatgaaattaagtcagaaatcaagaagttctttgaacaaagaaacaacgcaccagaatctctaggacatagctaaagcagtgttaagagggaagtttatagcactaaatgcccacttcataaagctagaaagacctcaagtcaaaaacgtagcatctcaactaaaagaaccagagaacaaagagcaaacaaactccagaggtagcagaaaacaagaaatagccaagatcagagtggaactaaaggagatagagacacaaaaaacccttcaaaaaatcagtgaatccaggagctgattttttttttgaaaaattaatattagtaatgaagaaaagagagaagaatcaaatagacacaataaaaaatgatgaaggggatatcatcactgaccccacagaaacataaacaaccatcagagaatactataaacacctctatgcaaataaactaagaaatctagaagaaactgataaattcctggatacctagacactttaaagactgaaccaggaagaagttgaatccttgaatagaccaataataagttctgaaattgagggagtaataaatagcctaccaaccaaaaagcccaggatcagacagatttacagctgaattctacaaggggaacaaagagaggctgttaccatttttactgaaactattctaaacaactgaaaaggagggactcccccctaactcattttatgaggccaacatcaccctgataccaaaacctggcagaaatacaataaaaaaagaaaacttcagaccagtatccctgatgaacatcagtgtgaaaatcctcagtaacatactggcaaaccaaatccagcagcacatcaaaaagcttatccagcatgatcaagtaggcttcatccctgggatgcaaggctggttcaacatatgcaaatcaataaatgtaatccatcacgtaaacagaaccaaagacaaaaaccacatgattatctcaatagatgcagaaaaggccttcgataaaattcaacatcccttcatgttaaaaactctcaataaactagatatgaatggaacataactcaaaataataggagccgtttatgacaaacccacagccatatcatactgaatgggcaaaatctggaagcagtacccttgaaaaccagcacaagacaaggatgctgtctgtcaccactcctattcagcttactattggaagttctggccggggcagtcaggcaagagaaggaaataaagaatactcaggaagagaggaaatcaagctgtcttgtttccagatgacacgagcctatatctagaaaacctcattgtctcagctgaaaagcttcttaagctgataaacaacttcagcaaagtctcaggatacaaataaatgtgcggaaatcacaagcattcctattcaccgacagtagacaagcagagagacaaatcatgaatgaattcccgttcacagtttcacaaaaagaataaaatacctaggaatacagctaacaaaagaagtgaaggacctctttaaggagaatgccaaaccattgctcaaggaaatcagaggacacaaacaaatgcaaaaaacattccatactcataggtagaaagaatcagtattgtgaaaatggccgtactacccaaagtaatttatggattcaatgctattcctgttaaattgagctggaagccattatcctcagcaaactaacacaggaacagaaaaccaaacaccacatgttcccacttataaatgggagctgaacagtgagaacacgtggacacagggcggcagaggtggggaaagagaacatcaggaaaactagctaatgcatactaggcttaatacctgggtgatgggttgataggtgcagcaaaccaccatggcacatgtttacctgtgtaacatattcccctctcaggaaaaatagttttaactaaaaacaattcagaatgtattcctgcctttttttttttttagaatgaacaaaagaaaactccaaagtataggaatactgttttttataagaataaaaattttttaaaaagtataagaatactgttttatttagcttcaagtgcctcaaggaactatgtgcttattggattgtatctctcataacatctaccatgtgactggcccatagtagacaggaagaatatttattaactaagtgaatgaacttcatagttttagttcataattctcacaaagtagttttcttggtgagcatgagctgcttcagaattccctcatgttgccgtctttgtctttggacttcagtagaaaaattttcagttatttttcatgtcaaactttccataactcaattactatacagtcatatgttattaaatgattgggatatgttctgaaaaaatttgtttttaggctttctcatcattgtgtgactattgtagagtatacttacacagccttgagatgtcatactctgctgcacaccaaggctctgtggtgtagcctgttgttcctgagttaaaaacctgtatagcatgttattttagtccattgaaacacagtggtaaatatttgtgtatctagacatagaaaaagtacagtaaaaatagcatatgattatcttatggaatcactgtcatatatgcagattgtcattgactgaaatgttgttatgtggcacatgactctacaaagtttcctgaatttgtttgcatttcttattaacttgattctgctatgggtacatcaaacttaaagcttttatgtaattaaatgtaagttttcagatagccctgaaagcttagcacttcaaaatgcagatggtccctgaattctgatggttccatttaggattattcaactttaagatggggttaccgtttctattgaatgtggttggctttctcactatcctaaagtcaaaaaatcctaagttgaatgattttaatttggagaccgtctgctgtgttgccagcattaaatacatttttggcttacaatattttcaactaacagtgggcttattgggaggtaggtgtagcccaaaaagtatctgagatgtgtcttaatccatttagtttattttgccaaggttagggacatgcgtggaggaaataaacatggaatcacagaaacagtctatggcctgtaactttctccaaagatgattttgaaggcttcagtatttataggggaaaagtgggctggaggggaaatagggagggtactgttatccacttgttgcaagagaaaaggagcaggtaggggagtagtcaattatgtattcctctccgtctcagtgatgggcactttacataagataaggtgaacatagagtagcgacctgtggagataatttaatctttttatctataggtatctgcttaggaacaaaaggaaaggcagcttcttgcatgactcagctttcagcttaatttttttcctttagcatagtgaattggggttcagattggagtttttgttttctttcacatcggtaagtcaagagcatccataattgattgtatccaaagaggtatcaaagaggtcagggtcaataaataaaaacagatttatatatttacgtgtttgaggaggattatcattttagaggaccaaatgttttaacagtttccaaatgaacagattccaaatcagtttaagcatcattgaaacatcaaataaaaaaccttgataatggagagaggtctctcccaaaagagcagagctgcacatcagttttacttatttccttagacatattcctgtagcttttaatttaaaatgtcaggtctgcttcggtgcaactggtatgtcaatcggtgtatccatattacctcccagcctgcccaaaccacccaaattagtgtagcaaagtgttattggaagcttcaaagcttaactttaatcttgattcctgctagcctccaaaaattctttgctctgtatgcaactgagtggttttgaatgtttatataacagtgtccctcactttgcgatactatttggcacagtgaatgtattaccactgttaaccttcaggccatcatctcctatcacaccctacggtatttgttcttccagttaaccttatcagcaatgcagacttttctctcagtgcccaccatctagatcagggctagaccctcctgactctgcctcctagcatttcagttgctgcttttcagtttctgtggcatcaggagtctgatctttaccactggtctctagtcctctttcttaaactccttcagcgcctccacttgtcctctgtgaaaagacgaacaacctgcaggagaaatccctttaggacctggcattgcctgcctctctgtccttttccttagctcttcacctactcgtactctaggtatcaaccttaaagaactatctgtagttcttcagaaactccaaggtaaacatgcttctgtgaactaacgtctgcagtttgctttgcatgaatgcctttcaagtttccttttcctgattacttatttatttctccccattagcatgagtctgtgagggcaaggtccatttcttccccctccattttcgttcctaacgcagactagatggatgctgagtggaagctgctgggtgaatgagtgagaaccaaccagatcctccctattgctttttatggttgattccttagtcccatttcagatgaactggtttcctttcttctcctcctttgtttctctcttaacaatttccacatatctctgactcagtctgtctgaagtacagctctgccttgatcaaaaccttcagtggattatcatctcttgcaaaatccttttcatgctcaatatcatttccagcctttactggtcagtctctaatatgcatttgcagctgtatttcccatgcttctccttgccaactccagaccagcctcttgtccattcttctgtcacactctgcagcatactatttctgtggttgtgttcatatcataccctcagataggtgtttcattgtcccagtcactgcctagtgaattaaaagtcaaaatgtcccctaccccacaatcagaatcaatcttccattctgtatctgtaaataccacttctacgtttttccttccattatggtatgtatcccattctactttttattatagcctttggttttttgctttacttttgtgtatctgtatctaattgattatccttgagataacagctatatcagtttaagcttgaaagccacagacaagcttgtccaatcaatggctggtgctattcagtccgtatgaatagagcatgtgtcttgactggcagacatcggtttgaatccctaatatgccacaaatagctatataatctctgcctcttctttcttctagtttcccagcttgtaataggaagatgataataccaaatttgtaacatgcttatgcagattaagtggaataatgtatggaaagcatatagccaatgacagaatgcaaaaaatagtcatgattactgctgttactgttactatagatatgtagtcaccatcgtagaaacatattgttttgtttgagcttttagaattaatgactttgtgtggctaatttctagctgaatataactgaagctagaaattacccattagtcttacgattaaatataaagcattttttcactatcttacagtcttttattattacttattttggcattacaacgttttgctggcaacaagggttgcttgcttcttcaatttttccaataacagagggctaaactgctgtcagtacttgtgaaaagaagaataataccaagccttaaatcctatctagcccagtcttttccatgctattttgcagtatatggattgaatttcctatggttagagttattgaaacccgacatctggtgttggagggaacaataaaataccagaaggactttagcctgccagtgggctattctccccctcagattaacttttgttgagtatatttgttcttttagaacttggatggacagcacagtcagaatgcatagtctttgtaccaaagaacgtagtaaaattgaagtcaactaaggggaaggacatctaattatattatgcttttgtaagttgttaggaaagatatagtgcagattattcttaatttgaattaggtgttttgtgcttattatgttagtgtttcttagaattgaaattatggaaagatgattcactgtgaggaaatacctaatttttttaccttccttttttccaactaaacttatgaataactcgtcaaagaaagaagaaaactctgatatagtcaccaaaaaatgacaagaattgatcatacatatttaaggcatatgtgtcattttctgcactggtgaaaatagattgaggaaactgcactagaaattgacttaatacctagacactagtagaagaatgacatattaccagagactaaaatactggaagaagacagtgaattaatgtcattttcaccaactgatgatgatggtgatgatggtggtgagaacatttagtaggcaaattttcaggccctgtgtaagtcaattaatggtcattgtttcatgctgcagtttttataagaatccctatgaaatgtatgttattattttacctttattttacagataaaaatactagggcttcaacagatagtcttacccaatgtcacataacttgtaaaagacagaagtgggacttaaactgagaccaggctaacctactgtcagtcctcttaatcccaatgctgtactgataaggctacagtccttctttctgcaggtgacagtgagggcaaagttctgagagtgagttcttaagttcttctctaggaacacagtacctgttggttagagcagagccaccaactaaccagaccaccacttcaaaggctttaatgagggagatttacagattgacatgaaaaaactctctgcagtaaatcctttctggcagtgacaccattataagctccatcaggcagaagaggaagatagactatgtgatttagacacagtgtttcctgaaagccgatatcagtagaaccactctgttggcattctatgccattgcatggcaatttaaactgcaaagcctaagcagaggagagttaacagtgtggttacaattgatgtacgtaccccttgatcctagatggaggcattctgttaataatccccacctggctctgcaaatggcaggattccatccaacaatccagaggaggctctctaacgtccctgaggtctcctagcagacccagatcctgtttgagtttggcctttcaacaattttattatggctgtgggtgcctatttccaaacacccacagcctatcattattagttattcagtaacatcccattagacatgttctttaagattcagcaaaatacccagaagactacagattcccatacagtattctcgctgatatagtttgaccctacaaactaaacaagagagtgaaaaaataaaacacagacacagacatgaaagtcagcctttctactgaaatacatcttacattggtcatgagagatttatgtaataccaaatatctattatttcagaaatgaaagcacacatggctgctgtgaaataagaacagaagtgaaatttcatatttaaaaaggagctaattcaagcatcagaagtaatacattttattggttctaagacatttttacattttagcatcttgaaatgggaattctttttaaaagatggcctctcacaaatactttgtcatgaaatggtagtaacatataaggccccttttaaaacataagagagatgatgtcatttttgctcaaatcttcctggctttgaatctccataaaatccaagaaccttaccatagactacatggctcagtgtgatctggccactcactgcttctctaacctcacttcccaggacttttcccctcgcttttttttttctctttttgttgcaaccatgctggtctttccgttcttaaatcacctaggcatgcttctacctccaggtcattgcccttggtgtttcctctgctgggaatgtgtttccactgagagtcccatggttcattctcacatctacttcagatatttattcaagtcatacttatttaggctttctctggccaccttatctaaaattgcagcatcctaacattccctgtctaccgttctgcttcatttttctctttagcatttattaccagctgacagttcccattttttatttaccttgcttgtagtttgtctctccccagtacagtataagctgtggtaaaaacagggatttttgtgtattttcttcactactgaatctccaggtcttagacgaatgcctgctacagacaagacacttagtaaatatatactgaatatatgaatagctataaatataaaaatacatatatatgaatatgccaaatataaaagaataaatcaatggattacatgctcaaaagttgataaggtggggaagagggtaaatattacactaagcctgtccagtggctcatggtctaggatttgggcatcttgaattataaacttgcctctgttactagctatctgagtagagtttgcaggttaatcccctgggcctccaggtgggactacagagtatggatgttataacctctcagttagttgaggcttcagctaaaaaccattaaaaaatgagggccagaatggggaatctgaagtgaaagacaccatatcttttaatataaatattatcaccagaaatggtagttgtaaggagagtcttaatacaaaagactttggagttaatttttggttcagttgcctttgttttataaatagtgaaactgaagcccaggatttgagagacttagccaaggccaggtgctaattggtggccaaccatagaactgtactctacaaccctgactcaacctgactgaacccctgttctttttactttaattagtacacagagtaaatactggtgattaaaaacaaaaaagagttatatttaggctgttttggtattttgttcaacttaaatttgatgaattcacctgatggaaagaattcatagatcaatgtatctctctttgtgacttaattcagcttccagaggagattggaaaacttgaagataaagtggaatgtgctaataatgccctgaaagcagattgggagagatggaaacaaaatatgcaaaatgatatcaagttagcatttacagatatggctgaggagaatatccattattatgaacaggtaattagtgttgtttgatattgcttcattttaaagttatatgctcatttacttttggtccgtccaatgttgaaagagtgtattaaagaacaagtgtcacattctaatgcctctctggtagcttggttttgatgaagttgtcagttaccatttggttttgtttatcctcagtttgttgttttggatttggattcttcaaaagcatttgataatgctttctaatgattgtcctaactactcctctttcctctcccttctccatttatgaagagtttgcaaaggaaggaaaggagcagagacttgaatgagcagaaaatcatttcagggcctgttctctatgtccttgctatccctgtcttctgtagctattctgaaaccatcaacaaaggagcacaccattccatcagcaaaagagtaacaacatctttttttaagttcattttgtttttcagatgattgtatttcaatttttttacagctgacttttctcagagaagttttttttttattgtaaacatactttttctagaaagtatattttaaaataacatctttaaccttatctctggctgaattaatgaatatatgaaattattacattaacaaaattatgtcttacagcagtggtccccaacctttttcgtaccagggacaggtttcatggaagacaagttttcctaggtggggggcggggttagtttcaggatgaaactgctctacctcagatcatcagccattagttaaattgtcataaggagcacgcaacttagatcccttacatgcgcagttcacaatagcgttcacactcttgtgagaatctaatgctgcctctgatctgatagggagtagagctcaggcagtaatgctcacccgccgctcacctcctgctgtgcggctgggttcctaacaggccaatgaccagtaccagtccatggcccaggggttgaggacccctgtaatttatagtatgtagtgcttatccgtttaaaagaactttaaactgaaatattatatatcttgaaagattaactgatattgatgtttttattcaccaagagttaattaagccccttctatcaccagacattgtgcctggccctggagagaccacagtatgcaagacaaacacaatccgtttctcatgtagttacagccaatgaaggaaacaatcacaaagagagcatgataaaatggtataaggttcggtatagaaagacattgcagggtcatataacctaatctagaaaaaataaggatatgtttatgcagagacctgaatgatgaataaggagttgccagataagagtgtgagaaatggagttggagcagagaaaacacatgcacaaaagtgtagaagggagagagaacatgttcagataactgaggttccattttggaggaagaaggagtgaaggtagtgttgaattgaaagattaggctgaagagtgcattataaatttattcttttacctttaagggaaatgggagccattgagtagttttcaggaggaaactgaccggatcagacttgccttttggaaagattgctctgactgtacatgggtcagagttaggcaacactggacatgatgagactagttaggaggcaggaaaggcagagatgtgaactgacctaggagtttcatgttagtgggctagagattatggaacagatccatggttttgttttgttttgttttgttttttaactaggtagaactggaaagatcattttctatctctccataattttttattctggtaacaaccctaagtaaattcaagtatctaaaatgaatttcccataaatctcagattttgaatgatataaagtatttctttttaataaagcacatttatcaacataaggctttattaccatttaactgtttaaatccacagaactaaccttacctctcctttatagtagaacttgtctacgcttacattacagaattgttaagaaagtcaacatgtgatgaataacaaaacaataaaaccaaaattttaattgagataatttataagaaaatgccttaaattaaagcatgcagttttctataaatgattacaaaacctaagtatattagggtataaaaatcacatgacaaatgcacttaatattattttcctttaaatgttaagatctgccaatttttctaaatttggatttttttaaaagtgttcataacaattccacagaatttcaactaaaatgtttgggtttttaccgtacttctcacataaaaatgtattttttttcagtctcattgattgaattcagtttatacaaaatgttcctttcttagaaacagctaaatgagcatcgctgtgccatattgcaaattttgtttttcacagcagtttctatcagtgtgtgatgtttttaactctttccccaagtgtactacatttctaaatgttacaaaattatattgtgtcctccatcttaaatgtataaatttggagggatcattgtttctcttttgtataacttccagagatccttatagctccaattgtttgttgaattttttcctgagtggaaaacttttaacagatttggcacatcagtccagtaaaacaaaatcaagaagttggagcccttaaatgatcagggattcttagcagaaagattaaggcctaaacagcaacaatctgtcactaactattaatatcagaaaatctcagatatacagggaagtgaaatgttccagaggtcattcatttcctgtttaatttcatcacattctaatggaaatacttcttttttcatcagtattcccaaaacggtctgttcctagtgtgatggatgaaacagggtatacatacatttgcctttggatttacctgtattaagttctggtcacagattgtttagaaattaaaagttaaatatcaaaatggcagagggaaattatattataaatacatggtatgggtctgtatccaactccagttattatcatattgtgcaataattgtgtcatgttatatttagaggcatctattacatctaagaacatgtaataatcaatgtcatgttgtacttagatgtatgaatttattgggagagagttgattctaaatccagaacaggtgtctcaaatgaaacttttactaggtaaaatgatgttgttcccattttgttctgtatgaccaataattaaggataaatgtgttgagtctttttaaacaaatgaataacgaaacaataaaattacaaatccatttgagcagggtgaatgatttcaaagtatattgatacccaaataatgaaagaaaatgacttcctgctaatgtgaagggattctaaaacagtaaaacatccatgccctggatacagggcatggatatttcctaacttttttcttgaaggtgcaaaagaatatctgctttgttgctgtcaatgctgatgatgctaatgatgaaggcttgagagcaagtgattcctggctgatcttatgaactggaagagcacattcttctcaaagctttattttaatatcattgaattcacttggctatccaatgtcctcttacaattagactttgagggcttatttggaaattctggcaggaaagtgcagctatttaggaactgctttagaatagctctggacttggcaacagctattaatataaaatagaacaattaccttttgtcagtatgagcacaaaaaatggggaaccatttacccagtccagtgaaatcacctttgttattaaggaggtgacagacagctctgatgtccttttggtcatttaatgtctttgctttctttgtctctaacacatcagggacaaggtggatagtaagaaagggtagggaattcacaaatattcccaatgatgagggtagggctagtaaagggagctatgttcaaaggtgtctatggcacatagcagattcttaatgtgtgcctgctaaattaccatttctgagtacctgctgtgatccggccctgctctatatctcacatgtggcatctcacatgaccgtatctgttactcttggagatagcgctgtcctctctgcagtcttgctggcccaagtttctactaatgttaatttttgccaaattacgcagtttgtcgttaagtgaatatgataaaggaatatagtttattcctttgcatagcttattttataatatagttcattcctttgaatagtttattttaaaattattagtaaatatatggaaatgcttgttttattatcttatttttctggttataaaattaatacaggctcactgaaaacaattacagcaacaaaagctcagtacacaaatgtatgatgaggataaagaatacccatataatcctttctcctagggagtggttcatttaaatataattatagaaaataatttgctattttaagattaaattattgttagattttctgcatgggtctttggaatgtgtcagcataaaaacacatatgtttacttattttgtgtcacaatgattaaaatgaatagtattttgagttccatatttttcatttattttacatatgtttccacatagtgtcataattttcttatgatacatcatactgatgtatatttattagcttagataataatagttaaacatttgttttttttcttttcttctatcattactattaaaaataattataaatattagctttttgaaaacttggtaagaatttcaagaaataagcaggtctatctatgattactgcatttcttattctatcagtcttatttaggaatgtcagttccctcatgtaaactcatttatgtgagattctgttatcatcaaagccctgtgctaataaacacaggggtggcgtggcatggggagaggtgatccaaattcacacttaagtcttgctgttaggaggctaaagttgattagggaaaaataatatataaaaatatttattcatttatttgattaatacagccctaaagttatttttttctaatggtgaagtatttaaattagtttttttgcttgattgtaatggatagactgaataaaaggttctactcttagcagataacacaaatatatttatatggacatctagcaagcagaaaaacaattctagcaaaggaaaatttctgaaagattttgaggaaaagaaaaaaatcgttacaagggtatctgtctagccagatgaacagtactactaatgttttcttaaaatccaagtctagttatttatggctcatttaaaaattacagaaattttgtaaaaatagatctcacagcagtcctctaaaaactaagtctgaataagcactgagtgtccagaaggttcttcaagtgtagttttacttatttagggatttatttcttgttgtgttgggaaaatggtgaaataaattctagtgacatggttgtttgttttaaacttaatactacactacatacttcggaacattttgtagattttgtaaatatttacttgaaaacatcctggtccaaattaggacaatttccaagtattctgaccttaagaggttaaactatattgataatgatgataaaactgctacctaagcaagatttggatggatggcatttagattcctgtcagaaatttcattctattcaaaactgaaaatcagaaaaagtattgatatgtgctcatctgtgagttgaaaggagcaatgaggggaatagtctccctagacttaattctgattaacaaagaactgttatcttaacatgacagttccatcaggagacagtactatttccagaatctgggaggtgaaagcaaaggaaggaaaatttggccattctcagtcatatttcctagaatttagtaaagtagcttaaaaaattagataaaagttagttatactttctcaaaatcatacactctaaatgagaatatgacttgagaggagtggacaattctaaaaagtgaaaagaatgaagcaggtgaagaatctgacacaattgtacctgtggaccatggatcatggaaacaaagatgatagaggaggatacagtcaagaaggaatacagaaaaaaacaggcaatgtcagtgaaagcatatgtcaggaagaagagagttttgggggaaaaaatgtgaagagtttccaaacagcaccagagtcaaatgagagtaggtatgaggagcatctctggaagcaagaaaattaggaattaatatgttaccaaaaatattaataaaaatgaattgctagtggaaactgtgtaatggaaactaagaaaacagaactaactcatttctatttcactgctgttttctccatgaaggagaatgaaagtataagatgaaaggattaggcaaatacaaataaacgttaactaaaatccaatacatttgaagaggtaataaaacaaaaactatccattgctgcaaaaaagagatggctgggtatcttctgtttttcagtgagtggtgcaaaagcccaccctttaccaacctgaaagcagtacttacaaagccccagttgaagcccttaattctaaatttactcatagaaggaagactgacagacctttacttacccagaagaaatgcaggccatgttactttcctaggtgaatcctaaaattacccccagagaaggttttcaacaatactggaacaatgtttccaaagtaacctcctctgtaatttctgatacacaccatgcacagtcatctaatacttgctcaaccctttgtcaatagcctgtcttagagaaggatggatatggtaggagagttacccagatagagttgttcagcatagttttgagcctaagaaatggcaggtagtgtttgagttttcttttaaattgttgcaatagaggtgtaatagatggtctgtattgaatcatttttttttatgttggccataaaaaaggctcctaggctgaacctctgtcaagaggcacattctttaaagttaaattctctttccttattatgaaacaaagaagttgactagagctggaataatccggagttatccaggacagggaattttgaatccataacaaggtgcatttctttttacagtcatgcctcctaatagttactgaagcctgacctaaaccctagacctcaggagacagacgccctgatggtgctaaaatgggccttcagaaaagagcagtctatatctttggaactatgtgcagaatatctcagaactacattatacaccctaaaattgaatagattccacttacatgtaggctatatttctggcaaagcaaacacaccagcttgagaggataagaagcttagaagtttactcagtctagccatttttataccagttaacttttccaattcgttacatccttgtacctgcattatcttaccgtcttattcattgggaagtactcactggaagcctgaatgcattaagaaattcaggttacatcattgctacttttctgtggatcatctaatttatttagggatgatcatcaaaaggaaaacaacaacttttcatctttttaatgccattaaatggcaacacatttaatagagttttctccttgtgtttcgagagcccagcattgttattgattatttaatgattaaccttgtccttttaaccaaatatgtcacttttttgttgagcaatcagttcttttttcaaatagaatctgaaggcacatagaaatgatcagagcaaaagatacagaaatggaatagccttctgtgattctagaacatctttggaggcaagccaccatagactccgagaaactgccttctcagtttgacacattattaccaggaaatttggataagtgaagaagcaagaattgtaagctgaactcagggaaatctacatttaagacatttcacaaataactttttaaaaattgactattataaatatcagaggaagtccctgggcatagttctttgggtctcgaattattgtatatttgtggtatacatgatcctacaatcctttacttccactgatagaggatggcaacttgatagccagattactcccatttaggttatactgtttcattttgttggagaaggttggcaatgcatcttagcctgttttaagtttctaagaaattcttaggaaagaaacctagtcacctttctttatcctctcacatactgaatttgtttgctcacagaagccatttatggagtaattgtctgaaatgttctctagaaaacagggaaaacacatgatagagatataagatttctaatgctcattagagtgttcattttaacaccacttgaacgagcttgggtaaccatgaggtcttgacagagtagattttaattcaacatggcttaaaacactgctctgttatagccaactgcctttgaacttatgtttgcataatttgatgcaacttttcactgatgtatagatgaatattcccctaccatagcaaataagaaggtaaatattatcttctatgttattgataaggtcctgctttcacattccgggaggtaaatctaaaatctaactagtttctttctgcaggaatctttatattcaagccaaagttagtttgaataagataatctttagcatggagaatgataatatgctttttagaggtcaatttatttaattttctgggtatttgttttggtgacctcttaattaattttgaaaaaaacttaattttcttcaaaagttaagttttatgagagtcatattaaggtcctgttgtattagaagacacttctgacttaaaaaaagtaattattaagtagttaagcaggtttatttactaaagaagttctcagagtactttatgtgcttgtatggttgtgattgtgaatctgaagacataataattttcttgactagatcagtgtttcttcttgcagaatgagtgttctacagaacatagtttgggaaatcttgggtaatagtgttgatctctaatgctactttaagtgtggactgatattcattccataagttattacagattcaatttagaagttgaaagtaatcagttggaatcttcgatagcaattagacattgccaagacaaccaagtaggtgattaggaggtttcacttgttgaattctatggaacaattcaaatattgtccagcttttgtggtgatttgcatgtggcatgaattacagactagtcatggccagtaagaccatttaatggtccttagatgactgaaagaagaaaaaacaaaacaattgttcttcaccacagatagtttaagaagcattgcctgaagttccttctggtttttacaagtctgttgatctcttacacttaatatagtgtcctttctcatttaaaagtttatagtcgatttaatattgaagcatcatataaagcatgtaaaacacagtcaatggtagaattaagtttaaatgcagcaggattttatttttatttatttctaaagaaactttagaatcaactagttgtcatttttagaattcttaagtattatgtacttattttgttgtttgattaagtgtgatttctgttctgaattaaattttcaaaatccatagctatagctcatgtttccatctagttttgaaccttttattatgtgtcgtataagtcttaaatatttttgttttacaggtttttacttttttttttttttttgagatggagtcttgctctgtcgcccaggctggagtgcagtgctccaatctcagctcactgcaacctctgcctcccaggttcaagcgattctcctgcctcagcctcctaagtaaccaagtagctgggattacaggcacctgccaccatgcctggctaattttttatatttttagtggagacgagggttcaccatgttggccaggctggtctcaaactcctgacctcaagtgatctgcctgccttggcctcccagagtgctggtattataggtgtgagccactgcacccagctgggtttctgcagtcttaaaaacttcaattgaaaaatattctcatcagtcccctatattctgtaatgtaatttgttctcgattatctatgcaaataaagtgagcctaggtatgaaatagacagttatatcatggcatagtctgtgcttcttcccatcctttgggctacataagtttttatgtagttaatcagggatttgcgtagaaggagattacacataataatgaaataatttctaaaaatgtctagtttctgaatcaaggacattctgcttattgtgctttgtaaatgacagactacatactatgggccaatataatagtttctgtatagaaaaggaagaaatgatttaaacacacacacacacacacacacacacacacacacactgcattttatcacaaataagaaagatgggtcttctaatggaaaaaattaaagttgggtaccatgatgcctgcattagctaattataaagtcctaatcatgtcttctctatatacccagtttgctaaactgccaaatagaggtattcctcccttcccccaccccatatcccattcacatacaccccttacaagtctttaggagaataaaactggaacacatatataacatgctataaaataatgtgcttaaacatcatagttgcaccttaataattttctaataatccagaggtaaatgtgcttatctgtacagttggttgtactttcagcgtatgctaacacaaaaacagataagcttgatgtctgaagtgtctagcattaaactggataaacttcatgtaattggcttagctgtaagtaaacaacaatgatgtggtatagaaaaagtatgagtttgtaaggatatgaatttaaattttggctcttacgttaatttctcctataaagatttccaatatattagacctttcagagccccaatttccccatgtataaaaatgagagaaatggaataaattttatctagggctccatctgtctttatcaatcttgagttagacatctacagaataatgctacagaataataaaaaaatggaccacaagatggcgtttgtagctaatgagtccttttgcattaactatctgtgttgcagtcatttaaatatttgcaataattacaagtgtacacttatcacttacattcttgagagatatgtaaaagtaatttttagaaaaataatatgcaaatcctgttatttttaagttattggtatttctaaaattataagttggcagatgattctcagaagctgaatttagacttttccaaaaatgaaatataatgaataattttgagctattgcaaaataatagaagttgtttttctctggcaatatcaactctaatttccagattgattacatttcagaatttgaaaatatgtagctcctgaaagttttaattagtgtttcaattttaggtttaggagatttaaaaagttactaaaatgttacacaccctattgccctcattttaggcataacctaataatttttatagatgataaataatttcgtggtgctattggcctagtatagaaatgattgcgaatttgggcttcaacgttttctcaaatgtaggtgatatcatctgtgtccaggatcatttgagacaatgttaaaatacttagaagaaactcagtcatatttccaattggtagcttactgagaaagatgtaattatcatggtactctctctaaaagttgctttttgattagaggtgaaaagtagaagcacaacagctttatatggcttaatatgggaatttccagttttaaaataaatatatgggaaggtgtggcttttacatattctataataataagtatcattattattattaggtaaatgtctagttattttactttattaccacagaaatatataattatattttattttgacttatataataattcgaatgaaagtaaattttctattagctgtttctgtcaacagtgtggtgtcattacctatggcgatatcaacttgttatgtaggcatcacatggtggctaaggggatgggctttggacaggcatgacttctgacttttagctgagtgaccttgaggactttttttattttagtgagcctcagtatcctcatcgatgaagtgatgaaaatgccatagatttgtttgggtgttaaaatataaatgtacatgcatatacatatatgtatttatggaaaggaatatgtaaagatgaaagaaaagtcttagaagcaaagtttaacattcccagtgagtcactaaaaatagtttataagattttatgctcatcaggtatttccaggagtcttaaccagcatatgccttaagccactaattttacttgagcccaaaattgccaccatagaaaataggtttcaaagctgctaaacgaatgaatgaatgaatgaatgaaagaaaagcagttaactcagtgtctaataaggattcagtaaatgttggctactagtagtactagcagctgtagtggtactgaaaatatttctcatatatttatgaatcttatatttggaaattataatgacagttatcttataaataccaaatgctaggaggagaagtaaaattttatgtttgctgtattccacgctgggtcaagcaaagcagagcgaggcatatttatacattacatatgatttcatttgccaactttttgtcagccacagttagcctctggaaatcttcagttttagttctgggatgaagcttaatggacacacatagttcaaaccccttactatgaataggtaaacaggcccagagcaataaagaaatttgcctgaagtcacactgtaggacagaacatcttcatatcccacaagcttgagaaaatagtgattctcaaatgtggaagcttccattgaaagctgtatcgtatctgtagaaataccattattgtcaccatttactctttagaaaacttgatcacatctgcttgtgggattactacccacttatgagagccgaagagacatttacctcttctaatgcaaaatgtcaccacctttactgaagtagcaagagatttattttcaaaactgaaagtcagttttggaattaaaacttaattttctatgtattccatctgtgtgtactgcatttaggaaggttttcagcctgtgtgtagaaacaaaaaggctttgtttacctgttgggtctgttttccccacctctggctcaccttcctgtggtggctctctttctctgagttctctcctcaaagagaaattgcacttgactttggctacaactgcagccacctgggggaaatgtgtactggattctcaattaacaaggatttgtgataagctttttttctggtcaacccacatcctggctaattgcatgtatagcatatttatcaacttaattttttctgcagtgagaaggagctgttcaccatggtttcatgtagtagagcactggaaaaaacacagtactgcactatgagagtcagttttcttaactgtaaaatgaaattacctgatttcatcagaagattattgcatgaaataaaacagtatgtatggaaaatgatgacatcttattcaaatggaagtggaactcctgttgttcttggttctcccatgatagtatgagaatccaaagctagaatgagctaaccagaactattaaatgtcaggccagcagtgatgctggatattttttattactactctgattttgacagatactaacttttttcactcactgtaatgatttaaaagtgaaaaaaaattgatgacaatgcaaagccaaataacaaatagaaacatgttttaaaaatactaacttataagcaagtctcacaccaggttttgagatttttttggttgtattaatgattctttatatcctccaattatgatcctgaggacagtaaatactcactgtaataaattacctaactatatggtataaacaatatatttcttgagtttttccttaggtttcgtactcaagagcaaagaaatttaaggagccttagagatcatctttttgttgtttataaagatttgtgtacattaatttgatatatgtgcaggatatcaggtaacacaggtgaatattaaacattggtggaaacaggcaattacatttatttaattaaaaatcggctatcaagaatcccaaagtgatctggtagcgtcaggagctgcatagttcaaggtcagattctcagctttacaggcctagaaaaaaaccatattggtcagcaacatgaatggggatcgggctcttagggcaaaacttaatatttacatgtttggagagcaatagaaaccaagatatcagttggttagtgttcaaatagaaaagtgcagttttctgatggccagcatcttagcatcagttgttcaatatattccttctctatagagtcatctgcattttctgagcacttaccatattcctggcatgtattaattcagtcttcttcaaagtatagatctgttcctagaaatatatgcagaatttccaagatatataaagggaattaatttccataccctcaccttttgtaaatactctttcctaaaatgtgatcagcctgatgcccctgcagtcagggtttcttacctacttctccttccaaaatcatccttctactatgtgaaagaaaggcatctcattctcttggcccagtgacttattaaatgtaccctggtgatggttcaggacattgactatccatttgttaatggataaatactggcatacaatttacgagatttatcatataaacacacttagaccatttgagcctcagctttctcacctgtaaaataggattcacagtaatcattatgaggcttaaagaaggtgatacataaagcaatcattataatgcctgaccaagtattcatatcagtatatggcagttgttaatgttatttctgttgctatcctatgtcagttgttctataatgttctgtatttcaaaacacatactttttctgcctctggtatggaagataaggaaatcgtgaagtagctaatttgtctgtcttaccatgttttactgtcccttttagtacttaatttagaaaggaagatgttaattcacatcactaattagcatggacgactactgaatatcttagatctttattaaactagtatcgttaatgcagaatatgaaaatgataggagtttgttcacttgagggctaatgccatctttggtgcaatttgaatcacttatttgacaggaattctaaatagagcagactgcttagaatttcattttgaattttacctggagaatgttcagaagtttatttaaatgatagttttgcagttattaaaaatatatcttctgaaagtagtaattgctttggggctgccctgtaggggtaccagatacaagattgtgtatgggtttgcagagagcaaaccagagcggtctagtagaaagatggtttgcaaaggaaactgagggcttttctctaaatgtaaagtgtggtgctgttcctgtcagccctttcaacccagttaatagttttctgttttataaacattgtgggtagattttttaaagatatactttggcatttttgtatttccttcttttttatacttgacatttggtgaaggagatttgtgagtggtttatgaaactgagttttaatttcttttttttcttggtattgaaaaatcaataaaatactaataacagctaatatttactgcatatctgcatatgatgttaattgtagctttttgtagatgttcctcgggttgtggaacttctcctttattcctaatttgctgagaaattttttttaataagcaatggacattggaatttgataaattttttgtctgttgagataatattgcatttaatatcatcatttgataaatacttgaatgttaatccagtcttgccttcgtgggataaactccatttggttatgatgcataattctttatagaaattactgcctttgatttaccaaaattttatttagaagttttgcatctatgtttaggaggaataatggtctgtagttttcttttcttggaatgtctttggctctggtattttggacagcatccccatgtcttcaattttctggaagagattatatggaattagtatgatttcttccttaaatgtttgctataattctctagtgaagaactctgggcctagaaatttgtgtatgtgtatgaagatatttaactacaaattcaaattcatttgggttattggtttcttctgtggtgaattttggtagtttatgtctttcaaggaattggtccatttcatctacactgtcaaatgtataggcataaagatcttcataattttcttttttcctttagtggaatccgaactaacattaactctctcattcctgacccttggcaatttatgtcatctctttttttatgatcaacatggctaaaaagtttaataattttattaattttctcaaggatctaacatcagtttcattgatttttctttactgtttttgttttttctttcattgagtcccactttgctcttttctgttttttgtttttttttcttctgcatttaattgttctttttttggttttcaaggtaaagactaaaggcattgatttgaaatctttcctcttttcatgtgtaggcatttagtgctaaaaaatctctctgttctactttaatggcataccaaaatttttgatgtgttgtgttttcatattcattcagttcaaaactctttctgatttctccattgatttgtcctttgacactggaggctttttataattgtcctgtttagatttcaaatatttggtgattttaaagatatctttctggtactgatttataatttaattccattatgttcagagaacatactttatatgacttgaatcttttaaaatttatcaagacttattgtatggcccagaatgtgatccatattggtaaatgttttatgggcatgtgaaagaaaatatgtattctgcttttgtcctgtagatctcagttaggcaaacttgattgatagtgtggttcagatcttatatatgagtgctgattttctgtccacacattctgtcagttcttgagaggggtatcaaaatcaattataattgtagatttgtctttctccttgtatttctgtcagtttttatgaaactcttttatgtgtgtaaacattttaaattatgtcctctagatggatggcccttttatcattatgaaatgatcatctttatctctgataatgatctttgctctgagatctacatttctaatactaatgtagccatgctagcttttcttttgacatatgttacaataaaacatatatatgtatttttaattaaaaaaataaacccaggatctcactgtgttgcccaggcttatctcaaactcctgggctcaagtgatcctcccacctcgaccacccaaactgctgggattacaggcatgagccaccatgcctgcccatatatatattttttaatccttttaattttaactatatttgtccttatatttaaaatatttataagaaatttaaacaaagtataggtaggtcttgtttttttattcagttggcaatctgcatcttttaatggtgtgtttagcatgtagacatttgagtaggattattgatatatttgagtcttttatcttgctgtgttttatttgttctgtctgtacattgttcctattttcttcttttgccttcttttgaattgatagacaattttacatgatttcattttacatctctttgtggtgtattagatgtaactcttttgtattaggtataacttttattattttagtggttatttttaggttactgtatgtgtcttaaatttatcatagtctaccttcaggtagtattatacttcatatataagaacctacaaatgtgttttttcattccctttcatctggcttttatgctgtttttgtcatacattttgcctatacatgtattataagccctgcaagattttgctatttttaattcattagattttaaatacatttaaataataggaaaagtatgtatcatatgtactcatgtcgttactatgtcatttgtttatagatccatatttctatctggtctcttttttttctgccagatgagttttttttttttttttttttttttaatattggttgtagtgtgttctgctggtgataaattttgcagataatgaattaagtgattttccagtctgcctgatgggattctgtactattgtaggccctatgagaatgctggatactgtttaatccttcccgatggctttttcccctgtctctggtagtcttctcacatgcatgtgccagtcagtactctgcttggtgtggggcaccctccgcatatctccagagctttccatgcaccactctcttctctgatactctggtctatgaactctagctgcattttctcgaactcttagctctatccttttaactcagtgagtcagccaggtaatgtctcccttcaccatggcctcgaaattctgttaaggcaataagctggcatattagagggatactaatatagtttagatattcgtccccacccaaatctcatgttgaaatgtcatccgcagtgttggagttggggctggtggaaggtatttggatcatagtggtggatcccttatgtatgtcttggaccatccctttggtgataagtgagtgcttgctctgagttcacaggagatctggttgtttagaagtgtgtagcaccacctccaccactcctgcatacgccatgcggcatgcctgctaccacctcaccttctgccatgattgtaaacttcatgaggcctccccagaatctgagaagatgctggcagcagcttcctatacagcctgcagaactgtgaggcaattaaacctcttttctttataaattacccagtctcaggtatttctttatagcaatgcaagaacagcccaatacagatgccataacaaaattccaaagactaggtggcttaaacaacagaaatttgtttcctcacaattctagaggctagaagtctaagatcaaggtgtcagcaggctgctttcttctaaggcccctctccttggcttgcagatgcccaccttcctgctgtgtcctcagatgatttttcctccttgctcacatttctggtttcctctctgtggccagatttcctcttcttataaggacaccagtcatattggattagggctcacccacatgaccttattttaccttaattacctctttaaaggccttatctgcaaatatagtcactttctgaggtactagaattagagcttcagtccataacactggggtaatcatggagcttactcttccccaccccaccccagggaccactatcctttgttgcctgatttccagggtgttgaaaaccattgctttatatatatagtatctacctgattgattgattgattgattgattgattgaggcaaaagagcctttccagtccctgttataccctctgggtcagcaacagaagtcctgagcctgagttcttgatcactacactatacttcctcacattgacctttcacaaacatgcagagatttatgggatctaccttttgctcatcttttagtctgcattcagtgattacttccactaggaaacattaggacactccaatgtgacttagatcctattactgttactcccatcatgtcctgtaacatcacagaccctatacttgattatatttgcttacttaggtttcatgctaaatcataatttctattagtttgtgggctgtgtgctagcatcatcacagtgcctggcatatagtaagaactccaaaatatttgttgagtgaagagatttttgtatgtctaccctccatgccccccaaatcatgcatagtttggacaattataaattacagtccaaaatttgaaaaatatactaaatgtgaagtattcatcttttatgccttttcatgagtatagacatttggatacacttaaagatatctaaattcttctcctgtaccgtctaagaggaggccattcttactagttggctcctgtagtaactacctgaccctgactcctctactcccctcccctcctcttcctattttattttgttatttctccatccctatgagagaggctattattattatatatctgaggagctacaatatcataaagttagtaacttactggaggataaaagcaaatcccagaatcaattcattacagtgactgtgcttcttggattgtacttggctttcagtaccttctaaagctatttaaagcaaaaagtatcccttaaagtcttgataaacttgattattctaatgaggcctacattaccccaagcctggccttcaaaatatatgacaaaataaatacccactatttaatccagtaatttattgggtaaattttacccagtatctttttatttgacaattaggtctttcagtgttttactgttctcatgtaattatacgaatcttttagctttattattagcttcctaagttattagagcctatctcagaattaaatcacagtatgtaatctttatgaaaatcagatttgacatagtatttcccatattctaaatcttcagtttgaaaaaaatgtgtttgtgcatacacacacacacacacacataagtatatacatacatactttttgaaatgcaacacacttataatttgagagctttaaacatttgagtttttacagtgtttgagaaatctctagtctgttattagtgctggttgtccgatatagacactttaaagctgtgaaagcattagaggcagaagaagtgacatggaggtagttgagccaggtggaccagtgttaatcagtccagctttggagtgtttatgtagaaacatacatgtctatggcagtctatccacatttgaaaaaaaaaaacataatttctttccaaattcattatagctcaggctgaatatatattagagtagttatgatttacaagaatcctaaatgtgtacagactattaaaattatgctgtagataaacttcatacagatacttgagactagtctattaggaggatcatccccaggcaaaatcaaataggccacatttatgtttatgtgttcccagcgccttcagacccttacaatcctgtttcatttcctgtggcacattaataactaagtctttccacccagtcccaacagaccatcataacagttgctaacttttggagcattcactttatgctaggcattctgcatagagacttatacagattatatacatttaattctcacagttgtgctagtggtaagtactattattaacctaagttatagctgaagaaactccaataaagattaatcaactttctcaaactcacaattgacgtaatgggattcaaatcgaactgaagtatgtttgtatcatcactcctcctcagctccagctgggtccatctttgcctctataacgtgaagctcttatttttctcttaatatggggtaatagtagattatttcagcaaactaatccttgctaatctttttaacctttaatatgttttccccttacttagcagtagcatccctcattaagaattaaaatatgtagaaaatgacaaggattctgacaagctgatgggagagaagaatagagcagattgcagtaggaacagatgtgttagaatttattaatcctttaacactgaaagtaaactattgttgattgcctcatggtgtgtttccattattcagtgccttgctacgtgggagtcattccttacatcacagaccaaccttcacttggaagaagcctctgaagataaaccttaatcccattgaggacttctgtttgatctttgggagacagcatttattaaccaaagttattctttctggatctgccgtgtccttataaagtggatgaaaaatgttttgtacccatctggaaaaccaacaacttgaaatctcaggtattccaggtcactgacatgaatttgaagatatatctatctgtatggatatatatctatatgtatatagatatataaatacagagagatatctggcttggttttaattatgttcttaaatttgtgtgccaataattgcatatagattttttttcttaaatatttgactgtggaacatgccattttaaatatgttgtaaggactgttttaataaaaagtttagtatg

SEQ ID NO: 36776 - DNA, 8584 bp, Homo sapiens
gcgaggcaggagccggcggctgggctccgcagcgcagccagcgcagcgcggcgccccgggcccggccccatgcccgcagccccgccggaccgtccttgagcgcgggcgcctagcccgcgccccctgcccgccggcaccattgccccgacggcgcggccgggcggcccggcgctccccaggctccgcgcgggccgaaagacgctgctagcggccgccgcgggtgtggtgatgctgctggtgctggtggtgctcatccccgtgctggtgagctcgggcggcccggaaggccactatgagatgctgggcacctgccgcatggtgtgcgacccctaccccgcgcggggccccggcgccggcgcgcggaccgacggcggcgacgccctgagcgagcagagcggcgcgcccccgccttccacgctggtgcagggcccccaggggaagccgggccgcaccggcaagcccggccctccggggcctcccggggacccaggtcctcccggccctgtggggccgccgggggagaagggtgagccaggcaagccgggccctccggggctgccgggcgcggggggcagcggcgccatcagcactgccacctacaccacggtgccgcgcgtggccttctacgccggcctcaagaacccccacgagggttacgaggtactcaagtttgacgacgtggtcaccaacctaggcaacaactacgacgcggccagcggcaagtttacgtgcaacattcccggcacctactttttcacctaccatgtcctcatgcgcggcggcgacggcaccagtatgtgggcagacctctgcaagaatggccaggtgggccaggcgggggcatggggctgggctgggcccagggcacccagggagcccggggcaaatgggtacctgatcggagttggcgggggcgccaggcggacgcaggtggagatcccaccccacagcggccccgcttggtcatcacgtgtggggatggtcggagccagcggacatcgccgatcctcagttcctgggttcccgctccaagacagacgctgctgggcaccgtctggaacgctactggaaatgcgggaaatgaacccaactagtcagagcgcagggctcccaggtgcacggacttgcccttgggggcttgccccttgggaagtggattcgggccgacagcagtgggcgataaggggagggcaaggatgggctctggcgtatggaacagggagaagcagcatccgcgcccgcgggcgcctaggcgcgtggccatgggcgcgagcggagaaggctggctgcaggaaatgtttggggcacaaaggcaaagggagcccggtgcttacagccctggctgcagtgcctcccctgccctggagaagggaccattgggcgaatctgacaccctttgcaaaatccgggagttggggagctgtttcccactgtagcagagcttccccaaaaagaaggcagtctggggggcgggggagtttttcctcctgaggcggggagggggtggggggtggggggtggtggaagagatggaaactccccctcctcttggtctcccagctccagcccctcctgactctggagtgtgtggggtcctctccattctccgtccccatctcagacgctgcagctggaaagcactgagtgtgtcggggactctggtaccgggactcgcatgtgcgtgtagctctccttggaatggccgaccccaggaccagcctccacccagccccgccctggggtgacaattttagccagctctcttgataccacctcccttcccagtgctctcactcgtggtggcctgtgacctgggggtgtggtcaggctgagcattctcttcgaagaaggggaccactggtcagaactaaagctgagctagtggaagttgagaaggaatctctcacgattaagatacaagaccttgttggaacccttcccacagcagcactgccctgaggctctgccagcctgcgggtctgcaagtcttaggggcagagacaggggcaggcagggaaagtgagcagatagcctgccaggtgcttataagtcagcccttcttctctttcctctgcctggctgctgccccgccaacaccttttctctggtttctgcctctcccctgcctctttcttctattttgctgtttcttgtccatctctctcctgtgtctgccttttccatctctccctgggtttctggcctctcctccccggatctaaccccactcttctctattccttgtatgtctctctttcccacgtgtgtctatcagacatccccgtgtctctcctctttgtccttggttcctgaccaaatgggaggccccagtatccagcaaaggctcattctgcagacagccccatgattccccctattaatcaccaataagggatgcagcaatgtcaccttcatcaatggaatgtcttcctttcccaaagaagtttgggctgacacagagctgaggtttcaggggattggcagcttgcctggatagggaggcagtcattgggccacaggttggccctagaccctgcaccacctcaggaagtcccagcaggtccccagagatgaggcaacaagaggccccggagatgctatgtgcttagaatggggaacttgcttcagtcactgggaggtaaaaccatctcaaaagctccttttccctccagcaggggcagggtgttgacagagtctgatgaaggggtgctcactggagatgggaccacaggctagtaggaaaaaaggaggtggctttaactaggggtttcaaaggcccagcactttaatagttattcagaccagccccctcaaaagaaaaacaggagaggctgggcctggtggctcacgtctgtaatcccagcactttgggaggctgaggcagatggatcaactgaggtcaggggtttgagatcatcctggccaacacagcgaaacaccatctctattaaaaatacaaacattaggccaggcacggtggctcacgcctgtaatcccagcactttgggaggccgaggcaagtggatcatgaggtcaggagatcaagaccatcctggctaacacggtgaaaccccatctctactaaaaatacaaaaaattagctgggcgtggtggcaggcacctgtagtcccagctacttgggaggctaaggcgggagaatggcgtgaacccgggaggcggagcttgcagtgagctgagatcgcgccactgcactacagcctgggtgacagagcgagactccgtctcaaaaaaaaaaaaaaatacaaacattagctgggcgtgatggtgcatacctgtaatcccagttagtcaggaggctgaggcaagagaataacttgaacccaggaggcagaggttgcaatgaggtgagatctcgccactgtactctagcctgggcaacagagtgagactctgtctcaaaaaaaaaagaaaagaaaagaaaagataaaaacgaaaagaaaagaaaaccaggagaaatagtggggcccgtagccccctctcccatgtcctttatgacttcttccaaattgcccaagagactcatttgatctcactagccatcccacttgttagttttgagcccctactaggagccagatttgaggctttgtaggagttcagtccacttgccctccaagacctcatggcctatgcagggggaacattcataacatacaaccacacgccccagcgaatactgtgttaaaggtgggctgggagcccagctgatgactttggtccccaaatgtgttggctgggagggagtgcttcagtagggcctaccctggtgcagaccaacctgatgcagggggagaagatggtgaaccttggtctgcaaagtgaggagataccacaagggagaatataaaaggtcaagtgtaggggaaagccagctcagaggtggacaaggacatttaaataagcagagaaaaaaatggcaggaccagacaatgtatgggaacaaaagagagaagcttgtatctcttgtgacttcagaaccaggggccaccctgagcactgcgcttttccttcctggcttcctgcctgtagagaggcttccagaatttctttagggaggcagagctgaatctgggctctgcctcctctccgggcaagttcgggatggggagcaccaccttcatgcctggcactgaggctccctctgtccttatctgaggcccactggccccagtccttaggggtagccttgcatcagcacccctgatggcaccaagtcctggccattaggatgcaaggagcctggggaaaggactctgggttggcagtggggccctgggtgtggtgagttgcctgcagctgcctccaagatccacagttcaggtgggttggagaggacacaaaattaataaactgggcagggggctttgtgaggatgtgccagggcctgtggtcagggtgctgcttatccagggtaggaggctgtggggaggtgagtatcaccaatgggccaggggtttgacaacagaatctgagtgtggcgagaggtgctggcatatataaattgaaggtggtggtataaagacctaagaaggctgtgcacagtggctcacgcctgtaatcccagcactttgggaggctgaggcgggcggatcaccagaggtcaggagttcgagaccagcctgtctaacatggtgaaaccctgtctctactaaaaatacaaaaaaacatagccgggtgtggtggtgggtgcctgtaattccagttactcgggaggctgaggtaggagaatcacttgaacctgggaagtggaagttgcagtgagccaagatcgcaccactgcactccatcctgggtgacagagcaagactctgtctcaaaaaagaaaaaagacctaaggagatcagcctctcccctggtggtggcagatggccccctggctatcctttctggcccctaatacctttcacaacacagagcacagtgcctggcacagtgggaatgcagttaatgtatgtatgaaaatgcaagtgtcccccatgggccaggctggctcccctatgggagccacatctgtacacccaagaccccagcattgatctgagggcaggaacgtgtttcctggatgccctctcacccagttcccttggtcagaccattgcctcagtttcccctcctggcagcccttgaggagctgattatacagcgctccctcataacaaggcccaaacctgctttcctgcttccttggcaacctcatttccccacacttccccttggaccccaggaggagctgcaggcctcaactgtctccagtcaggcagagaattgggacccctgggttccattcttggatcccccaccatctaaggatggaagggcataaattctctctgcctccatggataattaggataattacggcaacaatcatggtgatgaataaataataaacataagcataacagttctgatgcagtcacatcaccaggagattcctgatgacagatgactctgttccaatggatttggctattaaggagcacactgttttaatgagttaaggctaaattaatctgggcaataaaaataattgttattagtagtaatttattagcaaagataatgaaatgcatgtgtaataataaatattaccaggattagggctcagggaacaatacagaagttggctgtttgctttcagctcttccctaataactcaaagccccatcaagatctaatgtttttttttctttatcatcaaaagacttttacagaggtggcagtggtgaggcaaagtcttctcatccattttctagacagagaaactgagctccttggcagacagcatctcccccttcatttattccctcccacctttaactagaccagttttcccagctaagcacacaaagagtttcttctcaggttgggaagaagaggttgagggaaaagaaggggctggagaagggctttaaagggaggccctcatgcaaatatgtcgggtcctcttcattgcagcatcgcggctgagtcagcagctctggcacagctgacctgcagtgctgcctccagcccaggagagaggatgggcccctcccctaatttggcttggttctacccagacttcagccctgggagttgggatggtaagctgccttcagtgaagggacaggatagagaggggccgtggagaaacctggctgagagaactccactcagtgcagcctccccacaccacaagccacagtcctggagagggcgcttctcttccatgtctctacccaggataccctggagaggccccgatcctcaaactcaggacttatgtttccatacctgttagctgaatgtctgtagatcattcgttcaccaccacacaatctctctctctctctctctctctctttttttttttttttttttgagacggagtctcgctctgtcgcccaggccggactgcggactgcagtggcgcaatctcggctcactgcaagctccgcttcccgggttcacgccattctcctgcctcagcctccccagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcctggcctttttttttttttgagactgagtctcactatgtcgcccaggctggagcgcagtggcatgatctcggctcactgcagcctccatttcccaggttcaagtgattctcctgcctcagcctccccaggagctgggattacaggcgtgccactatgcctagctaatttttgtatttttagtagagatgggggtctcaccatattggccaggctgttctcgaactcctgacctcaaatgatccacctgcctgggcctcccaaagtgctgggatcacaggcatgagccaccgtatgcagccaccacacaatctcttatgattatagtcagagcccccaaaagtgacggcaggctccaagcccaaatgctggtgctcccttgacccattatcctgcctgtccctccccatcccccatcaaggcagggaccagcaaggatgtcacatcagactgagaatcccagagggaagtaaggcctggattcccttcttcccacccagttcctttctaccaccctgaggtgagacaggaggagctacaatcctctttgggtgggtagtgacaggtacatagctacagctccatggaggctggcacccaggccccttctaaactctgggaggggaaagcattaccaggccttctgtctcactgctgcagcaggagagactctggaatgcacttcagaccaaagacctggccctggttccagggtggttgctgactggcagcctggcattggtccagctgcctgacctgtggggccaaggtgtgcccttgtgtccatccactgacataagatccagcgggtgtggctgaaacgatggcatcattatgaaagcagagaggaaggaatgatgagagtagggaaggccctccattccctggaggtccagagaattcctctttgcaaggacaggcttccaggcttcctggaggtattgaggttctcagccagctggagggaaagccctataagagttaaggaggaagactctgccttgactcccaattcaggcccagatcagacctgccctagaaatccagggatcctctctgcccctttcctgaaacaagtcctgtatgattggaagggggcgggggagggggagcgtggcagggatgaggcgaggctggaggccaggtttctgggtctgctgatcctcccccacgggactgcctcacctccctcccttctcatcctctctctcctctcgccctccctcccgtgtcccccacccgcaggtgcgggccagtgctattgcccaggacgcggaccagaactacgactacgccagcaacagcgtgatcctgcacctggacgccggcgacgaggtcttcatcaagctggatggaggcaaagcacacggcggcaacagcaacaaatacagcacgttctctggcttcatcatctactccgactgagctccccacgtctccctccacccacgtccctcacccgccggggtcccctccgggcggggcagacgatgactcgcccctcgcccacccgctcgctgcccggccctccccggctatgacgcccccggcccgtgctcaacaccgcctgggccacagctaggccctcccaccggctcgctgcagagccgggcccagcgcgccctgtccccgtgccagggaaccggggttgaccgcccccgcccagcccgcgctatatatttgtacaataggactgtttactgcccacctccgcctgccagcccaccccagcctggggagaggtcgcggcggcgggtttgcttcctgcgctctgagatgagctgccctccgctccctccggggtggcgcgcccgggggaggggggagttgggggctggatagcttcccagcaccctcagagcccccgcccggctgtgccccgtctgaccaaagttataataaaaacattttcaccccgca
